United States Patent 9,487,797 (GENOMIC PLANT SEQUENCES AND USES THEREOF) - sequence listing, part 21

SEQ ID NO: 51400 - DNA, 1501 bp, Oryza sativa
tatgaatgggccaagaactcagaattgacacgatgaattgggtcaaaattcacaagtctacaaagtgaagcaatagaggaggccgccagccgaagatgggccaggaaggcccagcccatggttcggtcgaacccatcctggcaccgttggatgcagggttcggcgtggacgtccaagattgcatcccaatgatggttggagggcacttcggacaattccccttccacaaccgtcataaccacctctatataaggacttcactctcttcacttcaacacacacctcaagcaatagctctctcatttctctcaagtttagtttagtaatatctagctagtggaataggaatagagtagaaatcatgagtccggaagccttcggaagagttcggatatagctctagtaggttttctcttctcttttgtaagctttgtacttttattagaatactcttctaaatacatttatggtattgaaatactttccaagtatatgagtacctactttacattatgttcatgttatactgaatatatggctagcttatctgggatatgctttggtgtgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacgggtattgctccgcgccagtatataatccgaagttaattcgatggggagggtattcctccgtatttagacccggttatatggtcatgacgggttgtcgtaaggaacttggcagtcaggggtggcttctcgaagtaccaggagggcatcggatagagggtattagctagtatatcagttaactagaatgtatggatactatgtatattagaagtataggaatagatttttttttctctttcctttccacttagctcagataatatattatgagaatgagtagtaatgcttgtgtgtcactctacccttggattatcttaacccatgcttagaatttgattatcacaagtaatatataaattattagttgagttctctctacatgatcttcccacgggataaaataaatacgatacacttggaataccctcgggtaaaattctacaatggtatatccatgcgcttgtggatgaactctgtaaccataatataccaggagtttttctgcgccattgctgggaattatatttctagtaatgttgttaagaaatgccaacaagcatttctggcgccgttgccggggaagattcataatagagattacttgaactaatactttatatttacctctgtataatcattttactttttgcaggctaaccttggttgttttcactgtttgctgtggaaacagggtagtgcatgactggtttcatcctgccggaaaacttcaaagaaaatccagaagctttcttccggatcgtcatgccgcgagtcgtt

SEQ ID NO: 51401 - DNA, 1501 bp, Oryza sativa
tcagggttgcagcacccggatcatccatttcgatatcaagcctcacaacgtccttcttgatgaagacttatgtcctaaaattgcagattttggattggcaaaactttgccacctcaaggatagtgccatctcaatggctgaagcaagaggtaccatcggtttcattgcaccagaagtattttcaagaggcttcggagttgtgtcaactaagtcagatgtttacagttatggaatgatgctgttagagatggtagaaggaaggaaaaatgttaaaacaaatactgataattctagtgcatatttccccaactggatttatgatcatttagcgaaagatttgcaaagccatgaagtcacatgcgagaatgaagagattgcgaggaagatcacactagttggcctgtggtgcatacaaactgcccccaggaaatcgtccttcaatgagtaaggtcatagaaatgctggagaagaacatcaacgaattggagatgcccccgaagccgatcctttcatgtcatgcagcgccatcgtatttttcatcttattcttaactaagaattttcttttgggatgattcattctatatatgttccgccactcagctaaagtaaatgaatggaagtatgtttttgttaagccattaaatttattacttatcgcaacaactaaactcacccccaaaagctcaacagcctgtttggcaaagttgccccaaaagcttaacaacctgttcggcaaagttgttttagcagaggtgcacaattcagttcgatagatagataggtgtcctcatcaagaattaatcacatacctggggtcatctgcagccagcccagtctggaagtttgttgcagaagcacaccaccttcatccgccccttcttgtcacgcgaggagacggcggttgtcctgcttccctcacagcccctacctgcaacagcacgacactatcggtattggtctcatcagcgaggtcgatctgagccaacgccgctgaaatccgatgccctgattccctagacgacggcagcagtgtcgcgctgaagagacggaggcggcggatggataaaataaaacctaccggccggcggccgccgtcttgatgcaacaatataccctcaagagcgtgtaaaccaagcaagaggtgagacgagagccaccaaaacctcgagggagttcgccgacgggagaggccgcccgcggcggcggcggcggcgatgcatgaatcagccgccatccatcgagggggtttttaactatttgccactcttacgaagcggtactcttgacatcgccactcttccaaatttacagaaataccacaggagagaatgaatttttacaaattaccaattttatctaagggaagggccatgtcagctttaccagcactaaaggggacttcaaatgactcttttgcccctgatttgaccattgtagcagttgactatacaccaaatatttgagaaattatatatagacgtatctaagaaaaatacggt

SEQ ID NO: 51402 - DNA, 1501 bp, Oryza sativa
tgaaaaataaagtcaggtgcatcgactagatgcacctaataggtgtagccctcgactgtgtggttaattgaacaaacaaagcatatagtcaaggaataaataatccaaccaaccgagtggcttcgataattatagtcaaccaagcgactcgatattaatatgtagcatatgcggtgtgaatccctgaataacatgatccgagtgatataccgactgctttgtaaaatatgataagtgtaacctaaagttggctacatcattgaaaattcacatagcaaaacagctataaagaagcttgtatgttgtgaataaagaaatttccaaagtattgggcatacgccatgcgcacactactttaacagatgtgcttaagtccctaaaagacacatggtttcaccacacctgaaaatatatggcatatgtggtataaaatccgagtaaataaactcataaaggatttaacaaccgcctggaaaatgaccaaaatatataatcagcctaagccataatattggtcaataaaagtgcacacttacgtggcaaaaagcaatgatattgtatcgaatcaattgctttacgaacccaaacaacgccttgacttatataaaaaagtcagcgaacagctatataaagcattactgtttggcaccttttaaaatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgagctgcagacatattaggcctaagccaaaaaaaaatatgctttcgacaccctttaaaggatgacgcatgtaacatgctcccgagtgataaatcttccgggtgatatagaccaagtacagctcatatgaatagcttctgatctgagtgattatcccttatgggatactcccaaatagatatagtaattgaatcccgactggcgcaagtattcggttgataaccctgacggggaataataaatagtccagtctttgagcatagaaaataaactcatgatcataaattcatgttgcatgtatccggaataagtccaaattgaaggtatgatacttgtgtttgagctagtaaacccctgagcatatagtttgtccttctatcgtagtcacaattgtccattgaaggtagctgacgcagttagcatagagacaagacgaccaatatagagataatattgcccaccagaggtggcaaaaatattggtggtagtgaagatagtgataccaatcaaaagtgatgaagttgcacagccgtggaggcgaagaaaccagtcgacaacagtcaggtcagccagcaatgaataggaaggcgcccagtgataaagtgacatgatgaagatgacgatgtcggcgatccagtcaatagtagtgtcgcaaccaatgataatgacgaagacgctcatcagcatttgcatagtaggtc

SEQ ID NO: 51403 - DNA, 198 bp, Oryza sativa
gaggacgacggtggcaacgaggccggcgacccgggcgcatttgaatgagcccccaggcccccgccaatcttaacttttttcttgttctttcttctaaggccttcatgcctcttttttgtacaatttaacttaatctgcaatgagaaatgatgaaaaaaattttgtattagttttattttgctatatatgagatgagga

SEQ ID NO: 51404 - DNA, 180 bp, Oryza sativa
cccgtcaaggtgtgagtttctaagcactcgtccccagctggagctagcgtgttacatccagagatggcacgttaactccgatcgatatataccaggcttcatcctaaccattacaggcaaggtgttacacaaggaagggcaaacatgcatgttgttaaactgacgcgtggtggacaagaa

SEQ ID NO: 51405 - DNA, 312 bp, Oryza sativa
accaagttcaccagcaactaggcctgtctctctagggtttcgatgccatgcttctctccttccctttcccctcgtgtgcagtgtgctaggtggcagtagttgcaaacttgtgcctgctttgtaaattgtgcttgatcataatgggcagcttggatttgaagtaatagacgtgtcgagtgttatttattgtcggtggctgattcgcatcttgtgtttttcttttctctttgcgattgcgatttggggatctagggtttgaggagatgatgctgcgaggtgggcggctgggtggcttggcctctcggatggttg

SEQ ID NO: 51406 - DNA, 1501 bp, Oryza sativa
aaacatggtcttttggaatatttgttagatattgatcatttaggtattactagtaacatatccttgcactataatgggtctggtcatataaaatagggatggattgtaataagattaaggataaaacattggatctggtgaatacctatgtatgctaaccgtgcgagcacagtgggagaagggggtggaaagaggacaactccaattttaaagcagtagagattagttagaatattttattctacatccatcactgcttgtgccacatgacagtatccagtgattatgttgatagatcttgaatatcaaagtagcatgctagctagacattttctcgaaccgaagattgatctaacttcatttaactttttgtcacctttaagatgtggcaattaagtatttgcctcaaagtctttgacatgtgggtcctcatgtgcctataacatgtggacccagtgataaatccttaattatcacttataagagtggcaaatagttaattattcccccaaacatacacataggtctgcacataccgttgttactttggaagtatggccgtgtctagttgtttggcctaaattttttttacgtatacgaacacacatttgaaatattaaacgtagattaataacaaaacaaataatagatttcacatgtaaactgcgagacgaatctattaagcctaattaatccgtcattagcaaatgtttattgtagcactacattgtcaaatcattgcgtaattacgctcaaaagattcgtctcgcaattttacatgtaagctgtgcaattggtttttttttctcgtccacatttaatgttctatgtatatgtctaaatatttgatgtgatggaatttttagaagtttgaagggaactaaatacagcatatatgttttttttttctcccgaaaaagaaaaaacaacaacatagaattgactgcgcacgagtccacggcccaagacctacccgctcccggccctctgaccgtcagtccgtcaccaacccatgggccccacctgcttgccgcctccaggcctcgcaccctaaaaaaaataaaaataaaataaaataaggactaaaaacccggcccgctcccacgctgtgtcacacccacctgccacctcgccgcgacgaccccctcgccgccggccgccaccgcgcgtcaactgccggcgatgccgcccccttccctcctgctcctccatccacgcacgccgctgccgcaccaccaccgctcctccttccggacgagctctccgcggccatccaggatggtctgcgccgctgccgaggggtttatctccgcggcgccgatcctcctccccgacggcccgtggaagcaggtgggtaactggtttccggtgaagccgcgggggcgttgggctgtgggtttttttttttcagtatgctgaatctggtggctggttgctgatcgggtgcgggttcaggtggaaggcggcgtcacggcggcgaaggggttcaaggcggcgggta

SEQ ID NO: 51407 - DNA, 1501 bp, Oryza sativa
tgtagttgtttgtaaagagtctaatcagcggagagatcagttctgcagtcaacttgtccttttcatttagttgtccagttaagtgcctcatctaatttagttgtttgtatcagtggattttttttatccccttagtatctgaagtagatcagagataacatcacaaatgaggcccactcaatctacgagggtaagtgttatcatgaatcacgataaaccactctaggcttcaagtaattaagctagaaatgtgtgtgtggtgtgcatgtaccttcaattccaattgaaaaccaggtagaaagtactatatacagattttcagaactcttctcagataaagaagaatcaaaactaacatcagaaaggtaaattgcgggtcataggcaagataggggatgagcagagcaaatacccgtccatccatttccttaacagctttctctccgtctgcttgagaagaatatttaacaaaaccaaatccttttggccttccagtttggttctcttaccaatcgagctacgcttgataaggtagataaagcagagtgaaacttgaatgccaattaagagcaacaacaaagatttaaattgcctgtgctgaaaagcatgtgactactgagtactgactagtaccttcctcaacagcgccaaatggtgagaagacatttttaagttcttcctctgttgtgtaaaatgatagccctacaaaatcccaaaatgagtgaatggatgtttaagctgtatgagcaagcaacatcaaaacatgatagaacgagtggacaatccactaagaacataacttgcatggctttagcgtgcacaaatagcagaatatctacagacaacttatgtgttctactcatggtccatgtgaacaggtgagcatctcacaggctcagcagattagggacttctaagtactctatcaccaagagaataaatcagcatctgtcaaactctatgagctctacaacaacagctagctagtatgtatctaggctgtaattctctaacccgctagaaagcatcctctgatcgatccttcattgcaatcaaaaggaatcatattctgaaagcaccaagcctcaacaacttaaggcatgccatagctatcatattcagaaaaaaagaagggctaaaggacacaccatttagtgctcatttcatccaccacaccccccagaatcacaccagatcaagaaaccccattcactcatgaagttctgacgcacagatcatcacaagcggacctgtgaagcagcaggacatcacatcacaggctcacacagatccaaacattttgcaaaccacaagattattacgtaggcggcgaaaatttaattacatggagatgaacttactgctcacaaatatctccgtgctgaaaggcttggctccaaccatccgagaggccaagccacccagccgcccacctcgcagcatcatctcctcaaaccctagatccccaaatcgcaatcgcaaagagaaaagaaaaacacaa

SEQ ID NO: 51408 - DNA, 1501 bp, Oryza sativa
ttaattgttgtgatatagtgtgtctctctcctcacactataccacaactatcgcgtatagagctcccacctccatatagacttacgcgacctccccttcttatttcaagtaggttgtgttctataggaaaggacgaagagtagtttttcatgcgcaatttcgccttgtgtttttttaaaaaaatttctatatggaagttgtaaaaaacttattgatatattgtttcagttcacaatcctcacaaataatgcagtaagcacttattaaagcagtttataatttcaatccaatttctagcaaaaggatcattgattttatacttatcacgagaagttcactgaaattacattcttaggagaagcagcgtatacacacggataaaacacggagaaaatctttacgagagatggttggtgtttgggaggcaagaacggccggcggcggggcggccattacgcggatgggagcaccttcttgacgatctcgtcgctgagggaggcgatctgggcgtcgagcgccttgacggcctcctccttctgcgcctcgaggttggcgagcgcctccacgagctcggcctcgacgcggcggcgcccctcgtccagcttcgcctccagctcctgggtggtctccttcttcatcttgttgagcgccgcggcgatctcggcgcgtgccgccttcagcacggcggcggcctgctcctccagctgccgcacctcctcggacgcgtccttgacgccgccgagctcggcacggatcttggcgtcgcgctcgtccatgaacttgcccagcggcgtgaagtagagcttgtccagcgccaccatcagcagcaggaactcggtcgcgatcagcgggagcgtcaggttgaagtcgaacagcgccgccttctccatctgctccgccagcgccggtagcggcgccgcggccacggccacggccgccgtcgccacgagccccggcagctgcttcaatcccctccgcggttgctgctgctgctgccgcctgggcggctgcacggacgacgacgcgacgaccggcgcgcggcgaggggagcacgaggtggcggtcgcagccatcatagccgtcgccatgggctagtgcaaggagtgcgcggcgcggaggaggtaagcagcagcagcggcggcggcggcggcgactcgaggtgtggtgagctgagagagagaggaggaagcgggctatctaatccgaacgggttgggtggtgagattccgaagcaaccaaggccacacgacgccgctgctccatcgccgccactaaaaaacctctcctcgatatatcacgccaatttgggccgtacaaaactagttgggcccattagcccatccaaattttaggcccctacaaaagcacaacgggccgtagcctgtttagtactactacaatcccgagcgttcactccccctcccgcatccaacggctctggagaaattctacgtcatcgatccgcctcccacccatgtcgaccaatggggttccaccacgc

SEQ ID NO: 51409 - DNA, 1501 bp, Oryza sativa
gcccaaagggagcaaaggcatttttaagcttctcatccgtcgttaaccttgaaaggcctgtgttgcatcacattaggcatatgtgagcatgcaaacaaaaacagcatgacataaaaaataaagtctaattcaaatacataaatgtagtattagtacatgcaacaacaaatatagaaacgtaatagaattcgacagtacaggatatgatgtcttcctcaagaatgccgacaagactcagctgtattattagtcagtgggttcagttgttcatgtaagcatatacgggcaaagatattgacaaagagcagaatagagcatgagattaagaagcatactcagagacagatctgtagaaagcaaacacactagtttgctctgatttagcataaaacatgataacatcgcagcacagtacacacagccatcccaaattataccgagaaatcgggctccccaaatcatcttcataacaaatatatccatcttatgcagaaaaatgtgatgtgaaacaaagggaggggagagttaccgctgatgaagagcttgggggcggtcagcggcggcacgttgctgacctcggcgccgtcgccgaagacggaggaaaggggcgactcggtgggcaagggggcggacgaggaggaggagcagaaggtggcgcggagtattgaggaggcggcggcggaggaggaagagacgggggtagagccgcggaggaggcggtggagcagcgaggaggagagcgccatggccgccggctaaaaccctacctccgccttggctctggtgcggtgctgcggatatccccggtccgaccgatctgctgggttcgggttcgacctgaccaggtccgcatagcagagtgggctggagttacgcggttacacgccatccggtccaaaatatggcgcataggagagaacaactcgtttccagcggatagatcatcgagccatccagatcattggagaaacttctgaagcaaaagcccagcatgttgggacaaggtagcagtagagtatcgctattgaaaactaaaatagatgttacatatcctttatcgttttatgacagtgcttgtcagtcgcagatatagatattccagccttgccggcttatgtttgagcgtattggcgcaacttatgcgcacttatagcttgaagaaagtaaatttggtgcaattatcccaacttatgttcatttgatagcttgaagaaagtaaatttgctgcaattgaaattaattgttgtgatatagtgtgtctctctcctcacactataccacaactatcgcgtatagagctcccacctccatatagacttacgcgacctccccttcttatttcaagtaggttgtgttctataggaaaggacgaagagtagtttttcatgcgcaatttcgccttgtgtttttttaaaaaaatttctatatggaagttgtaaaaaacttattgatatattgtttcagttcacaatcctcacaaataatgcagtaagcacttatt

SEQ ID NO: 51410 - DNA, 1501 bp, Oryza sativa
ggaaatgttaacaaatggtcttccctgaaaaggtagaaacccacggaacaatggatcggatttagcttaagccaaaacataaatttaatgatttggattgtggtttgaacaaaggatcatgacttatatttggtttgttgttatggaaccacaggcataagcagacccttcatgcagcatttttcgcattcctggaattccttgatcatttttgttccttccagttccttctttttaaaaatattggagtactaccatagatagcctcattttggaagtgtttctattgccatgccaaaaattaagttgcacaattgttagttgccgaactgcagcctgcaggtggtaacgaatcaggctttttatgtttttttttcggactacttgaagtgataaaggcatttgctctcagccattgcatgtctctctgcagggttatttttcgcttcttctaagtctaattgaggcgcatttaaaggcctggaatgtccgtcttcttacggcacctgttgatcctgaaatggcaccaatctggtctgagaaacttgggtacactattttgtcagatgaacaggtaatacaacccttccttgtatttgtgcattacctgtggttgctgaaaacattagcttgtactagccaacaacagtaatctctccaacaacagtactgacattgcactattgatgctgtgcttgttgacagaagcattctatgctgatggcacatcccttggtgatgtttgcgaacctaagcttggtgcagaaatcacttgcttgagaagaccgattacgcggtttttaggataaaatgttacctttggagagcaacaggacagtttttgtagcctgccatctttttaatggatggttcgaggctcaagatgtatagagaagagagtagaggcatctcagtagatttttttagcaagtagtaatcggcaaaagaaatactaaaaaaaagagtagtttttgtgattaacgtcgagtgaatgattcgaagctgaagtacctaagaatagaagcgtctctgacattatatactctgctgagagggttgcgtgtgtgatgtacatcatttgccacacatgttctcagttccttactttcttaatgtcaattaggcatattaatatcctgtcacacttgtacccgtatcccgtatctgtatggtatgcataccatctcagggcagaagatttgtcgctgattgctgagttcctttttactgcagttttataagccgtgacatatcagatcaacgaaaaataattttagagctggaaatacttctgttgttagtattcttaggactgaacttttatacttttattcttcgctgtttagaagtcgaatctgaaaaatagaaaacaataaaagaacacctaaactaatttgaaattaacgagaaataatgttaggggtggacttttaaacttatattcttaggactggacttttatacttagactcttaacggtttagaagccaaagctaaaaaa

SEQ ID NO: 51411 - DNA, 1501 bp, Oryza sativa
accctactcctgtgtttttgtggatttgtgtatgaatgagctacaaagtgtgagccaactccccccccccgttctaagctctaaatctggaaaagaatccacccaaccccctctctatgggcaaggtcctccttttatacttcaaggggataccacatgcacccctcccctttccaaactggacttttcttctctttatggacggagattggtatggttgctgtccgaatgacactccgatgggacagcccacacctacctccactcccggcgacgacaggcgcaacgtgggatcgtggctgcccgttgctgacgcgaccagtgccagaccggtcattcttgtccaccacgcgtcagtttaacaacatgcatgtttgcccttccttgtgtaacaccttgcctgtaatggttaggatgaagcctggtatatatcgatcggagttaacgtgccatctctgggatgtaacacgctagctccagctggggacgagtgcttagaaactcacaccttgacgggatggggtaaggcgtgcgtcagaccgccagtcgccacctaacccgtgatctgaccggtctgtgactggtcacagaccggataaaggaacgcgccgtactgcgctgcatgcagtgtgacacgcttgaccagactgcaataaatgctgttaggtgagcacagctgtgctcacttatcccatatatgtggcgcagacttccttaagggggtcggggtgcctcggccctcggggccggggcaaacgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccaccctgtgacaggtgggaccggtctccgtagttgggcaaaataccgaacggtctcaatccatgcacattggtattggtaactttggttgtccataatgggcggtctattcaagactgccacaccacttgagcagcgcgcgaatctggatgagcagattcgtctcgcccggagatatggtaacgccgcttcggtcggcgagcgtaattaacgcgcgcacgatacaatccatttcgattgccacaaccgcatatccactcaatgcgccgtaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgcca

SEQ ID NO: 51412 - DNA, 1501 bp, Oryza sativa
ggttgcgcgtttttacaaccaagtcatcgacatacgcctcaacattacgtcctatttggctacccaaagaaattcgagtagtacgctgaaaagtaggacctgcattctttaatccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtttagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcggctttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcagcctgccctccccgggcaatgcacggtgggtggtcggtctggtcgaaagtgagggcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccgg

SEQ ID NO: 51413 - DNA, 1501 bp, Oryza sativa
gcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggccgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgaggaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcatccagattcgcgcgctgctcaagtggtgtggcagtcttgaatagaccgcccattatggacaaccaaagttaccaataccaatgtgcatggattgagaccgttcggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtct

SEQ ID NO: 51414 - DNA, 1501 bp, Oryza sativa
atggatatgcataggagaatatcttctttggtactcctcatttttttttcattaattagtttaaaaatcctgaatatatatataaatatgcactaacaatcaacttactgttttcaacctatctttttcattatttcagacatatatgcataatgcattgctcttctttcaatatggccaggacttccttatgcaaccatcctggtctttcagcggcatggtttcacactagtataagaattgaggaaacaaacggtattgactgttctgctgaatgaatttcgtgcaggacttatccagagtagctagcttaatttaattattttccgcaacttgcagatataagtatgtcgtttcagagtatttattcatgcagtcgatcactgctaaattatttcctaaatttccatatatataactacggtatctccattaattattgttatcatgctgttcagatgaaaggagaaaattaaaaaaagactaattcagatgattatacagtagtgtggatgcgttcgttaggaggataaagggagaagaaatccatctttcactcggatgcttcacgaactaaacatccgagtactaaacatgtgtgttttttttttacatttctataagaaagttgtttaatcttctcatttctcttttctcaaacacaccctaaattaaaaaatagggaaacatatttttactcccttcaactattccttgcttcacttagcattctaaaatatttttggtcattttgtagagccattaatgagaatataacctgtgctatacaatagttccaagatatatctttcatgaaagtttagtatgcagaaactgaatacgaaatccagagaaaaaaaagttgaggcacaagttgcaatgcatcaaaattctcacttagttaaaaagtacttatatacaaggaaacaaaaccaaattaaatactattctattatagaaaaaagtgaacctttttaagtaactaaactaaaaatgacaaaaaaataaaccgaaaaatagtttaagatgttaattaaatggaatactttaataaagtagaagagaatttatcgtaaaaaacaaaactatattgtcaggataagcacagtgagattgaactgcacaagcacaacgactctaaaacaaagggtttaatttgtcatttgttttcttgtggtgcaacatgacaacaatggctatcggccggtaaagcggtcccatcaacgttgattaccagtctgtggatattatgggtaccccatacccatacggcatggttatccgactagtcataggggataacttatatctatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggtatga

SEQ ID NO: 51415 - DNA, 1501 bp, Oryza sativa; identical to SEQ ID NO: 51413

SEQ ID NO: 51416 - DNA, 1501 bp, Oryza sativa
ctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtctgcgccacatatatgggataagtgagcacagctgtgctcacctaacagcatttattgcagtctggtcaagcgtgtcacactgcatgcagcgcagtacggcgcgttcctttatccggtctgtgaccagtcacagaccggtcagatcacgggttaggtggcgactggcggtctgacgcacgccttaccccatcccgtcaaggtgtgagtttctaagcactcgtccccagctggagctagcgtgttacatcccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggagttggctcacactttgtagctcattcatacacaaatccacaaaaacacaggagtagggtattacgcatggcagcggcccgaacctgtatacatcgccgtgtctcgtgtgtcttgcgggcagacgatctttccagatacagagggagagcgagagcttgagatctcaccctaagcccccggccgaactggcaaaggggggcctgcgcggtctcccggtgaggagccacgagctccgtcagagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacacggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttg

SEQ ID NO: 51417 - DNA, 560 bp, Oryza sativa
ggaaatatttgaactgtttagtccataatgaactctgttatttatctggtgtaatctagtttgcatatttgcacaaaggcaaacctattctttggcttaagaagagagatgctgtgcacctaacttggaaatgttaacaaatggtcttccctgaaaaggtagaaacccacggaacaatggatcggatttagcttaagccaaaacataaatttaatgatttggattgtggtttgaacaaaggatcatgacttatatttggtttgttgttatggaaccacaggcataagcagacccttcatgcagcatttttcgcattcctggaattccttgatcatttttgttccttccagttccttctttttaaaaatattggagtactaccatagatagcctcattttggaagtgtttctattgccatgccaaaaattaagttgcacaattgttagttgccgaactgcagcctgcaggtggtaacgaatcaggctttttatgtttttttttcggactacttgaagtgataaaggcatttgctctcagccattgcatgtctctctgcagg

SEQ ID NO: 51418 - DNA, 757 bp, Oryza sativa
acctgcttcaggaccttgaagatgtagatcttgtaggtctcgacgctcttcttcgccttcttcctccccttcttgtcgccggcgccgccctccttggacgacgccttcgacgccggcagccgcttctccgccttgggcttcttccccgccggcgccttctccgccgacttctcctcgccggctgcgggcttcttctccgccggcttcttctctgccttgggcgccatcggagctgcctctcgagggatcggctcaaatggagagagagagagagagagagagagagagagagagagagaggcgggattcgtgaggaggaggaagaccttttcccttcgcgtggagttgaggcaaaaggggaagaaggcctcaattatatataggcgcgtggtggaaccccattggtcgacatgggtgggaggcggatcgatgacgtagaatttctccagagccgttggatgcgggagggggagtgaacgctcgggattgtagtagtactaaacaggctacggcccgttgtgcttttgtaggggcctaaaatttggatgggctaatgggcccaactagttttgtacggcccaaattggcgtgatatatcgaggagaggttttttagtggcggcgatggagcagcggcgtcgtgtggccttggttgcttcggaatctcaccacccaacccgttcggattagatagcccgcttcctcctctctctctcagctcaccacacctcgagtcgccgccgccgccgccgctgctg

SEQ ID NO: 51419 - DNA, 1501 bp, Oryza sativa
cagccgcccaggcggcagcagcagcagcaaccgcggaggggattgaagcagctgccggggctcgtggcgacggcggccgtggccgtggccgcggcgccgctaccggcgctggcggagcagatggagaaggcggcgctgttcgacttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatgaagaaggagaccacccaggagctggaggcgaagctggacgaggggcgccgccgcgtcgaggccgagctcgtggaggcgctcgccaacctcgaggcgcagaaggaggaggccgtcaaggcgctcgacgcccagatcgcctccctcagcgacgagatcgtcaagaaggtgctcccatccgcgtaatggccgccccgccgccggccgttcttgcctcccaaacaccaaccatctctcgtaaagattttctccgtgttttatccgtgtgtatacgctgcttctcctaagaatgtaatttcagtgaacttctcgtgataagtataaaatcaatgatccttttgctagaaattggattgaaattataaactgctttaataagtgcttactgcattatttgtgaggattgtgaactgaaacaatatatcaataagttttttacaacttccatatagaaatttttttaaaaaaacacaaggcgaaattgcgcatgaaaaactactcttcgtcctttcctatagaacacaacctacttgaaataagaaggggaggtcgcgtaagtctatatggaggtgggagctctatacgcgatagttgtggtatagtgtgaggagagagacacactatatcacaacaattaatttcaattgcagcaaatttactttcttcaagctatcaaatgaacataagttgggataattgcaccaaatttactttcttcaagctataagtgcgcataagttgcgccaatacgctcaaacataagccggcaaggctggaatatctatatctgcgactgacaagcactgtcataaaacgataaaggatatgtaacatctattttagttttcaatagcgatactctactgctaccttgtcccaacatgctgggcttttgcttcagaagtttctccaatgatctggatggctcgatgatctatccgctggaaacgagttgttctctcctatgcgccatattttggaccggatggcgtgtaaccgcgtaactccagcccactctgctatgcggacctggtcaggtcgaacccgaacccagcagatcggtcggaccggggatatccgcagcaccgcaccagagccaaggcggaggtagggttttagccggcggcca

SEQ ID NO: 51420 - DNA, 287 bp, Oryza sativa
ctgttatatgtgtcggtaagaataagaatatgtggactggtcgcaatgtcaagattatgtaagctcatttatatgtaactctacaccttaaaattttgacaggaaaccccatacggtgcttggagttattagtgttgacatgattgtcttctgtaaccaggttaatgttctgcttaatgtttttctcccacaacagattgcctttgatacttagatcagtcttataatattcaaaaaagaaagataagattgtcaccttgaaattgtgccgtattctcatgtacagt

SEQ ID NO: 51421 - DNA, 889 bp, Oryza sativa
cgagaggcaggggtgctcacggcggcaggagcaggaagaagacagagaacgtctccggaggaaaatatataaaaggtgatcttgattttttttctttttagaactgatcttgatttcttgatgaagagatatcttccgtaactaaatagatataagaaaattatgatttcagttggtttttcgctcctacatggcacgccatctgtgcaccaatgcatccgcagatctttgttgggccttaatcattagaccactcgagtattactagtaggcctaattgccgcacaagtattcgggagaagaggtcattttcttattagcgcatgattaattaagcgctctctctgtttcatattataagtcattttgacttttttatagttaaatttatttaagtttaatcaggtttatagaaaaatttagtaacattaataacaccaaattagttgtattaaaactagcatttaatatattctcataatatgttttgttttatgtcgaaaatattgctatattttcctataaacttggttaaatttaaactataaaaaagtcaaaacaactcatcatatgaaacagacagaatattagctaaaactaaattgaaaaatagatcaatataatttttaaaatcaactttcgtatagaacttttttgcaaaaaaaatatcatttgtcggtttagggagcgtgtgcatgaaaaacgagaggtataagtatcgcttgtgcataagaagacaacctaagcaacaaaaatacgatctatcacctgttcatgaaacgaagatggaacaatgtaaagttcactagttacaatgtaattttcatgagtattcttgtaggtattcgttgtaaaatccgtgaaaatcatttaaatttaaaaatctagg

SEQ ID NO: 51422 - DNA, 1501 bp, Oryza sativa
ttccagttgaaacgaagctaaatgacataaaaatttttttaaaaaaagatagcccaacagaaagcttagcatcttgaagtatacaaaagctagaaagctgtaaatgctaggtactcaattaaatacctttccacttttcgtattgaatcatatttggagggagactgatcacttttccaatcacatccccaagcatatcaagtttagtgtatttcagtccttgtatcaccatatataaagaaatcccgctgtccaagaatatgtgattgttttgattgttagacgactcaccggaatgctgttcaaactcacatgcattcattatctgcaatttgtcaaacatgattaatgtcaggtcaaattttcagataatatatgggaacagacataaaaaatttcgctaatagagacaacagaaagctgacatttctatatccacattctgagcagccacaagaatatccttgtccatttattcttccaatcctctccacctaaggataaccaaaagaaacatatttttcttcaggtataaatcaaaagcagacttcaagtcagattcaacagcgaaggaaccacacggacctcattcttcttgtaggttaccctgaagccttcaagaagaccagtggacagcaatccccttacatctttcagtatactctctggccgatacttggtttctgtcacccgcaccttaacaggagcggttattaacatgctactatcccaaggttgctcaagaactggattccttgtctgttccgcatcaggcattgcatggtcattggctgctccaattcgcactttaacagcagaggttgttgccagcacactatccctaggttgctcataatctgcattcttcaactctttcgcatcagacattgcatggtcactgccagatgtaacctccagtttaacagcaagggttgctgaccgaccaccatcagcattcctcacctcatttgcatcaggcattgcatggttattgcgtgctgtcaccggcactttaacagttgtggttgtggaaagaccactattcctaggtcgctgagcagctgcattccccatctcttctgcatcaagcatcgcatggtcactgcttggtgcattcccaatcgcttctgtagcaagcccttcaatgccgtccatggaatttatttcggtccttgagccacttgccctgctcaaaaaatcgaattaagcccgacataatcctgcaactacctactaattttactaatctaacacgtcattgtttccagctttgacaaaataccctacaattcccccagtcactatagaattcatccccatgggaaggccaaatacacctctgccgtgaaatcacaccactacagtactactgcgcagcgatttcccgacgaaagtcaagcagcggaggtcactcacctcaagccaaggagagacaaaccggccttctcctcctcggtcagcatctccatggtcgggcgcggtcggggcgtcgccgaggccg

SEQ ID NO: 51423 - DNA, 1501 bp, Oryza sativa
cttctactttattaaagtattccatttaattaacatcttaaactatttttcggtttatttttttgtcatttttagtttagttacttaaaaaggttcacttttttctataatagaatagtatttaatttggttttgtttccttgtatataagtactttttaactaagtgagaattttgatgcattgcaacttgtgcctcaacttttttttctctggatttcgtattcagtttctgcatactaaactttcatgaaagatatatcttggaactattgtatagcacaggttatattctcattaatggctctacaaaatgaccaaaaatattttagaatgctaagtgaagcaaggaatagttgaagggagtaaaaatatgtttccctattttttaatttagggtgtgtttgagaaaagagaaatgagaagattaaacaactttcttatagaaatgtaaaaaaaaaacacacatgtttagtactcggatgtttagttcgtgaagcatccgagtgaaagatggatttcttctccctttatcctcctaacgaacgcatccacactactgtataatcatctgaattagtctttttttaattttctcctttcatctgaacagcatgataacaataattaatggagataccgtagttatatatatggaaatttaggaaataatttagcagtgatcgactgcatgaataaatactctgaaacgacatacttatatctgcaagttgcggaaaataattaaattaagctagctactctggataagtcctgcacgaaattcattcagcagaacagtcaataccgtttgtttcctcaattcttatactagtgtgaaaccatgccgctgaaagaccaggatggttgcataaggaagtcctggccatattgaaagaagagcaatgcattatgcatatatgtctgaaataatgaaaaagataggttgaaaacagtaagttgattgttagtgcatatttatatatatattcaggatttttaaactaattaatgaaaaaaaaatgaggagtaccaaagaagatattctcctatgcatatccatccccttgggttcctacctagtacggccggacaggcaacattgtaacatgcatcaagtacattgcatcacacccccaataaagcatccacatcaccatccagcaacttgcatgaaacaaaaaaaattaattaataaaaaaatctactagcacctcccaaccacctgtaatatggtgctttgatagggaccaaaataacaaacaaaaaaaagaattccaaaaagacatggtcgatcacttttcataaaaaaaagcacagatatactaccattaaattattgtaattaactaggctcaagatagatagacgtcgtctctactactcctactagaaaacatatctttgtccaagcaaattaacaaaatcaaatatagcaagaacacgtttaattttgtacacatgctgcgtttgggttggtccaaataaaatacaaagaccag

SEQ ID NO: 51424 - DNA, 1501 bp, Oryza sativa
gagatgcttttggtctaattttctcctgtcaaaattcccatgtgcgcgcgcgtgtgttcaagtcaaagtcttgaacacaatatagcttagcatgagtagtagattataattatattctagaactttctaccatgcatgcatggagccaattaacggcggctacactatatatatatatcgcatcatatcgtttttggcatgcagtagatgtgtcactttccattttcgggtggattgattgggcagggtacatatgaacatatatgtgtgcatcagcaaacatcatgatacagtaacatcatatcgctctcctctctttgattgtagatgtgaggtgccgcgcaccccaccttcttcctcggctccgactcctttcctaaacagtggtggggctagaaattatgaaaggctgaggaaagaaagagctcaactaatcgagtgttggtttttttttttaaatttgcatggcgatttaacaaaaattaaacaagattttggagataagtttagggctcaagtcctaactgccctaagcctacctccgcccctgactgaagagagacccatctccacaccactccgtattacaagtcttgcctccaacactaacccatcagcatctttctctcttgtggctcgaacaataccatcaccgcctcactactctaccatggcagctggtagccttcacatagtgaaaacggtatggaaattttccgaccgtaccgataccgtttccgcaaaactaatataataataatatctttttaccgatggttaccgttttcaaaatttagttttttttaaatttctgtcagcgtggcattaaagttgacactaaatagatgaattcataaatatgaaaattttccgaccgtttccattcgttttcaaaaaaacaataaaataatgataccgttttcgaccatttccgaccgttttcatccctctttcatttcccacctaataatgataccattttccgaccgacccacacctcccatttcctcgtccttgacccccactcttctcgattgtattcttaacccaagattctaaccaataggtattctgtcaaagtttagggttcgtgaaagtttgctaaagctcgtcgaagatgaagcatgaatcttggagtaagattagacattggtgtaatttcccacctaaatgtgtcagcatttccatgtaattaagggtctttaaattttcaactttgtacatacaaagatcaatgtgtcaactgtcaaagtgcaggcttttagtttgtagggatagctagctcgtggggttagttaattacccaattggtcaagaggtactggtccattttaccaggttttcatggagaattaacattttgtgtgcctacttgtgggcatagagaaatactccagtaataacactcctacataaagcaggtgcagcatgcaggtctgaggattcagagcgtctctcatgcaaacaaaggaagaggaagaagtcggtctcctcccaaatg

SEQ ID NO: 51425 - DNA, 752 bp, Oryza sativa
ggcaaacgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacacactcggatcatgttatttggaggattcacaccgcatatgctatatattgatatcaagtcacttggttgattacgattatcaaaaccactcggttggttggattatttattccttgactatatgtttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggtatga

SEQ ID NO: 51426 - DNA, 1501 bp, Oryza sativa
acccactgacccacctagtctgcttattgcttgtccatctatgtctctgtgtttagttcacttcagactttaaaatcttccatcacattaaatatttggacatatatatggagcattaaatatggacgaaaaaaaaccaattgcacagtttgcatgcaaattgcgagacgaatcttttgagcctaattacgccatgatttgacaatgtggtgctacagtaaacatttgctaatgacagattaattaagcttaatagattcgtttcacagtttacaggtggaatctgtaatttgttttgttattagtctacgtttaatactttaaatgtttgtccgtatacgtcaattttttttccaaaccaactataaacacggcatatatcaccatgtctatcaattttgccatgcactgtactcatgtatttccttctactccctcgtccacaaatataggcacagcaaaggcctcattctttttaaattttggctacatgagtttttttaattgctaaacggtataattttgagaaaaaaatattgaagtctttcaaaatttcgaacaaatccatttcttaagtttgagtaatagtcaatatttaattattcattcgttaattacaaaccttctcccttaaaggcgtggattgatcggcccaaaccccgtcgtagaatagggactataacatttacatagactctaatatattactttaaataataatatatgtataaataaaaatagttacatactactccttccatcccaaaatatttaacgctgttgacttttttaaataatatttgaccgttcatcttatttaaaaaatttaagtaattattaattcttttcctatcatttgatttattgttaaatatacttttatgtatacatatagttttacacatttcacaaaaatttttgaataagacgaatggtcaaacatatttaaaagaatcaatggcgtcaaacatttagggaatgagggagtattatagttttatttcatgataaatctagtaactttatccttacgctgtcaatctttaggagtatttttttgctattaacattttaagttaaaaaggtttaactttgtagagatagggagtgtgttccaaagcctgcttgctggttgtccagaggtactgaagtatcagtaggagtagcacctaataggcaagcaactaccttgccatcatgtgtgcttggtctttgtggaacacagcaaatgatgcatcatgtagtggtggtatccttttcctctgcggcatctctgtttcagtgtggctagttgttgtttgctcctgtaatctccaagagctaccatgtttggtagtaaaatccagtgccatccgttccatccacagggatgggccagagatagtgggctgtccaaacaggcctaaatccactaacaactctgtaataagtgtactgataactagtactacctccgtttgagaatacatgagcttattcgattagaagtattttcaaatca

SEQ ID NO: 51427 - DNA, 1501 bp, Oryza sativa
accgacgtatcaccaactaatggcactgcaagttattgtgatcctcatcaccgatcgatcagctctattgttccggggacctacttttctcctacacataagcattttatagccccttttttaagggaagtcgagatgcatgacgacaaattaaagcacgcaagagcatctgctgctgtctaaatttagcccgtgtgaggtggcgccgtcctatcatatcggatgaatttagagaattaaatatatactactaattacataaataaaactaattcgcgtgataaattttttaagcctaattaatctataattaacacatgtttactgtaacatcacataggctaatcatggattaattagactcaataaattcgtctcgcgaattagtctagggttataaggtgggttttattaataatatacatttaatatttataattagtgtccaaacatccgatgtgataggactaaaattagtcccatctgaaccgggtcgcttgtctagctgcatgcagttgtagcagcagacaacactgcctcgtactgtacggtactgctacttctactccactccttcattcatcttaaaataaatcaatctcgtaccggatatgacacatcctagtattatgaatcttgactaggaatgtgtcatatcccgcacgatgttggtttattttatgatggagggaatatggaatagagtttagaattctaagaaacagttgataggaattaactagtgaaaatctaaaatagctgtgtttttagctttcgagttctaaattatgttctgaattctatattttcatactcttaccgttctcaaatctgaaagaaaatctaaatgagttaagagattttgaaagatgctccatctaccaaaagatcttgaacagaactggagctgggaggtaatcaagccggtgatggctcaaggcagtagcaaaatttggcaatggatatgaggaagctttgggtcaggctggggaagcatctgggtcacatgctgcaggtgcattgaagaatgctacagtaacggtcaccaaccctccataaatataaaaccaagcactgcactgcagtaatccctcacccaccccatccaccgccatcatcacctccagtccccacacaaaatggtggtgttttccggacaaaagcaacaaaaaacggatggatcccatcacaaattcgccgtataaaagcattgcatcgcaaggttaaaaaccattctgctgcagccatccatccatcgtccatactctctcatcaacaatgatgcaatgccgtgcatgacaaaatttggaagctacgtcacgcatgtgatcggttatcgccacctacctaccaaatgctcgagaacaaaaaaaaatgcaaatgtattacgctaccggtccaaatttggtccgaacacctacgaaatcattcatccccaggagcaatggagatatggaaattttggaagcttacgttttcatcaaacaaaagcggccataga

SEQ ID NO: 51428 - DNA, 1501 bp, Oryza sativa
gttagaggatgcatttggtggtgtgtgagtgtgtggttcttttgagataatggactatactttgcttcaaagaagttacatccacttattacaaatacccgttcaataattaaagagcaaaaaaaaattactcacaaagagcactaaaaattctagaggtgaaacatcaatcttaatattttaatattgtaagattggatgtatgaaaatagtatctgtgttcgccccaaaaatagtgtacattatagtatgttttgtcgagttttataagtatgttatgacaaaatttagttgtcaaagctgcattaatatttgaaaaccttatcgcctccgataccatgtgttttgtgacagtagatagcagttgtgtattgccattaaaatcaagggggtacggcctgcaataaccaataacgattcagcatcgggtgcacttgaaatcttgctgaaacaattggccaagtggaagcagaggacggagagtgacctggacgaatggacatgagccttactaattaggttcatccccctacgtacaagagcctttaattgggcccatttctgatgtattaagtggtcacattgcaggcacaatttatacacatatatgttgtttttccaaaaaaaaaagttaattaggtagcacatctcatctggtatctacatggtacacgtgcaactgagataatactaaattgcataaagataaaaaatatatagtgagtccccttcagctgaggttcttatatggtactagtaattgattgatatgatgcttttgaagtaataatttggcatctgtcggtgatcgaaatttccatttgatttctgaaactagcatgttttccgcatgaaaaaatatgcagtggaaactatgacaaaaagttttaggaacttttgcatagaagtcctgaaaaaaatcaaaaaaacattctcgtatggagaacttccatcatgtagcttgcatggtttccacgtatatattggtttacaccatatatttaccctttcatcctaacatgcatactactattttaatatatattcaataacaatcttatttaaacaaccaatatattctcatcagtttcgcatctcttcattaatcaaaatattctttttatgtgcgcatatatataaatttgttattttggaagtttccaagtttttcagccagatttcctatgtgtggaaaatgggatatggaccatttgtggggtgcagtgatgacataggatgaaaaggacgttggatcgtatatgggacagttgatatggcaagatccaattatagagcataactgtttgcatttgttgatatatagtggcagccttgggaggctggggcaactactacaagttggtacgtactccagcccgcttgcaactcggtatcagcagtggaggaggcacaaccgtaggggacctggatatatttgcagagcatatatagtttgcagtgtggaaacaaatgtgtaagggcatcttcaaacatgccatgt

SEQ ID NO: 51429 - DNA, 1501 bp, Oryza sativa
gattattttggcaaaaaattttagtttttttttcaattttttgtgaatttggcgaaattttgttcaaatttgactaaaatttattcaaatttttggaaatttcagtatatcggtaccctccgatagaaacatccaaacggaaagattaaacccgggatactagtagtatatatctcagaccgatagtgtgccaaccagagccaatctccccacgtttctacatgtgtggatatatatgagataaacatattggcaaccaagctagaacagatcatagcgatggataggaaatttatgcatgcattgtggtgtccattgcatatatattcgcccatatactacaacatgggacttggagacatcatgaatttagagatcacagatattgctactgttacgatacaatcacataactcctcataccctctgtttgttcattgtgtttctcggttaattggctagctaggagctccatttctgtaatagtagcctgatctctttgatgcacgcatctaaaaattgtcctggctgctggacagatgcggcaccgtgtctattcgatctcctctaataaatgattaaatgtactgtatgctttaaatttattagtgcaatccctacatggccggactgcattgtatacccttgtatatatcattgtatgcttatatatacagcttcactagtttggtcgacctctatttctcagctcaagatacatcacaactcaagtttagagcatggggagtttctccaaatcctttctgggttttagcaatttttcagaagcgagcaagacagttacagtacgagagagtctattggccaactgaaccaaaaaaaacggtgtgtgctttctctgcaaatagctaagctagccaagaagaagaagctagaacgtttaaatatgttctactattttggtgattaataaggccccaatatataactaagctaaagcttgtgtgcatgcatgaatacaataagcatgagaggcttagggaaatttcagcttcgtcagatcgatccaagccgtacagcatctcagatcatgcgtgttgaagatcaattcatttaccgtgcgatgtggtgactccgtacccagcaaggggcaagaatctatggattcaactcctcttttgcgagattttagctgctgacaaccttcagaaaagagggtgggcgccgcacagtgacacttgcgctttgtgcaacaatgtggaggggagctgtcaacactttttttttttaagagaatggtattttttacccggtctctacatccaaccggatatatacggccattgaaatagagaacttagccccgcaaacaacccaatctaaaattcactccatctgaaacaacccaagctgtcaacacttgttagtggctgtcaattcacaaacagtgtgtagagaatgttaaggagttggctcggggtctccttttcctttccggaggatggaggggaacacttcacggaatggtggcgacaggtgc

SEQ ID NO: 51430 - DNA, 239 bp, Oryza sativa
attttgaagcagtgccgcactgtcttgcaggacaaaatttgaggcgtgcataaaagagaccgggctaccgttacagaaatggaactcctagctagccaaccgagaaacacaaagaatctaaacaaagcggaattgttgggggatcggctttgccctcctccgctctagaaaacgggcctccctttctctgaagaaggctctaaattcgaaggaagcttagaaggggcctccagaaacga

SEQ ID NO: 51431 - DNA, 1501 bp, Oryza sativa
atttgataattgaagttaaactaaatgtgctatactaattgttcgttcgtgtaaatactcctaaatgacaccagtactatagccaattaagaaaaccgcgtatgctgatgggatcggacaatttaatcacataaaccctgtatatgctggaacagatggagtacaccaatgagatttgataatgacaatgtctgatctcatctgaaggttaaataacaataagcgatctcatctaaaggagtagtaaccagattggcagcactctgaaaaaccatgcatgtctcaaaagaacaaatatatcctccatcatcaattctcatgattgtctttgtgatcagtctattgtaattattgattcaatacctaagcctttacatgttttggtacaataaactgaaactagttcaaatcacacatttgttttttgggttcatcacaaaaataatcttccatctacttgatgcttgagtgagtttggtgtcactttgtggtggctggaacatgattgagttgcctgagccagggagaaatttagggtggcaatcaaacaacccacacgcatacctctccggctttgctccaggcagaatgatcccagcaagagcagcaaccagaagagctctaaatcattcagtaacttgctcttcctcaagtagtactattaacttcaaattcgcgatgcctcccaagcctattgtattctttttcatccaagaggaaaatccggaagactgatatgggatccatatcaattcatagtcataggcttatggatccatatcaattcatatactggtgtacatctcttcatgagaatgtaatggatcaggaaattaactgatcttagggcagggcagacttgagtataatcacttgaggcaggctacatagagttttcatgcacatgcagacatatgctttatataggcttggcaggttatattctgatttcgtctaatatattgatgtgtaatccttttgcgcgttcgcgaaaaaacaagtagtgccaaattttactattgctgatatttggtaaggcagacataggtaaagtatgtttggtttgttaccaataccaaatacggagtatttgtaagagaaaattatataatgacactggaggctatttagggtagcatgaggtacccacacgggttgacaaatactccctcattccctaaatgtttgacgccgttgatttttttaaacatgtttgaccgttcgtcttattcaaaaacttttatgaaatgtgtaaaactatatgtatataaactatatgtatacataaaagtatatttaacaataaatcaaatgatagaaaaagaattaataattgcttaaatttttttaataagacgaatggttaaacattttttaaaaaatcaacggcgtcaaacattttggaatgaagggagtagctgcatgcattgactgcaattgaagggctcttatgtaaaatgatttaacatcctaaccgtttatgtcccatctaacggtaaga

SEQ ID NO: 51432 - DNA, 317 bp, Oryza sativa
acgacgaccagaaaaacaagtcatcctatagagccgtcatcctatagagccgagggtggtcgaccgacctagaacaagggccagcaatcaggctggtcaccaccttagccggagggcctttggaccccttggaagggtcagccaccaagttaaactaggccagccgaccacgtccaatgccttggccattaacctaatttcaccaagacaagcctagccggagggcctttggaccccttggaagggtcagccaccaagttaaactaggccggccgaccacgtccaatgccttggccattaacccaatttcaccaaga

SEQ ID NO: 51433 - DNA, 320 bp, Oryza sativa
ttaaacaagaagaaactaaaggtcggcaggagtacattctttaggcagaaagggatgaacaacatatggattagtagcaaattgtaggatgccaacaaggattggatatgcactggaaatagatctaaatctatggagaaggtgattgtccaccgaaagttttgtaattattgtagatgctcttatagtttaattattagggcttatacgagagccttgcgcgtagatcttccaagaataacgagagatctctcgttgagagatgaatattattcgtgccactgaaattcagtcatgatgatagagaattactctccccc

SEQ ID NO: 51434 - DNA, 1501 bp, Oryza sativa
tttactggaggaattcctggcaccataggttcatcaaaattacaaacagcgtaagtacactgtttgacattagcaattgttgtatattctcaaagcaacacaaacatactgattaccatctcttgtacagtttactgaacaacaatcaactcgatgggcaagttccagaaagactttactcgattggcgtacatggtggtgtgatagagtaagatacctttagtattttcacataaacaagatcttcactttctcctgtaaagtttactagtagttagtagtatatccagttgtcagatatctcatacaaagagctattgttctcaggcttagaattgatcggcaggctcctctatttcatcccatgctccctgctgaagtccaccgcttaagattttaggttccactatgtgacttatgttatgttgagtattgtttagatcagtggtagagcctgctactgggctggtcaggcagccgccctggctcttttttttgtgttcttcactgtagatcactgataagcatggaaaaaagttgtcagagcaagaagcagctcttcgctggctgggttcattgttgctggctccgccactggtttaaatttaacaatgccatgtttacaatatgatacactgatgctgagcgatatatctctgaggttaaactgagtaaaagcagggtgttgttagaaacgtgagaagtatgtactaggccttgactaactaaattggagattttgcatctaatggtgcttaatttagcaaattttactttcttattccttgcaagcaaatgactggagttcaaacatgcacactgtgatcagataatagatcaatggtagatatattgtgaaccatgatacttgcattcattttatctctctatttacaaacacccactgttttaacagtttgtcaggtaataaaggcctttgcggggtgcctactttacctgcttgtgcattattttgggagaaaggagggctgaacagaactggtaaaattgcactaggggcctcgcttgggtttgttctacttgtcacactcatagtggtctacatattgtgcatcagaagaggaccgtacgattatgattttgagttcccccaagatttgacttgtgagtataccacatctcaccttcatactgtgggtcaacctcatatatgactttaagattctttagttttgagtgattattgttttccattgtaagttagtggtagccgttcttttcttaaactatacctaaggccattcatatcagttgtcatgtcatttgaaaaaattatcagtgttcctatgttcctattaacgcaagtaacaatgtttcagatatatcaacctagagtttagtatcccttttatgaacaagtaatcactgtttacaaaccaatttcctgtcttcacaaatgtctaccatgtttaaatttgctactttctcatcctacacagcgatatcagcaatctctgcaaaaaggaataggtatcagagg

SEQ ID NO: 51435 - DNA, 1501 bp, Oryza sativa
catatatgactttaagattctttagttttgagtgattattgttttccattgtaagttagtggtagccgttcttttcttaaactatacctaaggccattcatatcagttgtcatgtcatttgaaaaaattatcagtgttcctatgttcctattaacgcaagtaacaatgtttcagatatatcaacctagagtttagtatcccttttatgaacaagtaatcactgtttacaaaccaatttcctgtcttcacaaatgtctaccatgtttaaatttgctactttctcatcctacacagcgatatcagcaatctctgcaaaaaggaataggtatcagagggcgaagtctgtaatgcttgccgagatggaggcgcacggcccggacggttattataccaacgggggcgctcactgaattgatgggcaccggaaatggatatcttcacaggttgttgtatttctacttacagagcaaacactcattgacaattgctggcctgaagcaaggacagttgtgacttgtgactcgtgaacacaattcaccagcatcatcaacatgacgtccctgtaacttcagtcaagcatccatggcattattttgcagttacactcacagcttaattacaaatgtaaaatatgtgcatgttttatgtgtactataatacgatgaagtggtggtggggtggtagtagtagtttggtaatagtagtaggggtgccttattttttgcagaggctttgctgtctcgtattagctttagctttaggcgtgtgcactccatcagcaatgtaaatggaaccaggttgggtcaggacagattcaggcgttgaaatgcttggggggtaaaagctggtgtactcataggtgtattctttctgtataaaacctgacttcgttggcactgtctgacttcaggagattgaaaacattagctttggatcagagtgttgttagccacttttgattatctgttgcttacttgcgtgtcatccagagtcatagacgactcaaattctcacctgctagtatttcaattgtcttcagaatgtgctctttaaacttaatttttccttctaatcgaaccatttggtctggatttagatacttgcattatatcgaagttgtactgcatgaaaccttaagcaatgatgtaataatatcgagtcatctgtaatgtctgaaaccttatttagactatgcagtttgcagttcatattaaagcccacgtaaaataattctcagcccaacaaaatacaaagaataattctaagcccaacgagcccaactgcgcttcccaactatcaaatctgcaccatccattcctcatcggatgccttcacgccgccacgtagcggagagcaaagcaaaaccctagctagagccacacccagaggtatagattccccaccccgccgcctccacgcattccttcgcccaccaaaaccctagccgcgccgccgccgccgacgaccaggtaaggaaggagatccgccgccggcgccgcca

SEQ ID NO: 51436 - DNA, 1501 bp, Oryza sativa
ccaaaaggtgggcttcccacttgtcatgccccccccggtccatccaaaactgtgaaggttaattgcagatttttgcaaaaaaaaggaaaacattaattctaattctatgatgcatgtaaaattgcataagcaggagaaatttaagaaaaacatacgagttacttcgttagtacccaggggcggatccaggataagaaacgagctagcgtcaccacgcactactactttatggatcatatatagtatttacatatggatagtaaaaactgtaatttacatggcatgtttgaagatgcccttacacatttgtttccacactgcaaactatatatgctctgcaaatatatccaggtcccctacggttgtgcctcctccactgctgataccgagttgcaagcgggctggagtacgtaccaacttgtagtagttgccccagcctcccaaggctgccactatatatcaacaaatgcaaacagttatgctctataattggatcttgccatatcaactgtcccatatacgatccaacgtccttttcatcctatgtcatcactgcaccccacaaatggtccatatcccattttccacacataggaaatctggctgaaaaacttggaaacttccaaaataacaaatttatatatatgcgcacataaaaagaatattttgattaatgaagagatgcgaaactgatgagaatatattggttgtttaaataagattgttattgaatatatattaaaatagtagtatgcatgttaggatgaaagggtaaatatatggtgtaaaccaatatatacgtggaaaccatgcaagctacatgatggaagttctccatacgagaatgtttttttgatttttttcaggacttctatgcaaaagttcctaaaactttttgtcatagtttccactgcatattttttcatgcggaaaacatgctagtttcagaaatcaaatggaaatttcgatcaccgacagatgccaaattattacttcaaaagcatcatatcaatcaattactagtaccatataagaacctcagctgaaggggactcactatatattttttatctttatgcaatttagtattatctcagttgcacgtgtaccatgtagataccagatgagatgtgctacctaattaacttttttttttggaaaaacaacatatatgtgtataaattgtgcctgcaatgtgaccacttaatacatcagaaatgggcccaattaaaggctcttgtacgtagggggatgaacctaattagtaaggctcatgtccattcgtccaggtcactctccgtcctctgcttccacttggccaattgtttcagcaagatttcaagtgcacccgatgctgaatcgttattggttattgcaggccgtacccccttgattttaatggcaatacacaactgctatctactgtcacaaaacacatggtatcggaggcgataaggttttcaaatattaatgcagctttgacaactaaattttgtcataa

SEQ ID NO: 51437 - DNA, 1501 bp, Oryza sativa
gactacaacaaaaggacacgctatatgctcaggggcttactacctcaaacacaagtgtcataccttcaatttggacttgttccggatacatgcaacatgaatttgatgatcatgggtctattttttatgcttaaagactggactatttattattccccgtaagggttatcaaccgaatacttgcgccagtcggaattcaattgttatatctattttggagtatcccataaaggataatcactgagatcagaagttattcatatgagctacacttggtctatatcacccgaaaagatttattactcgggagcatgttacatgcgtcatcctttaaagggtgtcgaaggcatattttttggcctaggcctaatatgtctgcagcccatattttcaggtgtggcatgtcacgttcttttagggacttaggcatctttttgcttaggcaaaagtgcgcgtgatctagtgtccaataccttaaaatccttttataccgcagttactcaactttttaggagttggtacaatgcatcttaaaaggtgtcaaacagtaaagctttatatagctgccccgctgacttttttatatagtcatggcgctgtttgggtttatcaagcaattgattggatacaacatcattgctttttgccacgtaagtgtgtatttttattgaccaatattatggcttaggctgattatatattttggtcatttttcagacgattgataaatccttatgagtttatttactcggattttataccacatatgccatatattttcaggtgtagtgaaaccatgtgtcttttagggactcaagcacatctgttaaagcagtgtgcgcatggtgtatgcccaatactttggaaagttatttattcacaacatacaagcttctttatagctgttttgctatgtgtattcaataatgtagtcagctttaggttgcacgcatcataagtcggtatatcactcggatcatgttattcagggattcataccgcatatgctatatattaatattaagttacttgtttgactacgattatcaaaaccactcagttggtgcatctattaggtacatctactcgatgcacctgactttatttttcagccctccacagtcttcatatttggtaaaagtactcgggagatcatggcgaggatgattgaagcacacggctttggagtaatctagttcgagagaagattatctttccgactgtgaaggtctcaggggctactgtggagattatgggtaccccatacccacacggcatggttatccgactagtcataggggatagcttatatctatggaatatttaaccgatcatgacttgggtattacgtttccttttatattatgaagcggcctaaagtcctgatttgataatattgtaaaatagatttaggaaaccgataccgtattggttaaggtttctatcttgtaatcctgccccccatcctatataaggtggacaggaggccctctagggggca

SEQ ID NO: 51438 - DNA, 1501 bp, Oryza sativa
ggcataaagcccagccgtgcaggtagaaacaccagtcagcggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgatttcccctagcagatgactcattatgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttacgttattcggtccatccaacaagcccccaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctatagccccccgactcactagtcaacggcgaaccagttgatgtagtgaggcaaaggaaaaggcaaaatatcatataaagaataaaataaatgatgacttagctttgtcatattccccttgattatggcagaggtggccaatgtgggaacaaagtcgtccatcaataataatgaagacacccgtcggcggcgacgaaggcgatcgacggtgaaagtgtggacgcccatgaacggtggtgtggccgaccagccgtataggcgaggacaccagtcggcagcgacggaggcaggccggcggtgaagtcgtagaagcccaacaacagcggcataataggccagccgtgcaggcagaaacgctagtcggcggcggcgaaggccagccggtcggtgaagatgtggacgcccatgaacggtggtgtgaccaaccaaccgtataggcgaggacaccagtcggcggcgacggaggcaagccgccggtgaagtcgtagacgcccaacaacggcggcataataggccaaccgtgcaggcggaaacaccagtcggcggtggcaaaggccagccagtcagtgatgaagtacaagcgatgatacatgcaaagacaagaaattgcacatcaacctgtggttagatatttgtaaaaaaaaaataactgatataataatcaatagatccaaacacatggcttgattggcacttgatagagaggcctgcataac

SEQ ID NO: 51439 - DNA, 1184 bp, Oryza sativa
gtgaaggttaccacataatgaatcttccatttgttatgaaggttacaacaaataaatctctcatttgttgtggatgttacaacacaatgaatctctcatttgttgtggaggttacaacacaatgaatctctcatttgttgtggaggttacaacacaatgaatttcatttgttaatggtgactttattctcatctgttacaaaacgaaagagcagcaggcaggctcggctcggtcggccgcctcgcctcgctacgcccacggccgaggccgactcggcatgcgcgcatgcgtgtggcagtccaaccatcacctcaaccggtcaacagggaatctctaatatcaccctatttaagttgaggttcttccacctaaattttcaaggcagtattattctctctaacattacttgtgggctcttgagattttagttgaattaaattgggacatatgagacaagaaagttcgcttcatttgatggcttttaacatgatttcacactttttcctatggttcgtccagatgagtacaggcctagcagtgacttccatgcatactcttttcatgtcatcctaccataccctctgatttggtcccgttagtggatacaagcctaggcgagattctcgctctcaggttcggtcctctacgagcggatacaaatcacggatacaaacataaattttgcataattcaccataaattaaacaagcacttgcttcggtcatgcttcatggcttcgagccatgctagtagtgatacaggcatagtgataaacaaaattaattgagcatactaattaattagcacgcacatttgctagttttgacatatgttcagccatatttctctaacaagaattaaaataaaatggcgtttattttctttccgtggtcagagataggaaatagatgtgcgcatgcatatattttctccttccatctattcatctacaaaatgttggataaatcacgaactacgccgagtcatgacggccggccataaaattaaccaacactcgcttcggttacacttcacggcttcgagccatgctagtagtaatacaagtggagtgaaaattataatctcaaaatcatctgcatacatatatttgcttaaaatagtgtatatatacttgttgcaccatatataaagtgcagtataaaaaataatctgatatacgcaca

SEQ ID NO: 51440 - DNA, 1501 bp, Oryza sativa
caaccattatctgtaaaaatctagagaaagtgtagactctccctacatgtatgcagtgtagtagtactaggagagtactagctaggatgggtagatttcttcggcttctaccatagggtgtgttcgctattcatggatcccaatcggatccttccacacggaaaacggagtagttcattagcgcgtgattaattttgtattagctttttttaaaaatagattaatttgattttttaagcaacttttgtatcgaaactttttgaaaaaaaacacgccgtttagcagtttaaaaagtatgcacgcgaaaaacgagagagaggttaggaaaaggggcatccgaacactccaatagagtgtcttcgatactcacgtttgggaacggtactctctaccacggaaaacggattagtttattagcacgggattaattaagtattagctattttattaaaaaaggaacaatatgatttttaaacaacttttatatagaaatatttttaaaaaagcaccgtttagcagtttgaaaaacgtgcgtgcgaaaaacgagaaggaggggttgggaacccggaaaaaccaatgcatgtgtaagtgcctgatgatgtatccattcatcaaacaagcaagctactagtagggcctctcacagtgcaagctatgtcgcccgtacccctagcccaaaaggttggtccaaaaacacccacctcatagtgcaagcacccatatatgtatggtttaattggatgaaggcactagtaaaggtaccaagcccacagtgggtgtgaccctagacgtgttaccacacatttatttctctcaattaccctcgcctgctactcacgcgagtattcttctcctctcctcggcgcgaccgcctcctcctctctcccgcatcgccgcgcctcctcctctcctgccacgccaccgtgcctcctcgcctcccacgccacggcgcggtccacggcgccgcctcgtcgcaagaaaccacgcgcgcaccggcgagtctttcccctccctctctgtcccacgctctgcttctcctccctcacacgcgccgaggaggaagcgggcacgggagaagggcggaagcaggcggcgtccccggtgacggcggtccggagtagggcggacttcgccggcggtggtgttaacgaccaaatttgataagatatgaaccaggttcgacattggaatcgaagcagattcggcaaagagatggattcgaagaacagagtgtgcatcggttgtgaagacatcggttggggtatgcatcggctgagatggatcggttagaggatggctgatgcaaccaatagagctgatatagctgatttcgatggagatagcttcgaggctgtttctggaatcaatcgatgtgcttaacaaggattgccacaatggagataaagctctcagataggcaattgtatctattaattaggatatcttatgtaatttctttagagatatgtttgggcaaaagtctgccgcaaagacttatagt

SEQ ID NO: 51441 - DNA, 1501 bp, Oryza sativa; identical to SEQ ID NO: 51440

SEQ ID NO: 51442 - DNA, 468 bp, Oryza sativa
ttgcttcggtcatgcttcatggcttcgagccgtgctagtagtgatacaggcatagtgataaacaaaattaattgagcatactaattagcatgcacatatgctagttttgacatatgttcagccatatttctctaacaagaattaaaataaaatggtgtttattttctttccatggttagagataggaaatagatgtacgcatgcatatattttctcattccatctgtttatctacaaaatgttggataaatcacgaactacgccgagtcatgacggccggccataaaattaaccaacactcgcttcggttacgcttcacggcttcgagccatgctagtagtaatacaagtggagtgaaaattataatctcaaaatcatctgcatacatatatttgcttaaaatagtgtatatatacttgttgcaccatatataaagtgcagtataaaaaataatctgatatacgcaca

SEQ ID NO: 51443 - DNA, 407 bp, Oryza sativa
atttattggatccaggaaaataaaaaaaatcccacgctagccttacctagaaaagattttttattttttaaccattttaattttttatttaaaaataaaccctttcaaaacttattttcaaaatctgagcctttacacaccatactacatcagcgagaatggtgtgccaaataacgttgtcacactagcgagatcaacatggccaagtaatgctgtcacatcaataagacctatatgacaatattgttttgctatgacagttcagctggcgtgaccaaaagatttagattttgaaaataagttttggaaatgtttatttttaaaatttaaaaggtttaaagaataaaaataattccctagaaaataggttaccgaagagaaaaaaaaaaacctgtaccaagggcgga

SEQ ID NO: 51444 - DNA, 788 bp, Oryza sativa
cggtagggtgtttaagagagttttcactaaaatctactcagctcttatcactttcttaatctaatttgtgttttcttgactgtcacgtgcttgaagaaaaatatcatataatccatccgtttcataatgtaagactttctagcattgtccacattcatatagattttaatgaatctagacatatatgtctagattcattaaaatctatatgaatgtgggcaatattagaaagtgttacattctaaaacggaggaagtagtaatttcttatatcccactctaagtttacaagtttacaacgatacttttaatttgcaagtcattgttatcttcatcttccacctccaaaacaccactattgattgaattagtgttcattggtgaagttgttgtcatttggtgattgggttgcagaaggagtcgtataagaaatcttttaaaaaatactagaatgctaacttgaggtgatcataatcctgattgcatctcatgattttttagaaaaatatatatctaggcgaattcttacaagcgaattcttacaataaatttcactttaaaccgtataaccgttgttgcaacgggcatattttccagtaaaattaaaaaaaattcgccctactaatatcgttgttattgttatgggccgaaatccatgggctggcaaatatactcgtggagaagatcgcccaaaaataacctaaaccgagcacttgaagcgcaaaacggcaaaacccaaaactcccctgccccatcaccgccgtctgcccgtcttcatccacccaacca

SEQ ID NO: 51445 - DNA, 1501 bp, Oryza sativa
ttcgtcctggatgctctggagtctgcagggcgagtgacagctcgtccttctctctgtcgggtcggaacatgccctgagaagaggcttccactgcgtccgttagtcgatgcgcagcctcgcgtatctgatcgctgaagaccaaggagccatcaactgggttgagtgttccaccgtgagcatagtaccaaaacttcgatcgatctggccaattagcggtagccggttcgatacccctctcaagcaagcttgccttcatctcctcccacttcggcatcgcgacgctatagccgcctgaccccaagtggtgatggtacttcttcttggtggtattttctttgtttctttccatgatcgcctgcccttgttgacctatcttatatgcaacgaactcgtcccagtgatcccttagctttgggaatgtgtcgaagttcggtgtctgccccttcaggatgtatttctggtatagatctcccttgaagctctgaaactgttctgtcattttctttagagtccaccttttcactttgtcctctgtacccatgggaagggtgaatgtctcgagcattgtggtccatagcatctctttctccgaatctgggacaaagctctcatgatctctgcgtgtccttgttctgcgccagtacaccgtactgacaggcatgttatcccgcataacccaactgctgtgacgtacgtagttcttggctgcttccgccgggacactaggtcggtcgtcttcgtccacttccgttatgatgtgccaaccctcaagcttcttcacggcacctcgttgcccacgtgtcctcttctatccagcggagggttgacttccactagcctcctcctcctggttcccctccacatccctctccatgtgcccctcctggttcccctccgcatccctctccatgttcccttcctcgttcaagtactggtttggatcctcgttcccctcttcttcgttccagtactagctgcttccctccgcgattgtatcgtacaatatctattcctcatcgtggtcagccatctgttcatacaagaaatagttgctaagtcatgagacatttttgctttaacaatcttatatgctaacaatcatatatgctaagtcatatatgctaagtctaactgtcgtatatgctaagtctaattacaaatctaataatcttatattaaaactataataatcttatacgaaaactcaaatattgtattaaaactgtaatagtcaactatgccaagcctaagtgacgtatattaggaccctaactagtcaataattatatactaagtctaattacaaatataataatcttatattaaaactcaaataatcttatactaaaactcaaatagtcatatattagaaccctacataatcttatatgctaagtctaattacaaatctaataatcttatattaaaactcaaataatattgtattaaaactctaattataatgctaagtctaagtgtcgtatattaaatctaatagtct

SEQ ID NO: 51446 - DNA, 1501 bp, Oryza sativa
tttgatcgtccgtcttatttgaaaaatatatgaaaaaaaattagtcagacataaagtaatattcatgttttatcatctaataacaataaaaatactaatcataaaaaaacttcaaataaaacgaacgatcaaatattggacatgaacataaacagtataaaactatattttaagatagaggaaataatattttgactgttaatagtaacttttagaacatttagtttaaagacaccataccacgatgtacagattagtcttataaaaagtacttttaaaagataaatatttacttactttttatagatgtgttacaatagaaaatcaaagatatgttttcggagacaatgccaaaacgttaaattatggaagcagagagagagtagtcatgcagtaaagtttttttttctactgtcgtctaagaggttgtgataccataacttctataacttctaatattattttgttgtcagttaacacatcacagtacttaaaaacctgaaaagaaagctaagcgagcgaaatggacgcaacgatcaatgcgagaatgcaagaggaactcaccataatcgggctggtcatgttgagctgaaagtatctgagagagttacatcgtgcaaggagacatgttacgccagtcataagagcacgttcgtttagggtagaatcccttattgtcaaagatgtgactccgggcaaatgtggtacatctttcatcatgtcatcaacctcttctttctcttcctcttcatctatcaattcctctgcctctgcatcccagataactacgtattcctgcacagaggataatcaatgtcattcgaaaaagatatatatggccttgtttagattccaaaaaattttggccaaaaacatcacatcatgtttggacagatgcatggggcattaaatgggaaaaagagaaaaaccaattgcacagtttgcatgtaaattgcgagacgaatcttttgagcctaattatgccatgatttgataatgtgatgttatagtaagcatttgctaatgatgaattaattaggcttaataaattcgtctcgcagtttacagacggaatctgtaatttgttttgttattagtctacgtttaatacatcaaatgtgtgtccgtgtactttaaaaaaattttggtacacgaactaaacacggcctatatagaaaaatatgcatgtacagtttatagcttggatatatattataatatataagtacccctttttacaatggtcattataatataagtacccctttataccattcacagtcttttctaatccaattgatcattcctatttatactaccacaacaagttaactattcatagtaaaaaatattttttttctatagatatatagttgtactactcataaatcaacccttaagattacgactactactagtgacaatattgttagttaaaatactcccccgtaaaggtactcataatatacatataggagggatataactcgcatctatgttt

SEQ ID NO: 51447 - DNA, 1501 bp, Oryza sativa
ttctattatgatgtttgctgatgattagctgtgttgggttacccaggaaactgaagcaaagaagaagagattacagatggagaagctcaagaaacagaggcttttggctgaagtcaagtaagggcctgaactcatcatcttctccagtgtgatttacatgcctggatgattatgctctacgacaatgcaaacatgttgatattgtctcattatcctgcgcataattgtgccgcgctgtaggtttttgcggaaaaggtacaaatccatgtccgaaaatccatcccagacgtttgtctatagagtaaagaatccggcattgccgcccacattgcggcaacctggttggtctcatggtgaagagtaccacacggttcgggctatcggaagctctagcaaaggcccatcggcgcaccggaggctgaatgctgctccaagagcatctccggtgattgacctcaacgaggcctgcgagccggtaatatttggggcgaactcggttaagttccgttatctgaagaaattatcatctgaatgtggttgaatttgctctttccagagttcagaagagatggaggagcttcatggttaccaggaacctgttagggttggcagggtcatgaggtacccaatggagggtgattttgccgccggtcctagtgatgcgaaaatggcggcattctgggatgtccggaacgccgcctcctcccgagctgggaagaggaagatatcatggcaggatcagttagctctcagagtataggttaataataacagtgttgagatagttgggaagaggaactgaatttcgttcatccctgttcctcgagttgtaaaagaatccttaagaggaatcggtggatgggtgtaatgctcctggcacttgttgagatcgtagtcgtgtataatcaatcacttgtctgttttgttagcgtgaatgccatctcaacaactactctagggctaatagtatttgagcaaatgaataattaatacaaatgctgtctgatgccttgtagtaggtgctgcagctgcatatgtttatattcttgtagagctgtaattcattcttgagctcaatcttgttttatgtagacactagggaatagaatggaagtcatggaacccatcaccattgtagattatatccatgtgtgaatattactatagtaatgtcagcatatatgttcactccatagtgatgttttatatttctggtagtggctaattggctactgtgatgcaatgccatgctagttctggcagccatatgtgttctttttcctggtctttcattaagaattagtattacagtaagatgcagcagtacaactgtggtgctggttaaaactgatgtttaggtagtgtagttcagcaggattctaaccccaggaatactggttctctgctgatgggttcgcatgtggtggcattatgatttatggctgcttctacaagtttgtctcatcttgtcgccatgatttcgggcaagagattattgcaa

SEQ ID NO: 51448 - DNA, 1501 bp, Oryza sativa
gaaatgatgcaccctccccttttcctttcctaccactactattttctcgtgatatttccagggtctatttggtaggggaattttaaagaaaaacaaaaggaatttaaaattatagtctttttagctatatagctgtttggaatgcaggaatggatcaagaatcccttgaaaaaactttcctaacattatctattctattgttattctagtgcaaatcaagggaaaaaatgtcctcaaatctagggaaaaaattccttgaaagaatctattacaccttttttattttaagcaagtctaaaattcatgttccaaaaccacgtccatattaatttttcagtgttgtttttttaattattcatatatttctatatatttctttttcctacaatattattattcatgtgtttttgtccatcaatccaaacattcctcatcactcgtgcaagcaacaaagctagctgtattaagtgcctaatttgctttgatggtttttataattgctcaggcatcaggaaaacgagtcgagcttgctgtgaggtgtcgaggggaggcgtgctgtgtcagaaggggggggccatctgcagtgacaggaccaagtacgccttcttcgatgggctccacccgacagacgtggtgaatgccaggctggcacgcaaggcgtacggctccaactcgccggacaaagtctaccctatcaatgttaagaagttggcaatgctgtagcagtagtaataattaatcatctctaattgtaattaagtcatacttaattagtattactagctagtagttgtgaaatggataattagctctagtgacatctagtagtaacttggtagcgtggcctctggtggcatatattgaactaggtgaaatcctgcgtgttactacgggagtttactaagtaaaaataatgtgtaagatatatagctagaatactagataatataatcttaagaaagttaatgtggtttataataatttaaatttaaatagtatgtataatgatgattcaaatgtaaaagtaagctgatatgactttacgagagaaagaaaagaaagaagatagtttggaccgtagattaaatatcgaagggctaaaacaattgatcagtaatatgacttaataagagaataaaagagggagataatttaaaccatagataatcatctaagaacaaaacaattgaagtgatgtaacttaataagaggagagagagagaggagcatattttaactaaggatcagtgatatgacttaataagagaataaaagagggagataatttaaaccatagataatcatctaagaacaaaacaattgaagtgatgtaacttaataagaggagagagagagaggggagcatattttaactaaggatcaatgatatgacttaataagagaattaagaacaaaacaattgaagtgatgtaacttaataagaggagagagagagaggggagcatattttaactaaggatcaatgatatgacttaataag

SEQ ID NO: 51449 - DNA, 1501 bp, Oryza sativa
ggatacaacaaggaatttatttttgaaacccagtatacaagatgcaaagtggattttcgaggttttgaaatttaatgtacaagatgtaatgacttaataagactcggcccatgccggtccagcccgaagcccaccgtgctcctccttacaaaagtctattttgcctccctcatctcttttgggccatctcttatatggctatagtaagtctattttgcatcccttatgtccccttgtatggctagaataaaactattttggcgctctcataaaataaaaagtaaaccgaaggtccctcaacttgtcatcgagttacaaaattgtccttgaaccataaaaccggatatgacgcatccctcaacttataaaaccagtgcatactagatccctcgggggttttgactccgattttatcctatgtggcagctgacttagcgtgggaccacgtaggccccacgcgtcagcctcttcttctctcccctctccccctctcttcctctctccccacgggcagcggctggcaggcgcaggtggcgtggggagcagctgcacgggcggaagccggcggggaacaattgggcggcggtgcacgagctcctccgacttgctgaaagagcggaaggccaacgcggcgacgaggggtgcctgcgtgacttcctggagagggcgaacaaggacggcggcacaacgatggagtacagggagcgcggcgtgttcaacgcgagcgagatggtggtggagatacagagcgtggaggctatggggaacaaggacctgttcgtggttgggagatcaccagcatgcattccgccgtgctgctcatggtcaccgctgttaaatatgtgatccgaattttgggcccacaatatattcggattagtttcctagtaggagtcctattaggtgtctttcttttataccctatatatactcttgtaagccgtacgggaaggggtgacgttcctattgtgattcccctacgtttgtaatcatctcctctatagtgatcattgccggtcggcgcccgtggttttttcccgcaagggttttccacgtaaaaatttgtgtctccgttgtgcatctattttcataacaagtggtatcagagcattggagatcgttctactattcccggccaccggcgattgtttctcgatcgaagaaatcgatcttatcggcggtggcggcggctcccgtcgtctcgtcgattcccagtccgactcagtgtttcttgtcctcgtgcagaggagaaaagccgcgcaagcaatcgaagcagaggagtactactgcagcgcacgcgcaccgaggaaaagtataggagtatcagccgagaggtctgtctagtacaggcggatttttcctataggcgaatttgctatacgcaccaagcttgtgtacccaggagatctacatacttcgctacgtgcacacgagaagtgtaccaggtttcgtgtttttgctaggtttaatttctttctagcaaattcaggattaattccca

SEQ ID NO: 51450 - DNA, 1501 bp, Oryza sativa
cgagtaggctctttaatggctcaatcccatttcctcattcttgagcatggcgcatagatgttgtcataggaagtgcaaggcctcatcgttctcgtcagggataagcgcacgatcttgcagtgtgcccatccagatcgtctggcaaagcttcttggccctgaggacactctggacattggatgcctaggttaggtagttttggctgtgcggggctagataagcgaactccttgttcgtgattcctgatattctgttgcaaagtgataaaaaattcaaaagtaactgctagtaacatgcttgcaaatacgaatacaaatattttattattttttccaatacttctatgtaggaaatgcgaattattcaattaaataaatacaataaagaaatgctagagttcatacaaaatatatacaaaagaagcataaagtgaatatattcatataaatactgaaaataaaatttttaatatcaagtaacagtaattaatgcctcaagtatgaaaagacaagttcaaattctaaattcgtaagacacaatatgctcaaaaacgaaatataagcgaaatttgcaaaaaccaagggccgttttctaagtttccatgcggtggacggttagaaatggaagtttccgaaattctagtattgcgcaaggaaactccatgctgagagttgtgggtgtgattttcaaaaaaaaaaaaaataataataaaagggccttttgcaaaattgccaatttcattcctttctctcttgctctttcctttccccattgacctcctcagcgtggcgctgcggcgaggcgaggcgcggcgctggcacggtgccaaaaacctcaatcggctagtgccgatgactccaagtccgcaatggtggttttcgtcggaagtcacataaaaggaacaaggaggatacaacaaggaatttatttttgaaacccagtatacaagatgcaaagtggattttcgaggttttgaaatttaatgtacaagatgtaatgacttaataagactcggcccatgccggtccagcccgaagcccaccgtgctcctccttacaaaagtctattttgcctccctcatctcttttgggccatctcttatatggctatagtaagtctattttgcatcccttatgtccccttgtatggctagaataaaactattttggcgctctcataaaataaaaagtaaaccgaaggtccctcaacttgtcatcgagttacaaaattgtccttgaaccataaaaccggatatgacgcatccctcaacttataaaaccagtgcatactagatccctcgggggttttgactccgattttatcctatgtggcagctgacttagcgtgggaccacgtaggccccacgcgtcagcctcttcttctctcccctctccccctctcttcctctctccccacgggcagcggctggcaggcgcaggtggcgtggggagcagctgcacgggcggaagccggcggggaacaattgggcggcggtgcacga

SEQ ID NO: 51451 - DNA, 1501 bp, Oryza sativa
gtacagtaatagatgtacagtactaataacactggaataaatttttaatgagaaccattaaaaaaaaattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaaccaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatacctaatatctagttgaaccaatataaataaagctcaactagtcaaattgtaataacccaaggtatcaaggaataaggtaatca

SEQ ID NO: 51452 - DNA, 1501 bp, Oryza sativa; identical to SEQ ID NO: 51451

SEQ ID NO: 51453 - DNA, 1501 bp, Oryza sativa
ggttacccatagaagccctctgaaaaatattggaaaagtagaactgttctcctccctttctcttttaattaaaccaaactaatggcacatgcacttcataatttttttttaatggttctcattaaaaatttattccagtgttattagtactgtacatctattactgtactaatggctcatttaccagcaaaagttttacaatgttgtatttaatcttgctgcaataaaataaatttagtatgtcgattttataattttcttttatttcttttgaaaccagttattcaaaattacaaaatttgtgaccttgtctccaactatttcaaattatctcgcaaagcttggtttactttatttacttcccttctactttgatttctaaactttattcaaattaatccaaaaacttgtgctattaattggataaaggtcttaactctctcctttcacttgtctttagatgccgcgttacaagcctgagtacctgtttggtgttgagggttttgtccaggagttgcgtacgatgtcctttgtcattggatttgggactgcccttttttatgcccagattcgtcatgatcgtcatgaagaaaagtgccgagtcaaagtcaccttgaacagcaatagtgaagaggtcccctcagtgatgtttgaagctggaggaagaaactacatccatgcatgtcaggaagtggcaaggatcgccataggagagctccgtgatcgctacagtgatcggttggccgatactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagatcggaatcgtggtaagatttgcaagctagaagacaaggtggatcgcttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcatcataagtagtgatgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaggtaattctctgtcctaagtagtttcccccgttttctc

SEQ ID NO: 51454 - DNA, 1501 bp, Oryza sativa
tttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattggttgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatttttttttaatggttctcattaaaaatttattccagtgttattagtactgtacatctattactgtactaatggctcatttaccagcaaaagttttacaatgttgtatttaatcttgctgcaataaaataaatttagtatgtcgattttataattttcttttatttcttttgaaaccagttattcaaaattacaaaatttgtgaccttgtctccaactatttcaaattatctcgcaaagcttggtttactttatttacttcccttctactttgatttctaaactttattcaaattaatccaaaaacttgtgctattaattggataaaggtcttaactctctcctttcacttgtctttaga

SEQ ID NO: 51455 - DNA, 1501 bp, Oryza sativa
gaaaaatattggaaaagtagaactgttctcctccctttctcttttaattaaaccaaactaatggcacatgcacttcataatttttttttaatggttctcattaaaaatttattccagtgttattagtactgtacatctattactgtactaatggctcatttaccagcaaaagttttacaatgttgtatttaatcttgctgcaataaaataaatttagtatgtcgattttataattttcttttatttcttttgaaaccagttattcaaaattacaaaatttgtgaccttgtctccaactatttcaaattatctcgcaaagcttggtttactttatttacttcccttctactttgatttctaaactttattcaaattaatccaaaaacttgtgctattaattggataaaggtcttaactctctcctttcacttgtctttagatgccgcgttacaagcctgagtacctgtttggtgttgagggttttgtccaggagttgcgtacgatgtcctttgtcattggatttgggactgcccttttttatgcccagattcgtcatgatcgtcatgaagaaaagtgccgagtcaaagtcaccttgaacagcaatagtgaagaggtcccctcagtgatgtttgaagctggaggaagaaactacatccatgcatgtcaggaagtggcaaggatcgccataggagagctccgtgatcgctacagtgatcggttggccgatactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagatcggaatcgtggtaagatttgcaagctagaagacaaggtggatcgcttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcatcataagtagtgatgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaggtaattctctgtcctaagtagtttcccccgttttctcttcttatcctgtcatgccaga

SEQ ID NO: 51456 - DNA, 1501 bp, Oryza sativa
gcgtttggaattttggatagaaattccgggcgtgacattggcctccatctacaataaatatctttgaaatatagtaattgatagtttcttctgtcggtttagtttccttctttttttaaataaaaagaagaacttttaagcatcgataaatctccaaaactgctgccatgcctgctaacggcgacaattggcaacgccaggccgtgcagctgcagctacgccttctgcccaggggcgggcccagctataattcaagggtattcagatgtatacccaagaattttggacaaaaaataggtatatatactctatagttcatatatgtatgcaaaaagataaagaaaaagagttaaactacttatttgggccttgttttaccatttctgctgtattgggcctaaattctccactcccctctccctttgaactcggccagcccatttccaaacaaaattcccctcctcccaattcccaaaatccccaatttcaccctaaccctaattttgagacagccggtgcgcctggagggcttgcagcacgggcggcggcgcgcgttccggcgcgggcggcgggcgcggcgtgcggcggcgggcgcggcgtgcggcggcgggcgcggcgtgcagcagagtgcgcggcgtgcggtggcggcgtcgcagcgagccggagaccgcagtaccgcagggcaggcgccaggcgggcagcacgccatcagcaaggaagcaagccaggcagccagaggggcaggggcgggccgcgggcggacggccggcttggcgcaccggcggagggcggaggcgcgtagccgcggccgcgcggcggcgcaacgccggcagcggctgagcggcgcgtcggcgtgaggcgtcgccgggcgccgactccaaagtccagcgccgcgtgctgtgggcggttagttcgtggctgggtgccgaccgccgagccgccttcccctattccccagttcccttcccgccttcccccgccgacgaccgaggctgcgactgcgaagacgccgacgggcgacggccacgctgccaccacattgccagtatgccccagtgagtcagtgagtatgaagcacaaattttgaataattgcaatgaagattttaggattgggtaccgcaattgattgatttagtatacttgcttgggtgcttagttgcaattcattgctcaaatgctcaatttcagaatttaaacatgaagaagaggaagggtcctgctgttgatttgaagtcctttttggagaaatctgctgcaaagaaggcaaatcgaagccaaactcctggtgagggcaatttgaatccgattgatagtaatttaaatccttcttgcaatgagagtcagatgcaattagtcatttatcaaggtcatcatcatgagaatgagagtggtagtccagcaagtagtagcacaataccaattgatccagcgattagtgatatgccaggatcaaatgatgaatctcaatctagtgatgaagacaacgatggtggcttgta

SEQ ID NO: 51457 - DNA, 402 bp, Oryza sativa
cgccctctggccgggcggcaggcctgccgcccagccccgagccctcattcctccccctcaaatccaatgaaaaaaaaagaagaaaggggaggagaagagaagaaggggcgaagccctgccggattcagacgccgatttcaggtaatattcatagatcgtatatgtgactattgagttaaatagtgtgtattttttaaaactttgtttgaataaatgcattatatttttagggttttagttgtactaatctagaagtgcgtattgtagatatcggtaactacgtagatctactagtttggaatcaatacattaccgttgcattggcatacacaagaagatattacgttttagattgcttcagcatgaaagagtaatatgatctagttattttgttgacagata

SEQ ID NO: 51458 - DNA, 1501 bp, Oryza sativa
atttaatacacaaaatagtctggaaatttgggctaaatttctgggcgtgacaaagtggtatcagagccaacttgactgtaggttgagccaaatggtcaaaccctaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagtgagaagatcagttcagagtcgtcgttctgcgaagatcaagtggagttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcatttttttcaaggacaatagttcaaaagttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggttttcctggaattacttgttatttgaattgggaccagtcgaagcggacatagggtaaatgatttataaatgccagattccattttcatcctcttatagccagcgtggtgaattctcaggttaccaaaattgctaacctcaacagttcagtccaaactaagtaagtttcaggagcatccgcagtcctagactgggtcagttcaagcagaacc

SEQ ID NO: 51459 - DNA, 1443 bp, Oryza sativa
tttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaatttatcgtacttatcacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccacggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaa

SEQ ID NO: 51460 - DNA, 247 bp, Oryza sativa
tttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcgtgcca

SEQ ID NO: 51461 - DNA, 284 bp, Oryza sativa
cggccaaaagatttttctatgttatgttaataataaataaagaagtatttattggtaaaacttgttaatattgttataaaaatgtattgaagttggttgtttccaatttcatatgttaagtgaggtattattttgtaccttattcgacgtatcagtactcggataattaatataggcctatcgcagtctcggtcgtagaaacattatatggacttaaacaaggagaattatgtaacatgaagaaatagtagtacaatttgaacatgatacaactatttccattg

SEQ ID NO: 51462 - DNA, 1469 bp, Oryza sativa
tatctcttccgagtgtgggcccccccgggagaagaaatatctcctccggctcggcttgggaaggtaggtgacggcttcgagtatatatagtggggacaactaacctcaaacggtttagggtttgaacccgtttgaggttagtaaacctcacctctgacggccatccgattgcaactcgtcacaggtaactagtcacctgtgacgggccagaagtacaaaccgtcagaggtgaggattaactcacctttgacgggttccgttttcgacccatcacaggtgactagttacctgtgacgggtcgcagctgaatagctcaccgatgacggaatcttttaggacccgtcaaaggtgaccatcatcactgactaccacttatgcccgtcatagatatgtcgtcacaagtgtgaggatctggtgtcgtgtttgtggttgctaattatagcagaggaattggtgttgattatatttgttggatgtttgaactaatcatgttgcatgtatttgtactgtcaatttgtggcttgggagcaatgttgtccacactagtccaatatgcaaacatatgcaaatttttgtgctgctaagtgaaaaaggatggccaagtcctagtctaatgtaaaactatggtgaaaaaatctagtccattgtgcaatttactctatttttaatgataacgatatagaccatgtccagatttatatacaaaactgaacttattttaggacggagatagaattacataagcattatgtcagcacatagattgctgcattgttgatagctcagttctagatggggacaggattcacaaacagatccccaacaatctcctgaatatacctggaaaatgtatatgcatctttcttcttatcgtaaaagaatggcactgatacggccaagttcaaaagtcgttgcaccacagggaactgctggtgatgatcacaacgaacctgattcaaggttctccattcactttcaatcattgattcgatcttgtctaaggcaacttcgcttgtaaccttgttctcattcatatagcactctacagtgtttgcggcatctcctttgttctttcttccagactgcatgagtgtgaaaaaaaagtatgttacttcctctaatttacaatatatatttagcttttcttctcaaattttgtttcaatattatatgctgcaggaattagctagttatatacaaataacatttcaactctccactaagaatttagtaatgtaaagtgataaagtagctgaaccgcattcagcatccaattcctgcgtgcatatttaggttgtgttccataaactaggttggggacttctccaagtgtatgtaaaacaagggacttattaacacacaattaattaacgattagctattaaaaacttgaaaaaaataatttttaaagcaacttttatataggtttttttttagaaaagcaccactcaacaattcacgaaacatga

SEQ ID NO: 51463 - DNA, 1501 bp, Oryza sativa
gaaggcggtcggtgttggcgcgtccgttcccggtgattgggacgccgttcaagggggaaaatgggggaaatcaaagaggaatcaatggagattaattccccctatttaatttggaaaaagccggcttgaatggggtggatttggaggaggaacaacgctagggttcacgggagagagagagaggaaggaggccggcggctggaggtcggggacgcgcctggcaggcgggacccatgcgagaggcgcgcagtcaacgcgcggcaacggcgcgcacgcgcgcgcacatgcgcggcacgggtgggaggcgcggctcggcttgggccgggcaaagccgaggcggcccaggaggagaagaggagggagctgggcctaagggagggaaggaggaaggggcggcccgggaaaaacagggaaaacagagggaggattgaaggactttgggctggactcggcccaaaggagggaggaggattatttttagtttttctttttagttaattgttgttgttgcttaatatataattccggtgctctgaaaattcaagtaaaatttgagagctccttttagaccaaggagaatttaacaaaaattttctgggccacattcgaatttttcttatacgtattttagtgtttgccaatttcttttcgaattgtaattaattctattattccttttataaaatgatttttattttgggatgaatttatcaggacgtgacaggtcagaggtgtaccactgtacccacaagacacaacctcaacatcatgtcaaccatgcgtcgcgatacttaacaagtacccgaatagagattgtgacaataccctctgcataacacaattcaaagcagtttactattcctggatcataatcacccccttataaacaaggcatagactccccagaaacccccgtgtgcttatctccgccacttcacagtctggtgctccagaatgaaccatactatataaaaagtaaagccgttgcccacgctggcttgtggttggcacggttaatgtttcacaaccgaaaatcgtgaaccggtccttaattgtcatgagcacgaccatcaaaaccatgcgctcacaacccaccattatcaagttttagttggcaaattaattaattaaccaatcacgattaaccatcgtgagctatcattaagccatcattaaataatagtgaatcataagttatcccatttatatgagctaatgtctctaagcatggctaagcatcctatgcacttttagctaaaactatataatgttctagctaatccaattattaatcaaacgacaaagtataacaaaggcaataggttattcccacccaatgacattcgaaaataaatgcagtagttgaatagaaacaatagctttaaacgggatcaacatgctcaaaggattgtttgggatatgtgtgacttgccttgttggccttggaactcttcaaagtcttctcctgcaaaatcggactctccaggaacgtcggaatcga

SEQ ID NO: 51464 - DNA, 1501 bp, Oryza sativa
gacagacggacaaactgaaagggtaaatcagattttggaagacatgttgagagcttgtgctttagacttcggtggaagttgggataagaatctgccttacgcggaattctcgtacaacaacagttaccaagctagtcttcaaatggctccttatgaagcactatatggtcggaagtgccgcactccgctgtcgtgggatcagacgggagaacgtcaggtttttgggaccgatattctgagggaagcagaagagaaggtaaagatcattcaagaaagattgtgtatagcccagtctcgtcataagaattatgctgacaatcgccgcagggatttaagttttgaggaaggagatcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacactctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggttttaaaaatcttcttttggctttgggccgaaagtcggcccaattctctccctctctctcctcggcctgcttgcgcccggcccaaccagccagtcgagccgagccgccgctcgcgctcctctctcccgctgacaggtggggcccacctgtcagggccatcgtcttcctcgcgccgcccagccgcgccctagccgcgcaagccgccgccgcccccttccaaaattcgcccgcgtctttatatctcggatcaaatcaatagaggggaaatgatcctcgggatcccctcttccttttctcttttggaatcttcggctaatttcgtttggaaatcgttgaattcgagcttgattcgaattcgttttttcctcctaaccctagatcttccatcgccgttgccggcggccgtgggcctccatcgctgctcctagcccctatataaggacccccggga

SEQ ID NO: 51465 - DNA, 1501 bp, Oryza sativa
gttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgggtacagtggtacacctctgacctgtcacgtcctgataaattcatcccaaaataaaaatcattttataaaaggaataatagaattaattacaattcgaaaagaaattggcaaacactaaaatacgtataagaaaaattcgaatgtggcccagaaaatttttgttaaattctccttggtctaaaaggagctctcaaattttacttgaattttcagagcaccggaattatatattaagcaacaacaacaattaactaaaaagaaaaactaaaaataatcctcctccctcctttgggccgagtccagcccaaagtccttcaatcctccctctgttttccctgtttttcccgggccgccccttcctccttccctcccttaggcccagctccctcctcttctcctcctgggccgcctcggctttgcccggcccaagccgagccgcgcctcccacccgtgccgcgcatgtgcgcgcgcgtgcgcgccgttgccgcgcgttgactgcgcgcctctcgcatgggtcccgcctgccaggcgcgtccccgacctccagccgccggcctccttcctctctctctctcccgtgaaccctagcgttgttcctcctccaaatccaccccattcaagccggctttttccaaattaaatagggggaattaatctccattgattcctctttgatttcccccattttcccccttga

SEQ ID NO: 51466 - DNA, 1501 bp, Oryza sativa
tcttgtttatggctaggatgggttgggaactatgtcacgtctttcgtccgtatgccgtggtggtatgtggcgcgttgttagacgtgaggaagacgtgtcttgtggataaagatttacacctctgatcagagtataatctattcgaatagccgcgccctcggttatgggcaagcctagcaatgtacccaagttagtggtttacttcttaaaatttgcttaacaactataatgtggaatggttggcctgggttggcttgggacaagctgggacctaggtcgggttgtcagttcggtctgaatcatcgtaggccttgggttaaggcaggttcgtgagggttcacggccttgattaataacagtgtagctctaggatcgtctttataaaatggctttgggcaactaagtgacttttaaatgctgtttactgcaaaacttaacccctatattattaccccttgtacccccttgcattaatcatgcatctcccggtgtggcttgctgagtactgtggttgtactcattcttgctctatcttccctccccttcagtacgagaagctttggagaagaagtcctaagtggactcctagcttataccccagttgagcgcctgtgaagatggagccgtaggcccgctagtccgctgctgtttatttttgattgtcaggccttaagtgtctttgtaataatgtaaatattatcgatataataaagatgtgccttttgtatcatgtttgagtggtgtacctcggcttttcctgggacggggattaatacactagcgtttgggaaaaggtaatttttccgggcgcgacatggccagagtaaaactattcgaatagtcgtgcccgcggttatgggcgggtctaataatgtttagtttcatacctctcaccatattaaatgatgatgataataatttgtttagctcctggtttggaatggtatattcctggtttggaggtagaactgtgtagccgggattggttgttcagaatggttgggcctatgcaacgggtatgttgtatagcgttggattaatactgtttaattaaatactttactattttattaaattctggagtatttattaaatgccatttatgcaaatgagactatattatgccattctttgttattccctgcacttgcatatttgctgcgtgacttgttgagtatgtcatatactcaccttgcaatcattcatcagacgaagagttctacagtgatgctgaaggtgtggaggattaggtgtagccctggtcaagctgcttgtgggatggagtcgtctgcgccgttcatcttatttttccgctgcatggatttttattgtttgagaggaactatctacctctgtaataactttatattcgcttattaattagagtaatgattgcactctattatcaatttgttattgtgtgccttggctgattcttgtacgagggtttacacacatgtaagcgtttggaattttggatagaaattccgcgcgtgacagt

SEQ ID NO: 51467 - DNA, 1501 bp, Oryza sativa
aaatttcagagaacttggcattggaattgtggcgtacagcccgctagggagagggttcttctccagtggagctaaactggtcgatgaacttcctgacgacgatttccgcaaggtgattatactgcccatgagatcaaccacgacagccatcaacaattaattacgatctaaataaaatcttaaatatcgattctttgtttgtccaatcaatacatagatcgacattgatccgtgcctgtttttcacaaatataatatgcattttccactcttctcttcagagcctacctagattccagccagagaacctcgagaagaacgcggcgatattcgagaaggttaatgccatggcagcgagaaagggatgcacatcgtcgcagctcgcactggcctgggttcatcaccaagggagcgatgtctgtcccataccaggaaccacaaagatccacaacttcgaccagaatgtgggagcactgtcagtgaagctcacacctgacgagatgtctgaacttgagtcgtatgcttcagctgacgttgtgcaaggtgacaggtatcatggtacttttctgaacacctggaagaactctgaaactcctccgctgtcatcgtggagatcaggcaattaattagtcagagagattgtcatctgctgggagtttgatggagttttattgtcacaaatatagatagcttggtgtatcaatcacatgtttattatgcaaataaaagtttgtatggattgataatgttccagtgtttttgccatgtggcgcagcagtggtttgtatgatttggatgatatatagtatcttttgtaagttgggtatatgatatctattaagcataggaatatagaagtttcgcttgccataatatggctcatgaataaacaaatgtcctgaacagccaaagtttgactatagcttgagtgtgacaaacatttcaattggatgagacaaacacctgaaaagttcattcttatttgtgatgtaactaattacaaaataactaattgccaataaatttaattctttatgtaagatgtcacaaaaattacagttaataaaacagtcgtactatttacaattactctcactttattcgctaaagtctcatcactacagaaatgcccatcacagcatcactgccaccggcaatatcactagagggttgtcaaccggtagtgatgccagtttcggaaaaaaaaaagaaaatctgagttgctcgccaaactattaccattgtcatcgccaatactgtcgtcacctagccatcaccgctgtcatcgcaaagtaggtcgcaaaccgataatgtttttgccatgtggcgcagcagtggtttgtatggagtgtttttgccatggggcgcagcagtggcgctagggatgcacggaacggcaaaacgatcagtaggcccaaaaagataagggaggccaaatagacttattttcagcagtatcagccacagcccaaagagttgagggaggtaagatagacttattc

SEQ ID NO: 51468 - DNA, 1501 bp, Oryza sativa
gagtccaaaagacagaacattttcagtttagcttcagtatattaaaaaaaatcacatgatgctcatgaagcatcagatatctgaatatagcttcagtatattcagattgctcatgcaatcagtagcttcaatttcactcatgtagttctaggttgtgagtagcttcagactaatgcaatggcagttggcacttgttcagacattcagattgtcattcagaacgaagaaacatgcaattaaacaaactgacatttagattccatccgcgagcagccaccattattccaatcggcatcacggaaacaattactatatatcatactgacaaagtacaaatttgtcatgctcagatcactctactggcactattccataatactgatggaattcaaattcgtcatactcacatggcaaatttctgccaaaaaaatggaaactatttgtaactttaaagtgccggagccccatcgactagaagttgccgcctcggatgtagcatcagaatccagtgtggttatatcaggaagctggctcggacatggagtacctgcatttggcatgaaacatgtctgaatttctatatttcttaatctctacaaacaagaaccagctaattaagaaagttgcatatctctgaaacatatctgaaaccgggatgtggatttttatccctaggggacatcccctcgttgtttgcatgtcatctaaatagttgttaaaaaatttgaaaaaaattgacaacatagattaatacgaaatatatcactccacaaacatacaagaccaaattcaacttctataagttgcaacaaaaataataaattaaactgaaaatagttatctcacattcgcaactatatttattattttttttacaacttgtagaagttgaatttaaactttgatatatttcatattagtctatgttgccaatttttttttcatattttttgatgactatttaggtgatatgcacgaaacgagaggatatcgggatgatttcactttcccctgaaaccgaagcattaaaatccacatcttgcagtatatatatatgattcaaaccaaagaaaagtgtactcagcttcagctatgtgtaagctatgagctactgcaccactgtcaaaactatatgtgcactccatcaaaataagaacctacagtgaacaaaaattcacaagcaaatttaaagatctatctgcttcacaggatatcagcttatcttcttcaggtagtcagtcagactgtcagagagggtggtattcgtcaacaaaaaattcagaagcaggccagagtgagccagttgttggtcgatgctgacatgtttggtcctgcctgcagcagcagcaattgaaatgttcaatcatcttgaatatagccatttttccatctcccagtgtgcagcattatataagtgagtgacacacagcagaaaaatatatatataggcatcagccaagaagtacagcggccgtggcaatggcagctgctgcaatggcga

SEQ ID NO: 51469 - DNA, 1501 bp, Oryza sativa
aatcccaagtcatcacttatatgtatttgtcttcagttacttatatttagtcatttagtatatatttttattctaagaagtctctttacagagtttaaagtgtctcaatggttgataacgagaagaaaacgataaaattactattgaagaggtctataaaactaaactctagggacaaatctttagtccaaagactacacaggacacacggagtaactagttaactgattatatgcaatatcgtttagaaagggaagtgtctaagatggaaaattcaaggcaggatggccactttgcaaattgaaatgttccttccagctgttatgttcaggggtggatccaacgtggtgcagggggacttaggttcccctacacccacaagacccatggatatatacccgcagagcgccccctctaattttttcaccatgaatgataaactaaagcttcctaaatggctggaggttgaagaaactgtataattgagtcccttaattttttgttcctagatccgcctctggtttacgttgacagtaagaaagagaggtttacctactttttgtcgtataacccaaaactataggagcaattaatatgctaagtcaatggttagggctatcagcgagccgagcttgctcgtctgggctcaagctcgacaaagctcgagccgagcttaattctcttttgagcttttaagcaggctcggctcgagctcgtttaggctcgcgagctcgatcgattataggataatgtatattttgttgataagatttagtaaaaaaaatttaatcaataatattgaagataaagttatatatgatgccaaaatacactaatttttcacatgaatatatactaatttgtccttgagctactaacttatcatataaaagataaaaaatttacacacatagttagactcataagaatctcgagcttggcttgacaaaactcgtgagcttgcagctaggctttggttcggcttgttaagagttcgagccgagctcgaatcgagtctgaggtgactcacgagcctcgagctttttttgatagccctacgggtgatagttagcaattcaaaacgagtcacgtcgcacgcataagctcttacacatgctcctgctcccacccatgcagtgacgcttaggatctgtttgagaaagtttttggcaggtgcaacttctcttataatcataagctctctaaacagttgacattttcgtttagatcctaaaaagctatagctgttgaatccaaaaaagaataaagtcggaagctgggaaccccgacttttctatattctaaaaactgattaccaaccagcagctttttagaatcttaatctcttctaaacaatacccttacatactacagttacattgttatagcattaaccttatatatgtgagtggccatgcagagcccaggtagcatcactacaaagtaagaaatcgactgatccggccagccatgcatggcagcggcagccggcttctcgggg

SEQ ID NO: 51470 - DNA, 1501 bp, Oryza sativa
tcagggacaaaacgtggcccaatcaatttatctgtgattttaatttatctgttggcttgagattaatagataggggacccgtcaagatttgatgaattaagggattgattgacaagctcgccggcaggactatatatggaattatggatattgtcttattttgtcatcttttctccgtggtaatgcagacttttttcaggcaaaacgatgcaaaagtttcagcatgattagttaaaagaaagaaacattataccaacccgcacaatggttgttagagtagtgacttgagggagtcgaggattggtgattcactggagggagctgtgcgcaacaatcccactgtgttgaattaataaatgattggctggagtgtccatatactactaatcaaaaagtctacttccaaggagagatctaattggtttctagttatcatctaatttaatttaataattcactaatacactgcgtcacatatgtaacgtccttatacatgcatgttcgcttaaaaccagcacaaatatgaccaatttctcatccatctaagcctcattgactggttcaaattaaaatccgtcaccatttatgatggtttaaaatacagagcggcaccaattaatagttttaaggagtaataggtgccggttgttataacaaaccggcatatatgtactaggaaaaaccagcacatattgattactatatataagaggcacctacaagtaccatcactagctagcttcattaattatattggtgctggtcttggaacagatatctatgaggtttttctactagtgactacactaaaaatatatttcttttgttgaatcgggttaagcttgtatggaaaactccatgaaccttagtttcagattattttttttctctcattcattaagaaatatgtttcttacagtaagtctacatgctcttctaaagtcaaaaaaaattaatgatacttacgtaattttttatgaacgatgaaacatatatgaaaaagtcaatgatatcatatattaaaaaataaagcctaaaattgcacactcctaagtctaaaattgtactaggtatgcgtgtgtatggttaccttttttaactgtacttatgctgttatatatggctttactttatttttatctaagattgaactttttgtaactaattttgtaaagattatgagctgtaattttttcatgtaatttttgttattatttcaccctgaactttcaataccgcacgaattaccccccttgacctaatccagagcgattttgtcctacatgccatacacgtggcaatcatgtcatcattttgttttaaaaaaattatgggacccacctatcatactccgcttccctttttcctctctctctctcttcactttatctctctcatgggggcgcaggagtgggaggtgggtggtggtgcgagcggcggcgacgggcacagctgggtcgccagcggcgacgagtgcagctcggtagcgagccgctgtcgg

SEQ ID NO: 51471 - DNA, 686 bp, Oryza sativa
catcaataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagcttgggattgcaccctaagcccctggtcgaaccggcaaaggggggcttgcgcagtctcccggtgaggggcaacgagctccgtcatctggcgcgccaggtaaggggctcagcgtgtgttttctgagctctcatactcttccgtgtgcaccaagtttcccttgttcagcctaa

SEQ ID NO: 51472 - DNA, 1501 bp, Oryza sativa
ttcctcccttaccgggacattctcctccccatgtacttcctccctgacctctacatccgctgtatcatttactccctcgcccacctccacctcaattaattcttccttcctactacacctctccgactgttcgtgggaactaatgggttattctatgagtggactttcattcaggtctataagttctttcttccctttcctaccctctttcttccatgcaaacacctcaagagctttgaaatgtgaccccaatactatatctatatatgtttgccattcgatctctccattcaagtctaacataaacttatgcaacatgacaccggcgcccacatcgtatctcccttgcataccaactgactcatcactccaatccaattcatgcttaatgcgagacattaactcctcaaatgtaggcttcgcatgaaacactaactgtctaacaatcattccctcaaattggcttccaccggtactttcatctaccacacaaccaccataatgaagccggaccaatctatccatctacaatatttaacccatacataaacattaattaattgaaaataatctctaaataccatagcaatcccaaaacttccaaacctatcaacatgtccaactttttccataaaacataacataattgtttcaactcatatactacacattattcacaaaaaaaatttctcttctcctacaaagtgcctagacatcaccacaaatcaaccccttgcaaccatttcaatcaccacacaacaatccaacaaagccctaaccatcaccacacatgaaccaaatggagcaagattaatatgtgtcttccgcactacatccccacccacattatccaattaacatcgcaatcggagccaaatattatcaacccacggttggaaccaaacaatgcgaaatatccaataaaacatgggggaaattagggtttctagaggagtttaccttctcaatcgatcctcaactcaatcccgacgaaatccccttcgatttgagttgatttgggggagatttggtgaggggagaagagagggcgacgaaccctagcgcagccgcggtggggagaagagaggagaggctggctggggcggcctcggccggcctctaagtaccaaacctcagtgccaaacccgttggcgctgaactttggcatctcagcgccgaagtggttggtgctgaggtagctaccacgttagctgggggatcggcccggccgccacggtggcacgatgtcagcgccagcctcgttggcgctgacacggccaaccccaagcgcatgcgcttggcgctgcgccgacggcctatctttggttgaagtttttcgcaggggttagtttcgaaataagtttttaaaaagagtcaatttgtcaaaaaaaagggtactcctcccaactacgcagttgccatcgcacagcattatatgggtacagatgtacagtggagggaaatcgatcgatccgattccggccggccatggcacctgctg

SEQ ID NO: 51473 - DNA, 1501 bp, Oryza sativa
gtgtagtatatgagttgaaacaattatgttatgttttatggaaaaagttggacatgttgataggtttggaagttttgggattgctatggtatttagagattattttcaattaattaatgtttatgtatgggttaaatattgtagatggatagattggtccggcttcattatggtggttgtgtggtagatgaaagtaccggtggaagccaatttgagggaatgattgttagacagttagtgtttcatgcgaagcctacatttgaggagttaatgtctcgcattaagcatgaattggattggagtgatgagtcagttggtatgcaagggagatacgatgtgggcgccggtgtcatgttgcataagtttatgttagacttgaatggagagatcgaatggcaaacatatatagatatagtattggggtcacatttcaaagctcttgaggtgtttgcatggaagaaagagggtaggaaagggaagaaagaacttatagacctgaatgaaagtccactcatagaataacccattagttcccacgaacagtcggagaggtgtagtaggaaggaagaattaattgaggtggaggtgggcgagggagtaaatgatacagcggatgtagaggtcagggaggaagtacatggggaggagaatgtcccggtaagggaggaagtacatgtagaggagaatgtgccgttaagggaggaagcaaatgcagaggacaatgtgctgttaagagagggagttaatgtagaggagaatgtgccggtaagagaggaacgagatgttgacgatggtcgggaggtaggtgatgatgtggagttgcctgaggaagaagcgaatgctaaggatgtaagtttgggccttagggagttggttaggctgaaaatctatacccgacaggagtgtgaggaggttatgatacgcagtggattgaacccaggctgattggagtatgatacagaggatgaattggatgagtccgcttctgactccgatgatgatcgtccagtgcgcaagatgtcggagcatgaaaggactgtgtttgagaaactggtgggtagaaacccggaaataacacaattcgaggatcttacaagagccgggctagcaattgctgatgaagatccacaatatgacggtgccttcgaaccaatgtgtgatgaaccaaggaaggggttggagttttgatcaatggaagatctgaagatatggctgcagagttattctatccgtgtccaccggccttaccatgtcaaggaatctaacgcgtcagtaaagtatactgtggcttgtctcgatcgccgttgcaaatggcagattaatgcaaggaagagtggaggagataggtggcgggtgactagggtgggcgaagaccacacatgctgtagtgcggaagtaaccggcaagcatttgcaacttacttcgaggtttattggaaataggttacaggcatttgtgcgagctgaaccaactttgtctcctgtagctattgtcgaggcag

SEQ ID NO: 51474 - DNA, 1501 bp, Oryza sativa
ccgcccgcttttcacaaaggggaacggggatgttactcgctgttgtcgggctgctgatcatcacctggccgacacgacgtcccacggtttcgctgttcagacctgtgaatcgagaaccaaattttgataaatcaggaggaacgtggacatgagcatgtcaggataaatgcgagaaagataccctgaggagaaacccgggtcgcgtcctccggtccggaatagtcaaaggctggatggactcgagcctggagcggctggatccgtcttctaacgaagtctgcagtgacttcatacctcgacaagcctcgtactcggagatcatcgacaatgtcgatgaacgattggagagaaggagtcaaagggggctttgcagtccaagacgggattttgtccggttgttccgtaggaacaatgaagacagggtccgaatctttgatctgaaggtagaaccacctcgtccgccatttgctgcgagaagaagggcactggaaggggatataacgcgacttcaggccatcccgaagtcggaacccgacgcatccagacaccctgttgggctccatccaacgcagctcatagtaaaagcgaaagagatcaagaaagggctctaccccaatgtaggcctcacagagatgagaaaagatgctaagaaaggcgatggaattggggttcaggtggagcagagaaagaccgtagaagttcagaaccaagagaagaaattcggaaggcggagggataaaatcacagagaatgtagtcttcgatcacaaccatgcgacctaagacaggctggggattagtacctcctgcttccctttccatggtcccacgaccgggaagggcgccatcttcctaaagcttcttcagcgacgcgctggtggaggatgatttgccaagatccatcgtcgatcggagatcaccggagaaggggctaaggccgacgaactagggtttcttgtgggagtggagaagacgaagagcgcttgcaggctggatgttttctacacgatgggcggactttggatcctcaaaattcctttaaatagacacactaccgacggtgcgaattccaaggaaaggagagagatgctcgccggaaatttctgggtcctttacgcgcggcagttttttggacttcagtttaaattcgctcatgaccgttgggcttcaaacggtgttctcgactacgtcctgtctctacggtcctcgcatcgggaacgacaacagtctcgacacaagaagccgtgaatggttacacgagcttatttaagcagaagtcgggggctactgttagggttacgggttaggtataccctttaccctttgacgtacgtcgcatacctatgtagtatacccacacgtatacggatactctccgcgtaaattaaggaaacccctcacggagtttacaaatgaaaagagtcctactcggacaagactgggtcgtcaatgtatcgtgtaaggtttgatgtttccgagttctacttggaaaccgcctgacc

SEQ ID NO: 51475 - DNA, 1501 bp, Oryza sativa
attccaaactatgtccagcaatcagcactaaaaggacattaaaaaaatagatgaaaggtggtttctcttgcacaggtggagcaaaggacacaagttagatccgaattattgggagggcaatgccttctgttaagcatgtcataagtattgagtcgatcaattaacaggagccatccaaaaactttaaccttcatagcacacttactcttccagatccaagctagataactaggcgcatgtatatgcatgaaattaatgtcatatattttcttggaagagaacaaaccatttccccaaacataagaccagacatcattctcatcagataattgatctaaaggatcagctgcagacattgtatcatactcatggaaggcttgctcagacagagggagattaaaacgctgcgaaatactcttggaagaggttaaactcactgaatccttcaaagaaacagcataagagtgaatccttgggtacattactgacctgactttattattccagaaatcatcccaaaacagacaagtctttccatccccaaccttacaggtggacaatcccctaaaaatgtctgcaaattgtagaacatctttccaccaaaaagaccctctagggcgatcagcatgaggaactttattaatataataagtggaccagatcaagctaacccaaggtattgagagcctattataaaatttgtgcatatttttcattaaaagagcattattatgcagcctcaggttaatgactcctagacctcctctacttttaggttgacaaaccctttcccaaagaaccaaagatttcctgctagaattaatatcagttcctctccataaacaatttcttctagctctatcaatgttttcaattattgactttggaagggaaagagagcacatatagtaagttgggagggaagataaaactgaattgaccatagttaatctatctccataagacagaagagcagaagtagcagacaatcttctctcaaccctatcaactaagggggcaaaatcaattatctttggcctagttgttcccaaaggcagacctaaataggtgaagggtaaagtgcccactgagcaaccaaacatcttggacaaatgctgcaccttttctatatccacattcagaggaatcatccatgacttactgtagttaatcttcaaaccggtagaatctgcataagagttgagaataaccttcaaacagaaaagctcttttgaggaagctgtcaagaaaaggagagtatcgtctgcatactgtacaactggaaagccattatcaggagttgggattggaatagtcaaaacaccctgagaataagctttgttgacaacagactgtagtaaatcagcacctagcacaaataaaagaggtgataatggatccccttgccttacaccccttttgcaataaaaattccttccaagaaccccatttagaagaactgaagaagatgctgaagaaaagatcaaatcaatccaattca

SEQ ID NO: 51476 - DNA, 1501 bp, Oryza sativa
tctaccaaatataatctaatcttttccggaggttgttttaatcttttatctcagttataaatcatttgtaaattgtttaattaatttggaatagtcttttcttcaataggtttaattggaatttaatcttgtaaaatttgtaattaattcatatgaaatcggaatgaggtcgttcaagtctctaaattcatctaaaatcatgacacatgtttgtttacttttatgtactgtttatttggtttttattagtctttttcctcgttttgcatgttagcttgtcgtttccgttatttcgatggttcgcgtgtgcgtcggaagtattcaagaagattaattgaagaccgattattgcaaggcaagtcacacagatcccaaacacaattcctttgagcatgttgatcttatatttaaattctctatttattttaactgtgcatttatttttgaatgtcaccgggtggtgtgaacttattcctttgttatggccaatttgcattgattaccctatttcttgattacctcggggttataatttgactagttggatttatatattagttcagctagatgttagacataattgcttagccatgcttagaaacattagcacactattgggataactaatgcttcactattacttaatgatggatatttaattgtagctcacgatggtcaatcgtgattgtgaattaattaatgtgccaactaaaacttgataatggtgggttgtgagcacatggttttgatggtcgtgttcatgacaattaaggaccggttcacgagtttcggttgtgaaacattaaccgtgccaaccacaagccagcataggcaacggctttaccttttgtatagcatggttcattgtggagcaccagactgagaagtggcagagttaagcccacgggggtcgctggggagtccatgccttgtttataagggggtgattatgatccaggaacagtgcgctgtggtggattgtgttgtgcgatgagtactgttacagctcctttccgtggtaccgtggtggtattgaggcgcatggtgacatgttgtagggctgtgtcttgtgggtacagtggtacacctctggccagagtaaaactattcgaatagccgtgcccgcggttatgggcgggtctaacaatgtctttcgtgattagtcccacactactcattaataataatgtgataattgatggtaattaatttagctcctggtttggaatggtacattcctggtttggagatagatctgtgcagccgggtatggttgttcaggatggttgggcctgatcagcatgggtgtgctgttcagtgttgattaatattgatgattaattactctactgttttgcaattcttaaatgtttgctaaatactgcttttgcaaatgagccctatattatgccatcctttggtatcctatgcacttgcatatttgctgtgtagcttgctgagtatgtcatatgctcaccttgcaataatcaatcaaacctca

SEQ ID NO: 51477 - DNA, 1501 bp, Oryza sativa
ctatgactacattgatatcatatattttagggaaagaagaaaacaatatatatagaaaaaataataacgcaaataatgtaaaatattggttcaagtttttacattcttatgagccattttttctatatgtttattttctactaggttctaatgaatatgtaaaacttacaagttttataaaatcactgcaatttaacacaacacacttactattatttttcctaacacatgcacctatactcatgaacttaaacaacacaatctacccaaataattactgacaaatcataaattactatttgatccatctcaattttcgacaaacatatagataattaaaatccagtaaaacattcttttgaatatatgatttatgcataatttgaaataacccatatactcaaaaaataactaagccatgtaatattatacaaaatttccatattcaagatgatcgataaataatgtatatgggctataaatttctagcgcgccaactaacgcgctgattttctagttatacgtactatagatttttttacttttcttcttatataaattcagaatttatctgtgatgtcatgggctaacacgtggacctttaatttatctgtcggcttgagattagtagataggcgacccgacaagatttgatgaaataacggattgacaagctcgccggcaggactatagatcgatattgtcttattttgacatcttttttccgtggtaatgcagaccttttttcaggcgaaacgatgcaaaagtttcagcatgattagttaaaagatagaaacactatacctacccgaacaaaggttgatagggtagtggcttgagtaggtcgcaggagtggtgattcattggagggagctatgccacaatcccactgtattgaattattaaatcattggatggatgtctatatactacttcctccatcccaaaatatattttaggacggagggagtactaatcaataagactacttcgaaagagagatctaattggtttcttgctatctaatttataatttaatgagtcactaatacattacgtcacatacgtgacgttcttatacatgtatgttcgcttaaaaccggcacaaatatgacccatttctcatccaactaagcctcattgactcgttcaaattaaaatccttcacctatgactactcatttgtgatgatttaaaatacagagctaattaatttttttagataatacagagctaattaatagtttaatcaagtaataggtgcctatttttataataagcgcgcacatataaatgccacatacggtgtaagtaggttgaaaaaaccgacacctatttgtataagtggcacctgtaagtaccatcattagctccattatattggtgttggttttggaagtgatatctatgaggtttttctactaaggactacaccaaaaatatatttcttttgttgaatcaggttaagctaagctacacatgtccacttttcatgctactg

SEQ ID NO: 51478 - DNA, 1501 bp, Oryza sativa
aaaacgtagcaacatttctaacatagaatagacatactaataaaatatatatgttaacggcaaaatttggtgcatgccgttaggcaaagcaagtcaaagagatggttgaagttgtgattctagcaaggatggttggaaagtgtatcagatatatttaaccaatcttagaagtattttgtttttagttttcgtattaaggcaagtttgttagtttccttttctaacaaagttaattttgatgagttctaagtatcgagtttagactgcaccggtttcgatctccaacgagaaagtaagctccatcaacttcgcttatatcggcctaattagtaatttctcgattaagtccgatattctaatcacattttactaccgttccttatctgatatatcgactctttctttgatttctttgctttcttaatttgattcaatatatctgatatattggctctttatttgattgctttgctagtttgatttaatatagatctatcaagcctttcatcaaacttatattgtcttggttaagtccgatctgctagtcttttattcgttagatagacttattcaggcttgataggctctgttcaaagttctatcggagttttagctgatgagttatccatcacgattgtatagatctatcgactagatagtttttcttattgtcttcaatcctatactatctcattttgtcgacgggtgatacccgtagaccggatatagagggtattggggtacgttggtacaaggatctacgtaatacgacatcaagcagacaaaagacaaagattatactggttcagaccccttgatatgtaatagccctaatccagttgatgtgggattatatgatggaaaacacaggttacaaagggaatagtggaacttgacgaatccggcgagatcgtggtcgagttggctcgactacgatccctggcgatttggctcattgcaggctccgacttcgtaggctgtgtgggttgtgttggctctgagattcgatgccttaggtcctccccggggggtcccttttatatcacaggtcaggcggtttccaagtagaactcggaaacatcaaaccttacacgatacattgacgacccagtcttgtccgagtaggactcttttcatttgtaaactccgtgaggggtttccttaatttacgcggagagtatccgtatacgtgtgggtatactacataggtatgcgacgtacgtcaaagggtaaagggtatacctaacccgtaaccctaacagtagcccccgacttctgcttaaataagctcgtgtaaccattcacggcttcttgtgtcgagactgttgtcgttcccgatgcgaggaccgtagagacaggacgtagtcgagaacaccgtttgaagcccaacggtcatgagcgaatttaaactgaagtccaaaaaactgccgcgcgtaaaggacccagaaatttccggcgagcatctctctcctttccttggaattcgcaccgtcggtagtgt

SEQ ID NO: 51479 - DNA, 1501 bp, Oryza sativa
gaaatagaaaagaaatctatctttaacaaaacaaatctttcttactccagatgtcgtgtgtaagagtgtgttcttagttcacgactttagtcagtcgtttgagtcgtacactctccctagcccccagccttgtcgtcggaggaattttctcggaggataaggctcttggacctttgacctgccttggttgaataagctctgatcctagcccccagccatgaagttggaaagttaatttccgatttcacggcttggttaatacgcacggcgagaactcttacacgaccagatcttacatggtctttcgtctctacaggatctgacaaggccttatcggctctgggcgtccccagccgaagatcctttaggttcctcggaggccttgtcaagacagcgtaaagggacatgaggataggtttcaacgctaggtgtcatcagggtaagggatcatcgggcgggaacactttgattgtaatatgggcctaagaataggctttactgatactgtaaggtgtcttacaggtacggatggtattgagtcatacatagaatttacgtagttggttaatgttccaggaatttgctaactcgtgaccatcgccgtctgcaattttgaatgcgcctggccgcaagacttgtgtgatcgtgtaaggtccttcctatttgggtgagagtttgtttcgcgctgcttggctttgaacccgtcggaggacgtagtcgccgatcgaatgtatgcatactcggatgcgcttctcgtggtaacggcggagggcctgttgatagctggctgctcgaacgacaactcgttcgcgatgttcctcgagtagatttacatcgacgtttcgctgctcctcctggtcctcgtcggagtgcttctgtactcgtgtactctgatgtcatagctcgctggggagcatggcctcggagccgtacacgaggaagaaggttgtttccttgttacacgttgtcggtgtggtgcgtacggcccatagtactgatgggagttcctcgacccattttttgtcatgtgacatgagcctgtcgtagacgcgggttttgatcccttgtagtactatgccgtttgccctctcgacttgtccgttactttgagggtgagagaccgaggcgaagcatatcttgactcccagcccgatgcagtaatcctggaaatcagcgctgatgaactgggagccgttgtcggttatgatgcggtgaggtagtccgtatctgcaaaatatccccttgatgaatttgatggcgttgacagccttgatttcccccatgggtactgcttcgatccatttagtgaatttgtcgatcgccacgaattggaacctatagccgccctgtcctcgtgggaatggcccgagtatatctagcccccagcacgagaacggccaagtaagagggatagtctggagcgcttgcgcggatagccttgtgtgtttactgtggaattgacaggcttcacatcgctggaccatgtcgcatgcatatttaa

SEQ ID NO: 51480 - DNA, 1501 bp, Oryza sativa
cggctcgcggttcatgtcggaacgacaaggtttggccgcattagaatccttctcgagctcggatgtcgtcgatattccgttcttcgcctcggtgggagtatctttcgacatggagtcgtctcggtttgtagccactgcgttctcgtttccagtcattagtggacaggttgagatcggcattgtggtgtaaaccgggaagacgatttcgccgacttgagtccacactagcatcgttgaagcagggaatacttggctgaggttggtgttgacgctgttgttgacgaggctggatgacatagtagtagaaccttgagtaccaagtgcccctacctggcatgccactgtcgacgggtgatacccgtaaaccggatatagagggtattggggtacgttggtacaaggatctacgtaatacgacatcaagcagacaaaagacaaagattatactggttcaggcccctttataggtaatagccctaatccagttgatgtgggattatatgatggaaaacacaggttacaaagggaacagtggaacttgacgaatccggcgagatcgtggtcgagttggctcgactacgatccctggcgatttggctccttgcaggctccgacttcgtaggctgtgtgggttgtgttggctctgagattcaatgccttaggtcctcccggggggtcccttttatatcacaggttaggcggtttccaagtagaactcggaaacatcaaaccttacccgatacattgatgacccagtcttgtccgagtaggactctttccatttgtaaactccgtgaggggtttccttaatatacgcggagagtatccgtctacgtgtgggtatactacatcggtatgcgacgtacgtcaaagggtaaagggtatacctaacccgtaaccctgacacatttaggaccgatctatcggctagatatgtttaattcttgaaagccgatatgttttatacaacgtttcatcggagtttaattctagccaatgagtcattttttatagtcttgaaaagtatggcaccgtcttatgttcacatcggtaaaatcagtaactaggccctgtttgtttcagcttaagattattgtaatctagattattaaatcagattactctaagctgaattataataagctgacatagaataagctgcgagttgtttgtttctctggattattagaggcattaagggtagtgggtctttagccactcaataatctggaaaaagctcattcagaggagattattagattatactaatctggcttatagattatgataatctagcatgataatctatttgtttgtttcagcttactcctaataatccagattataataatcctaagttgaatcaaacagggtctaagtcatcctttgttagtttcaatggtttggtcccagttttgtgaaggtaacttagctttggaaagtttaaatagatctttcattactcttgttcccaaaaaatcaacacctgagagggttaatg

SEQ ID NO: 51481 - DNA, 1501 bp, Oryza sativa
catcaaagccaggacaatacaggattgtctctcttggtcttttgagtacttacacaagtgccaacaatcaaaaagggagatagtgctgttgaagttggactttgagaaagctttttatactatagagcactctactattttggacatcatgagacaaaaaggttttgattcaaagtggttgaattggattgatttgatcttttcttcagcatcttcttcagttcttctaaatggggttcttggaaggaatttttattgcaaaaggggtgtaaggcaaggggatccattatcacctcttttatttgtgctaggtgctgatttactacagtctgttgtcaacaaagcttattctcagggtgttttgactattccaatcccaactcctgataatggctttccagttgtacagtatgcagacgatactctccttttcttgacagcttcctcaaaagagcttttctgtttgaaggttattctcaactcttatgcagattctaccggtttgaagattaactacagtaagtcatggatgattcctctgaatgtggatatagaaaaggtgcagcatttgtccaagatgtttggttgctcagtgggcactttacccttcacctatttaggtctgcctttgggaacaactaggccaaagataattgattttgcccccttagttgatagggttgagagaagattgtctgctacttctgctcttctgtcttatggagatagattaactatggtcaattcagttttatcttccctcccaacttactatatgtgctctctttcccttccaaagtcaataattgaaaacattgatagagctagaagaaattgtttatggagaggaactgatattaattctagcaggaaatctttggttctttgggaaagggtttgtcaacctaaaagtagaggaggtctaggagtcattaacctgaggctgcataataatgctcttttaatgaaaaatatgcacaaattttataataggctctcaataccttgggttagcttgatctggtccacttattatattaataaagttcctcatgctgatcgccctagagggtctttttggtggaaagatgttctacaatttgcagacatttttaggggattgtccacctgtaaggttggggatggaaagacttgtctgttttgggatgatttctggaataataaagtcaggtcagtaatgtacccaaggattcactcttatgctgtttctttgaaggattcagtgagtttaacctcttccaagagtatttcgcagcgttttaatctccctctgtctgagcaagccttccatgagtatgatacaatgtctgcagctgatcctttagatcaattatctgatgagaatgatgtctggtcttatgtttggggaaatggtttgttctcttccaagaaaatatatgacattaatttcatgcatatacatgcgcctagttatctagcttggatctggaagagtaagtgtgctatgaaggttaaagtt

SEQ ID NO: 51482 - DNA, 1501 bp, Oryza sativa
ttaaccccgtaaacaacccaatctaaaattcgctctataaaagatttaaactcaaaaccttagagtattactcaggtcactgtaaccactagactacatggctcattaaagatgttaatcatcactaaagggcttccaccgattagagatgaggtgcaatcatgactaaccactgttacctgatgaggatcaaacctgtcagaggtaacgatatgggctcaacagcggtgatcggatccaactttgtcagggttgaacacactaaattaatttaatgattaacacggagaatatgctcgatcgattaaactttccatgcctgaatcgcgtgtttgagtaatatcaccaataattaggaagcacgatacttacgtactccctcataaaaaaaaaggcaaaccctgaatttacatgtccaacgtttgaccgtccgttttatttgaaaaaattatgaaaaaaaaagacaagtcaggtataaagtattaatcatgttttattatctaacaataataaaaatactaattataaaaaaaattcatataagacggacagtcaaacgttagatacgaaaatttagggtttgtcttttttttctttcgaacagagagagtagataagtacattttgcccttgattcatgcatggcttcatggtactaatagctggtacagtgttttttttttaaaaaaaaaggaacataatatctcatcgagattcatcttggtactagttgctcgtatagtagagtagtgaatacttcgtacaacattatgttttcattgatgtgacacgcttatatattattagtttatagcatgatggcagggaacaaagccagcgctgccacgctgcctctccattatactactaattaaagcttgattttcgttatacatacaggatgcgagtgagaaaaataatcaacaaaagaacaggataacaggtgaaatccaatatatcctatatataaataaagtccgtcctataggtttaatgttatttctcttttttctaattaagccatgtcaccttaattacttttagtcattagatgattaatatatggtccaaattaactccctcattttattcacttattgtcagggttatggataaagcatacctcctaccctacgacttatggaatacactaataaggtatacctttacgcacacggatcgttcccatgtataccgtttggaattcgttcaaaattacggaaaatatctctacgagtcaagtgatttctaaagtcctactcggaagggtagagtttctgttataccgtaccagatcagatattaacaggccttacttaagggtcaagatgatccacggtagaaaagggacccccagggaggggtgcaaggcatcaaatttcatcgccaacacacacaccatagttacgaagccagagtacgtggagcctagtcgccgggagatctcatcggattcatcaactacgatctcgtcggtaccgtctgtttcgtctacttcctt

SEQ ID NO: 51483 - DNA, 1501 bp, Oryza sativa
atagtcaaggagtaaataatgcaaccaactgagtggtttttgataattatagtcaaccaagtggcttgatattaatatatagcatatgcagtgtgaatctccgaataacatgatccaagtgatataccgactgctttgtaaaatatgatgcgtgcaacctaaagttgacttcatcattgaagattcaaatagcagaacagctataaagaagcttgtatgttgtgaataaagaaatttccagagtatcgggcacacacaccatgcgcacactgctttaacagatgtacttaagaacttaaaagacacatggttttaccactggaaatgtatggcacatgtgatgaaaaatccgactaaataaactcataaaggatttaccaaccgcctggaaaatgacgtaccataatatataatcagcctaagccataatattggtcaataaaaatgcacacttacatggcaaaaaaaacaacgatattgtatccaatcaattgctttataaaaccaaacagtgccttgactaataaaaagtcaacggggcagctatataaagcttcactgttcgacaccttttaaaatgcattgtaccaactcctaaaaagttgagtaactgcggtataaaaggattttaaggtattgggcacttaatctcccgcacctttgcctaagcaaaaaaaaatgcctaagtccctaaaagaacgtgacaggccacacctgaaaatatgagctgcagacgtattaggcctagacctaaattatgtataccgatacccttaaaatatgacgtatagaacacaccaattaatatgactccaagtgatgaatatcatgcatgatgtagatcaagcgtaattatccctcataaagaataccaaagtagatgtgataattgaatcccgactggcgcaaacactcagctgatgtccctcgtggggaataatgaattgtccagtcgtttgagcatgagaaatcgactcatgaccatgaatccatgttgaatgtatctggaacaagtccaaattgaagatataatcctcgcgcttgtgttgatcgcccctaagcatgtagcttattcttctgttgtagtcacaattgtccattgatggtagttgacgcagtcagtatggagacgaaatgaccaacatgaacatgatatcacccatcaaagctgacaaagatgatggtggtggtaaagataatgacaccaatcaaaggtgatgaagtcacatagccatggaggcgaagaaactagttggcagcagtcatgtcagccagtagtgaagacgaaggcgcccagcaacggcgatagagttgtgcagccatggcagcgaaataatcagtcgataacagacgaggcgcccggtgaagaagacgaagatgcccatcagtagaggcataataagccagccgtgaaagcgaagaaaccatgggcggcggtggacgcaagccggtggtgaagacgtagacgctcatcaatagcaatagcgaaatccatcaatca

SEQ ID NO: 51484 - DNA, 1501 bp, Oryza sativa
attaatacataattaattgcatgctaataattcacctcgtgatgaaacaaaggcagtcttgacaaccggcaaaaaggaccctccgggaggcaaaaaaaatcatcgaggctagctcgagacaaggagcccacaattaaaatccctaaaataatgaaacaaatagccaacaaaaatccataggatgaacggagtcacataatccatcaacacatcacataatatttacaaaattcatcacagatgaggatgttgaagcacttcgattttgattgatatagcttgggagaagattttcctcgattgtgaaggtctcggggcttcaatggatattatggacactcatactcacgtggcctggatatccgactagagataggaggtagaccgagtgagggattatgtaagagattagagcttgtgactgttaattgccttgttttttagggtaaaatctcatgaatcttagataagtacaattatgtaatagataaggaaacatataccgtgtccggttggattcctatctttgtaaccctacccctcgcacatataaggagggcaggggcctctcaaaggcataatcacaacttgatcgtgtcatcaatacaatactcggcggatctagtcctcaaaacaggagtaagatattagttctcattgagaagttttgaacctgtctaaaccttatcctctttactcatctgtcatggttatgcataccacatacctaatagtagttgactaaatctcggcaggatccaccacataccatgtcctatacggaaactaacttcagatatggagggagttccggataaggaaagacaaccagagttctacatggaaacgacaaggactactcggattgtatccatattggtttccctagttctacttggacaaagggacacctatgggtataaatataaggcccccgaggaggagagggggaaccaccctgagaggagaccatggaagacacccatgattatcaacatacacccaccagaagccacaacatacaagccaacatacgccaagacacgccgccggatatcgacttcacagataggcatggctattcccctacggtgtctccggataccgtcaggagatacgaaagcgctatctttgatctcgccgggtacggactcgaggaggaagactacccagttgtcgactacgagtcagaccttcagaccgacatgtcgacaacagttagataggctgcccacatattgtattggtgtgattatggtgaataaaaagcaacatcggctctggccaacaggatgtagggctattacctgaccgctcagggacccgaacctgtataaaaatccctgtctccatctcttttacctcagtctcgcatatatcctagcatcaacgatccccatactgtacaaataccagaattgcgatatcaaacgtcgacagtggcgcgccaggtagggggattttggtgcttcttggatttcgacgagatgggtttaagaga

SEQ ID NO: 51485 - DNA, 1501 bp, Oryza sativa
ttggatcgatcgctggcgattgatcgcccgttagggccccctagtagcaagagacataaaaaaccgaggctatacaaaaggaaataataataataataataataataataataataataataataataataataagggaaaattacaaaaaccaccccacaagtcacccacaagtcacttgaagtttgacattccatcccataagtcattttgttgcaaatacccacccgctactaagttttgttgaaaaaccacccaatgctagggtttgaaattttggttcgaaatttccgaaatttcgccatcccaccggcatgctcaagtctcgcccaaaatttttggatttttgcattttttaaaaaaatttggtcaaattttattcaaattcagtcaaattttcaaataatttcagccagaaatttctgaaatttcaggaatccccggcataaaatccaatttcagaattgaaaaccctacccaatgcgcacgtgcttaaccaaatcagtttgttattgcggatgtagggttaccacatgctaagctagccaagtcaatcttgtctaagtgcttaaattagacttattttccatatttgattgtttttttttcatatagcgaaactcagtgcgacaatgtttaaactctcgtccacaattttatttgtggaatcttacataaaatgtatcaataatactctagaaatatttagttttggtaaggaccacattgatagatcacattttataaaaacatgttgattcggttaagcatacgggggcgtcccgggggcccgtgcggactgtgcgaccgaacagggcccccaaattttaagggcccttaaaatattaagtatgccatatatataataatattagaggctttaattttgttaacttgcagtccaaatagtatcaaacacaaggcccaaaacgctgcagaaggtgaatcgatccatcttccatcgtgctcccatccaggcgttcgcgtcgtcgcgtatcgccaaagtcccgatgccgcagccacttcatctcctctccccagttccctctagcctccgcttctgcttcatcgctgatgatcagctaatcgtcacgcccgtttttaattttactataaaaaaatttactaggctactatggcctattttaatatttcgcacggggacctgatttgaccgggacgcccctgaagcatgtgtttactggggtggttgttgtaacaaaattgagtaggtgggtgggcatttgcaacaaaataacttacggggtggaatgtcaaacttcaagtgacttatggggtgatttttgcaattttccctgataataataaccgacacgcgtaagctcttgaacacatgacacattccttctcccaccaaccactaacgattgctctgcactgtatttgtatgtactccaccattatataagtgacggagtgaaccaagaagcggcggagagaaatcgatcgatccgattccggccggccatggcagctgctg

SEQ ID NO: 51486 - DNA, 1501 bp, Oryza sativa
ctgatttttttcttaaattacttatccaaatcatgatccgattgcaccattaaatttgttgcaattaaatcttcaaaacaagaccacacatagatatattccggcgacaacttttttaagcttattattgaattatttttaaatgttgtacgatgttccaccagatatatcggaattgtttcgctaagtagatcgaaaatgtttcactcgtttaaattgggtgttgtttcaccgtatataaaaataatgtttcagcaaatagcgaaagattgtttcagttcattgcaacatttgatccatacatagtaaaacattataaatgcactaggcgaaacattttttggtggaacaacaaataaaacgaattctcttaataggggtttctaaaatatgtgggttttttttgttgcaatggaatatttcaattcactgcaacgttacatctatacatagtgaaacattatgagtacactagatggaatatttttggtggaacaaaaaataaaccaaattttccttactagagggtttttaaaatatgtggttgatttgttagaggtggaggcaggtattgtggtgggaccagcgacatcagcgtgcgcgcggggacagggttgggggtagcgaacgatttttcctcccccgcccggtcgcccaacgaccatcattatccaagaaagacttccaagtcttcgaccgcgacactccttacccgcacgcgcggccatgggaatgtgaatccgacgtatggccatggaaaaactgatactccttggtctcggtaactatatgatgacatctttttaaataaaattaaactcgttaactttcgactaataatcatactaactatatatactatatactaagtattatacatactatataatatatcactagatttatattttaaaatatacttttatatgacactaattttatttttttaagaaatacaatatgtaataaattgatggtcaaaaggccctatttggatccaagggatattttttagtcctctcttaaatagcccaaaaagatccaaaagggtgagctatttgagggctatttgaaaataatccaccaaaaaactatcacatccaagaagtgctaattgaggatatttcgggtgaggtcctctgaaaaagtgtcttttctctctatctcttttcatgggaaggtacattaaagccaaatagctctcaaaataacacttgatccaaataacttagagctattttattaaagtgttattttcttgtgataaaaaatagctctcagagtaactcttggctaatttaggaacggagaagcacgtgcgtaagctcttacgcacactgtgcagcgacgcttgcagtgagttgtatggtactagcattaacccctatatatgtgagtggccagagcccacgtagcatcaccaccggaatcgcgcgcgcggcggagagaaattaatcgatcgatcgatcgatccgattccggccggccatggcagctgctg

SEQ ID NO: 51487 - DNA, 1501 bp, Oryza sativa
ttatttccatttcagagaacttggaattggaatagtagcttacagcccacttggtagagggttcttttctggtggagctaaactagtggagtctatctgttcaggatgttcgcaaggtaaattcttatggatactactcattcagttttccctaagaatggggatgaaggaggtaatgaaaataggtatcatgcctcttattttgaaacattgtaatttaattatattccttatatatagtttgaatattgggagtttccactaaataccttcgtgtgtactctcattttccaaactttgtgatgtatattaacgcctcgtctatttatttatacttttgcagcatcttcctagatttcaaccagcgaatctcgagaagaatgctgaaatatttgagcgtgttaacgcaatggcagccagaaaaggatgcacaccgtcacaactcgcattggcctgggtccatcatcagggaagcgacgtatgccccatacctgggacaacaaaaatcgagaatttcaatcaaaatgtagcagctctatctgtgaagctcacccctggggaaatgactgaacttgagtcctatgccagcacagatgttgttcaaggtgaccgctatgctcagacggccggcacttggaaggattctgagacccctccattgtcgtcttggaaagcagagtaaacgttttcatatgttcaaatacaaaatcccggttcaaatttagctcaaatggcagagcacacaccagattttgtataagtgttcattgtatcagacgcgttgctcgctcttgttaaaccatcgcttatgcttgtttgtgtctaaaacctagctagtggtgttgtaaagtgtggttttattagtttgtgcgcagtacgtgtgcgaataataaataaagttctgaggtcacattttttttttgttgccgacatgtttgttcaaaatttgaaattaagcagtgtcatgtctaaatctatattcatgtggtctgctgactggcttcacagccttgtttgtttattaccttcacctaacaataaatcgactgcattatatttggttgtgaactgtgtgatcggtgggaagattatattaaacggtgcgtgttttgaaaaaaaaaatctatagaaaaattgctttaaaaatcatattaatctatttttgaagttttttaaactaataattagttaatcatgtattaattcattactctgttttccgtgtcaaaagtgagggttcctgaccctcaagccttacctaagaacacagccttaaggcatccacaatatggtgtaaaagtagtccataagcaatagaatattccatccaaccacctataaccattgtgcaactagtccatatagaaaaaataacaaaaggtatccatatacatatggactacccatatggaataaattatattatctatctctactcatctctcttctcctaatgatacattgtatccatatatattgtggagattgtcataggtaaaaa

SEQ ID NO: 51488 - DNA, 1501 bp, Oryza sativa
caatttggacttgttccagatacattcaacatggattcatggtcatgagtcgatttctcatgctcaaacgattagactattcattattccccacgagggacatcagctgagtgcttgcactagtcgggattcaattatcacatctactttggtattcttcatgagggataattacgcgatctacatcacccaggatatttatcacttgggatcatattaattggtgtgttctatacgtcatattttaagggtatcggtagatatattttaggtctaggcctaatatgtctgcagcccatattttcaggtgtggcctgtcacgtttttttagggactaaggcatttttttgcttaggcaaaagtgcgcgtgattaagtgcccaataccttaaaatccttttataccgcagttactcaactttttagaagttggtacaatgcattttaaaaggtgccgaacagtgaagctttatatagctaccccgctgactttttatatagtcaaggcattgtttggttttataaagcaattgattggatacaatatcgttggtttttcgccacgtaagtgtgtatttttattaaccaatattatggcttaggctgattatatattatggtcattttccaggcggttggtaaatcctttatgagtttatttactcggatttttcaccacatgtgccatacatttccaggtgtggtaaaaccatgtgtcttttagggacttaagcacatcttttaaagcagtgtgcgtatggtgtgtgcccgatactttggaaatttctttattcacaacatacaagcttctttatagctgttctgctatgtgaatcttcaatgatgaagtcaactttagcttgcacgcatcatattttacaaagcagtcggtatatcacttgtatcatgttattcggggattcacactacatatgccatatattaatatcaagtcacttggttgactataattatcgaaaaccactcagttggttggattatttactccttaaatatatgttcagtttgttcaactaaccacatagtcgggggctacacctattaggtgcatctaatcgatgcacctaagattacatttaattatttctcagccctccacagtcttcagatttggtaaaagtacttgggagatcttggcggagatgattgaagcactcggctttggagtaatctagtttgagagaagattatcttttcaacagtaaaggtctcaggggtactgtggagattatgggtaccccatacacatacggcatggttatccgactggttataggagataacttatatctatgaaatatgtaacggatcatgacttgggtattatgttttcttgtatattatggaatggcctaaagtcctggtttgataatattgtaaagtagatttaggaaaccgataccgtattggttaaggtttctatcttgtaatcttgccccccatcttatataaggtggacaggaggccctctagagtgcatg

SEQ ID NO: 51489 - DNA, 928 bp, Oryza sativa
attttttaaccaagcggaagctgccatacttttcaagcgaggagttttcagcttctcctccagagttttatagattaggcgtgcctaatcctccatgaagagcctttttctcccagtgcaaaaaaattgtccggtattttcgccctcataaacagggttgtccttgaagcttcatttggcctttccagttcccgggcccagtgcccttatggatctagatcgaaacacgttgcttttcgcttaattcttgtccccccttttctataggtcactcaggttaaacatcttttgctaaatgcaaagagtttctattaagatatattgtgcatctggagtccatccactcgcactcttgctattttttgtcaagtatggagcttattagagcaagtaccctaaatgcatatgatgcatagatccacgttggtgtgtgtgtgtatatatatatatatatatatatatatatatatatatatatatatatatatatatatatatatatatatatatgtttgtactggtgcagttgtgtagtgtgtccgaaatcgcccttcagactttagaccctgtttagaggggactaaaactttttaaattcctatctcatcggatgtttgggcactaattataaatattaaacgtagactattaataaaacccatctataatattagactaattcgcaagacgaatctattgagcctaattaatttattattagtctatgtgatgctacagtaaacattctctaattatggattaactaggattaaaaaatttgtctcgcgaattagttttcatttatataattagttttgtaagtagtctatatttaatactttaaattagtgtctaaatatagggactaaagttaagtccttggatccaaacaccacctaaatcctgaactcactctttctaccatagc

SEQ ID NO: 51490 - DNA, 216 bp, Oryza sativa
cattagttgttgctcgccagaccacactcctgcccgcgtatatatcaaataatattggggtttgggtaaacccatgaacctgcccaacaatttctgtactatctcttgagctttaagcctccaccacatagcataaactaaagctatatatgaatgtgagaaattaacttttagattaactattcataaagagagaaatcagaagatgaacagcca

SEQ ID NO: 51491 - DNA, 166 bp, Oryza sativa
aaattggggtcttgttcctggatggatgctagaaaattgggatcttattcctctatttcttgtttcatttctttctttcatcgagaaaagctcccaactaagctactgctgcctccacacgtgagcgtggctcgtgctgctagctgttgctgatttccgtcccagt

SEQ ID NO: 51492 - DNA, 430 bp, Oryza sativa
agtctatgcttttcctatgtgcatctatgtttcgctctttttccccgttcgacgcctgatgtggtgacacttcttgttttcgtagtgttgactcttgctcaggccgacaccgaagcccgaaagttgatcggcgacgtgtcggtcgctgagttcagccagctgctatcgcggcaggcggcaagacgggcaaaccggtgtaggatcgagatgtcaactagaaggggggtgaataggcgatataaaactaaatgacacctaatcaaaactaacctaagttgctaggcacgtgaggatcaactctaagcaactaagttatgttttgcaaacgtagggtgatagtggctcaaatatatctctaggaaagtaaatcacactcctatgtcaatgtttagcaatcatagggtgatatgatctcaagtatctctctaga

SEQ ID NO: 51493 - DNA, 1501 bp, Oryza sativa
tgacttaaacattgtcctaaatgactttctttacgagtacggagggagtatacggagggagtatgcattgacgggaatgccgctcacgcccatatacctgctgagtacgaagctctaaaagtctctgtgtgtgccgaattgtcaattaaattcacagtcacgtaacgttggtccgactaatcgtgtccatatacgtacgtaacacaagatcagcattaacaatcctcgccgaattaacgtctcgactctggagtacgtagcgacacgatccccgtccatcgtccacacacaagacgcccgggcgcagtgaaatggtgatgtgttgctgctgatgaattccatggaagacacggcacatacgaaattaattagaggctgcaatatatatattagcggatcgatcagcacacactgagcagtgaaattaattaggtcgacttgcccaacgagacaaatataatccagaaacacccggtagctttgctagaatctacataaccttgccgagtagctagcgctccccacggaggtctcggagacggcaaaatccaacgaatcgcatatccggcgcatatgatatggcttgcccactacttacaggtatcgttttctttgtctattttcacttgtacaggcaacattttagagaacaaacacaaacgcacaaacatttactactaggtcatattaagaatgttgtcttgtccaattagcagtataccctcgccatatttatacccggcctagaaatattctgactaggagctgctcgagcctgcttctcatgcagtcctgcctctgaccctagtaccaaatctcaatttctatcctcatatagtttttttgcagattgatgcatgctttcaactcaatttacttgcaattagggagagaatatataagaagatgaccaacttaggacattcataggattttatggttgactaaaatttggatatctgatgtgggagtggatccacatttccaaatgaacttcttgcgatgaatatgttcagaactatagtgttgatgggtcgttaacatatagacacggtaatcgaaagatgaaactaccttttgtaattgcaattttatcttcttgttatgaaatttacttagtattaactttgtttttttatcaacatatttaatatatgattatgtaaatatcttttcctataggcttgaaaggagtaaacccaattttaaaatgtattttacttctatgtcatagtgtgattagttttatgtcttacttttagtcctgcctattgtgatctggggtagacaagcttggatatcggataaatcctgggtctgccacagtttgttatcctgaggtggcctaaaccattttagcaggcgtttacttttttttttcccttttggtcgattgtggaaaagaaagccaaaattctacgaaaatcatttttgtagtagtgatctttttctcagaaaatagtatgtaccactgcttcttgtgttaattacggccttgcag

SEQ ID NO: 51494 - DNA, 520 bp, Oryza sativa
cattgagctcgggctttgtttttcattttcacaggtaggctctcgggcttagtcgtcgtcgttggcggcggcggcgggggtggggggctaggctggggcacgtggagacggtcggcgggtccaaaaaacaagggagaaaaaaagggagaaaaaattccatgtcatcgtccatgtggcgtgccacgtagacaagctcacggtcaaacgcggttttggaccgggatgataccataaaccaagtttagggacctcgacgtgcactttggaagttcgtggacttaagtgaaacctcccgacaagtttaaggaccgctggtgtattttactctttgaagtataatgctagagagcatgtaaaaaagctaatacatcttatatattagaatggagggagtatatatgtatgtggctggaatatttcccctttatgatctatgcattatgtggcaaatgtcattataattgattgttagttttgattcccagccaagggtatgtcatacttcttctgtccttaacaa

SEQ ID NO: 51495 - DNA, 982 bp, Oryza sativa
cattgagctcgggctttgtttttcattttcacaggtaggctctcgggcttagtcgtcgtcgttggcggcggcggcgggggtggggggctaggctggggcacgtggagacggtcggcgggtccaaaaaacaagggagaaaaaaagggagaaaaaattccatgtcatcgtccatgtggcgtgccacgtagacaagctcacggtcaaacgcggttttggaccgggatgataccataaaccaagtttagggacctcgacgtgcactttggaagttcgtggacttaagtgaaacctcccgacaagtttaaggaccgctggtgtattttactctttgaagtataatgctagagagcatgtaaaaaagctaatacatcttatatattagaatggagggagtatatatgtatgtggctggaatatttcccctttatgatctatgcattatgtggcaaatgtcattataattgattgttagttttgattcccagccaagggtatgtcatacttcttctgtccttaacaatacacaggctcttaacatggtctgctgctgggtggaagatccaaattcagattcattcaagcggcatcttgcaaggatacctgatttcctgtggctttcagaagatggcatgaaggcacaggttattattaacttttgcatcttttatgcataattaagggactaattccgtgtggaagtgaggctaacatgatcaatctgtttcctgctggtactactctaagttggaaaaatatgtttcatctagaaaaattaaattgtcctataatcctattactccctctagtaaataataattgacattgggagtactaatcctaatactgccaatgtcaaatattttagcggctaaagtacaatctagtgttgttatctatctatctatctattatatactaaaagaaaaagtacgaattacccccccgaactatcacggtcgtccgaattacccccctaaccaca

SEQ ID NO: 51496 - DNA, 1501 bp, Oryza sativa
acagatcaagaaaatcacgatgacaacagatcagtggcactagtcattgctgtagtcggcaagtggtgtttggcggtggtgctaggttccgctggagatacgaagaagcctagaaggtcagggtcgtggcggtgtgcgcgttttgcgtcgaagccgagccggcggcggagatcagggtgatgccgagaaggagcgggctgagccaggacgtgcaaggtttggtgtttcgtgatgcagaggaagacttggccatggagttatctatgtgtcggtcacggcatggacacgaccgaagacaagctggatggataccacgttcgacacaggagggagtttgatacggattcgatttggactggaaatcggacacgttgttttcccaataaaagcaccacgggattgcaacaaagtaatcgaaacaaaccacaaggcaagggcgagatcttacctccgatttcgtgggcagcgtggtttggggcggcgagttcacgggcggctagaggcatcattgcaggcggcgtggtactcggcggcgtccgtcggagctcgagcaggggcttgcggcggcggttaccggcgtggaaccggcgccggactttggcgacgcggcggctctagggctggataacgagccagctcgtctcgttaaggctcggctcgtttgagctcgttatcttaacgagccagctcggctcggctcgttaatgttaatgagctataaggctagctcggctcggctcgcgagctggctcgttaagctcgttaggctcgttaacgagctatatcttattaatatcgtattaataatttcaattttaacattttattatatattaacataataataaacactaactaatataatacttactgaatatgaatagttttgatgtaactaaaagactaagcactagtcaataaatactaagttcatgaaaatttagtgatattttatactaacgagctaaacgagcagctcgcgagctagctcgttaagctcacgagctaaaaggctagctcgactcgactcattaagactacgagttcgagtcgatccgagccgagcttgctacgagccgatccgagccacgaatttcgagctttttgtccacccttaggcggctcctcacggggtcggcgcaggtgacggcggcaggaggcggcgacgccctaggcggtttctgaggcaggaggcggtgtttcttgcggggccggtggcgcagagcggcggcatgaggagcaggaggtggcggcgcatcgggagaaggggagcgagagagggccgaaggaaggagagaaatcgatctgattcctttgaccgctcggtttgactggttttttcaaccaaaaataaaaccgaaccggtttttttggagaaaaaaggggttggttttgtccggctggtgactgtgcaagtttagtcagtgggtcaattaaatcagggtagatcaatttaatcagggcgacagctgatcaagttgattatcgttgatggcggcga

SEQ ID NO: 51497 - DNA, 1501 bp, Oryza sativa
tatgttggtgatggtaatagtgttgatggatggtttgtcactaaagattgctgtttggagatgttgagatagtgagaagattaaatgatcaataggctcagatgcccctaaagcagggagatatgccacatgttgatgcacagtattaaacaagaacatggtgaacaaaactattatatttatagcaactcatgaatcgtgtattggccctgcaagcaattggctatgtagaccccatttgaggactatggcaataccaaaaaagaggttccaccgggatttgaacccaggttgccagattcaaagtctggagtgctaaccactacactatggaaccagatgttgtatttggtccctttctgatgacatttctatcttatattccaaaaaaggtaaaggcaggaaatttgtctatgtccttttttatcttttctttttttgtttgtttccatcagtttggtgtcagtgaaattgttctcctctttgagaaccattcatccatttggcatacacgtagactgacatttcttaagaagttctattcatttaaatctttttgtagaactttttggcacttcgtagaattactaaatgcgacttctgatggtacatgcactccaacagataatattcacccctgatttctgtaataatcatcttacagatgcttcaaagttaaatcttcggagaagtttcattgcactaattaacagagtgattatatcatatgtgaatgcaacgaatagtcaaatctaatgctatgaattaaactttggatttaatcttaggtttaagtaattgtgaacttggcgcagcctaattagagaacacatgctcacaaaatactgtgggcatgccctatgcagtggctactttaaaattcgatggatattttattttatatatacaactcaagggttgtacctagcaatatagattacttctaattataacgtgatatactattatcttggaaatttaactgatgtctcacagaatgctctgtgacaaattgtgttttttcttctggttgtaggtgagataaggccacagatccagctatcactatgtccacaaacatgtgcgaatccccagttgtttactgcacaaattcaccccaacaaaaccatgtttaaccttgtcaggtaactgcttacctgaccatcttgcacgtgcaaattttaagattaaattaaaaattataatgtggtttattttagttctttgttagcaagaaaaaagcatgtcatctaactgtcaccattgcttagttatctattgacaatttagtgccctgatatttacactacctgttccagctcttgctattatgttcactgaaaatactgtcaactccatcctgaaattccgtccttcttttcattgtatcagaatctgctttcatataaaaaaagttcaaagcctcctctggcctttaaacagtagacattgaaaaacacacaaggaccaaaacccaccaccacttttgtttgtctttagg

SEQ ID NO: 51498 - DNA, 1501 bp, Oryza sativa
tcagatcgtaaccataattcaattaacaatcattggggtaccattcaagagtaagttcacaagttctatgggtattatgagcaaattcttaatagaccttaaagtagaataacggttcaagattatgtaatcatttaattgagttagcgtctagctttcttaaagaatattgtttttaagattatgtgaattaagagaagtggcacacaaaacgggaccaaccaaaatatgtagattaattgcataccttcattggaataagactgggttgtacgtaggatgctccgagatgtagttgtggtgcagcctatcatatggcccgctcgacgatcacgacgaacaacctgactaccaggaacagcaaaaccatgtcgtggagcattcgaatgctcatattcatcttgtgtaactattgctgctgcagcgatgagttcatcgtcagatgacgatgactcatccaacagaagatgtcttaaaattaaaatgaagctcattgattgatggaagaaggattcacaacaatgtgaatggagaaaaagacagcaagcaatgtagcggtatatgtagggctgaaattttacatgttgcatggtcgttggacacaattttaatgagctagccgttggaaagctagctgttgaacacatcaaattgaaataaaaatatttcattcattgcaaatatatcaattaaaaaactactaattaaaaatatatctgttaaaatttacttattttgaaatattaacgcaataaataacaccattaaaaatttagtcgttcaaaatatagtccttacaaaataatataaatgtatggttagttgaaagatattactgaaatatagaagggtgtgatatggatgatctgtttaataagtgaaaatggatacgaaggagtaatccttttaaacggccatctatttgtgcatatggatgatcaaatttggatgaactgttggggtgctctaatacatatccgggaccgttggacacaaccacctcaatacttgctataattaataccggtagtccaatcactagatatattgtgtctttttattagtgtcacgtctgaaattcacaatcactaggactacatgtctgggaccgttggacacaaccacctcaatatatagtagtacgaagtatttgctagtaattaataccgatagtccaactgctagagatagagatattagtgtacaccacgctgacatgtcaacgtgttgtgccacgttagttaaagtggcagaaaaaaatttaagaaatagtcttatctctcccgtctgctaaatatgtaacaacaaatccaaaagtgttatttgaagagtggcacagtttggtattgtaataaatactgtagttaagccccccacagtagctctaataaaaaggcagccagtatatatactggatatagctggtcgtcgtctttgcattgtctccttgtccggtacgttggttggctctagcttagctggtgctcgatcgcgaacatca

SEQ ID NO: 51499 - DNA, 1035 bp, Oryza sativa
tgtctgtccgtatttgtctagcggagtctttttgtttatctgcggaaactacaaaacaaccatttttgtcggtccttcctttgtttcatctgtatgaaatttgacttatgaagcatagcatattatggtattgcctatgaataaaatgtgccccgataatagtgtgtttgaaaaaaagcataactataatataatgtcattaaccaaagtctgtgattcagagaacaatactactatacatactgctatcatcctttggttgaaggatgaattgtatcaaatattgtcgtagtgttagcacgggcatattactagtgttactaattagataacatattattacgaatatagattaaatatggcaaaatataactgaagtagctaacatattattccagatgtagatgaggttgtgtctagttgtagtattaagttgctacatttttggacgaatttattatattttgggatgaagtgggatggagagtacaccaccgtccccaaataacttaagttctatgaacttggacaaacaattatatacattcgaagcaaggattggttttttgatgtagaagtaaaagtttgtggttggatcaaacatctagggccgggaactgtcctgcccctctcctctcaccgctgcatcagcattttggggcacataaatgagaggattggacttgtgaatgcctcagcatttccaaatgcaatccttttcgagccatcgtggctctcgaaaatactgatcctccgaggaaaagatttgaataatccagaaaccagtttgcacctcaccaacttgcatcaacttgcatgatgatagtgctgaatcttcattcatcagagtgtggctcggatctttctgtattgatgttagattgcaaattgtaaatatattactgaattcaagttaatagaagctattgggatcgtgtaggctacgatagcataaatcaaaattttctatcacgtaaaccaggaaccatgcaagtattagatcatagatcgttaccactcgacgcgctgtgcagt

SEQ ID NO: 51500 - DNA, 286 bp, Oryza sativa
caacttcgggaacaatttgtagcagcagcagcaccaggctgggccacgacctaccggcccatgggtctgtttcaatccatgggctgtgcagcagcagcagtctccctggcgtcccagcaacagtgccggcctcctgggcccatatcctcaagcacacacgacatttgcaggcccatatgtctctccaccaatgccgggcttgccaccaatacagcaatctcagcccaattgggatcaggcaggtctgattgctgccctcaatcagttgtccgtgcaaagtccaagt

SEQ ID NO: 51501 - DNA, 1501 bp, Oryza sativa
gtttcatgtgtaggccacacaattttggagtcgcagacacgtgcacttctttcatttgagatttatagaaaatgagatttagctactcaggacaatctgtttttcacaattacatgaaaaacagacaggcgcatacaccaccacacacgcaccaccgcctcaatatcctcagatatgttcttgtcacctttgacaagaggttctgctcttcccttaaatcacatgcaagtgtttgcaatcgtaatgcagtgtgaagttcgtttacttcagaaatgtaaagaaaatttcttgcctgatatgttcccattattttcatcaagatgatgcaactaaggaaacactgaatctgaatggtgcggactgcaaagacttacatttagtagacagcaaaacttactaccagagtgcctatagaagcttcagaaggaaataataatgtttcctacagctgggtatgattgcgatgtcactgataatgaagttgaagttgagtcacccgactgatcacatctcacactgatcaatcttgctcttgaccagctggaaagctggattcacccaggctccgcagctgcactgcattcctgcccagtggaattgtcccaatcggctgttgcatttcctgcacgcgatcttccctgaaatatatccttccaccactgcaatgcataatacattttattagaagaaaatatatcagacgcacaacaccaaactagcagaaaatacgtttgtgagcagagtggttcattattagtcctaaaataatttgtgcgtgttctgagcgacttaaaaaccaatgttgataaataaactatgatgaagaaaaaacattaaaattaactctaaaatatatcagacacacacaacaccaaaaaagaaagaaaaaaaaacattacagcatccaaggtaggtaactaaccaggttgcatccacttcaagggctccacaaagaggcaggtacattcgggttccttctcatccacatgatactttttgcgcgtcgcgaagcacttctcaccacgaccaactttgtgggtaacaacatagccttcagtagcgacgagtgtgcgacatcttttgcagcggtaagtagtgcctggatcagtggtttctaggtcaccataagttaccccatctgtgtactggtttgtttctgcagggtttggattagccactggacttgtctccagctcagtttgtactgctggtttaatatcagtttccgcgactttgtcctggcttatttccgcaggcttttgatcctccatggatcctggcatctcatcaacctctggttctgactttttctgttcaactcccaattctagcgcctggatggtttccatctcctggttgatttgctcacccctgcattagtaacagttaagacacaagtggtgtttctacagtgcttggtaatgtgcaaacataaataaagtccaagctttgcaatgttgctgttgagatattcatttatgtgcaaacataaatagtgact

SEQ ID NO: 51502 - DNA, 1501 bp, Oryza sativa
taaaattcaattaactatatagtgctacttatagaataggaataggaatgattgaatgcccatactggttgttgtggggcaacatgttgtgcatgcaactctgcatcctgccttgcaagcatggctcgctcagccttcctcttttgcttgctcaggttcttcttgtagttggccacaaatctatcaagttcccaaagtgtctcagtatccatgctatctatttcaacctcaatctcatcatcatgctgtctaacagacagattcttgttcttaatgatctgcacaacaacatcaagcttctccggtggcaaattctgaaggttgttactaagcttccgcttctcatctattgtcatatctctcttatccggatccttggcctttggtttcttcatcgatggagtcctggcactataagtgggagtatgacttaatggccttgacttggagtccaacaccatatggtgttttacagaatctgaccgatcaaggaagcgcacgtcaattggtggaggtggaaacttatttggcaatggcggacatgaggcaaggtactgaacctcagcctcaatttcgggccactgcgcctcaaagattcccaacaactgctcagccatgaaatgcacatcctgccccttgggattataggtcatggcattatggaacgtcagccgtacatcatcagcaaactccctcgggttcctgtactggccatgcgtgagtcgggtctttatcgtgccaagatccattgggtgcttgataatagcaaaataatcatgcaaaccaagcgcaacagcatctacaggcttgttaaacacccaaccaaatttgtgcttcattagcctagaaagcagcgacatagatttcttaaaagcatgagagtatagcctctgctcagcatcataaccagcaccatgagatgctaaggaacgatgcttcttcttgtggtgcttgggtttcttacgaccatgtgaatctgaaggcggaaacttatccttggcaagcaagaactctgaattttgatacaactgattcgcctttggtgtccgcttctccttctcgaaggactctgtgtgagtcactgacacggttagtggcccgcgctgcatcactgagcggaccggaacaatagcaccagcaacttgaccaggtatgggcgtcacaggatcagcgagtgcgaactgcgagtgcgcatacccaacaggaagctgaggcggcggcaccaccacaggcaaagcaagggccgctgcagactcagccgcgatggcctcagcggccgccttcagccgcttggaaagcccacgcacctggtcgagctccgacgcaagctgccgccgcagctcgctccgcgccctccgcttccgcgccttctcctcggcggccgcccggacgtctccatggccgttgggaacggccccgccgtcccgattaggccccgcggagacgtcgtcggaagcgggcgcggcgggctccccctgctgcgcgggggcaaccggggcgc

SEQ ID NO: 51503 - DNA, 1501 bp, Oryza sativa
ttaaagtagaggtagtgggagaatcgctagaccactggtcgaggaccaggtagtagtcgtaactcgaccacttgaagttaaggcgcgaaagattgctacgatttactggtttgagaacccgcgggtagaattatctctcgaacgccaaaggaagctgcggtgcgagagattgctatgatttactggttcgagaaccagcgagcgagtagacttatctctcgaacaccaacggaagctgcggtgcgagagattgctaccttttactggttcgagaaccagcgagcgagtagacttatctttcaaacactaatggaagctacggtgcgagagattgctacggtttactggttcgagaaccagcgagcgggtagaattatctcttgaacaccaatggaagctgcggtgcgagagattgctacggtttacaggttcgagaaccagcgagcgagtagaattatctctcgaacgccaatggaagctgtggtgcgagagattgctacggtttactggttcgagaaccagcgagcgagtagaattatctctcaaacaccaatggaggtgctagagttggtttattacatgtgcatctcatgtggccagcatgactcacatacccaacttatagcatatctggatgtccgttcgcaatcatgtcgggtgatcaagccgatgacgttcgtgaggaattatccgttaacaaccttttctcgaatagtccagccatggccggtgctatgagataggtcgtcggtctttgttggcaggttgggcgtgacgactctgtatttgtcgagatcgttctcgataatggggtgtactcgaccacaacctactcgagtgctcaattgttcctgaaaaatattttctagaaggcaagacatatagcagataatatcgagtatgtactcaaaaaaaatgcatggatcttctagtattatcaggatataacgagcagattaaatatcaagcattatgtaaaccgtaaacaagcatgatttatacagaagaaaatagagcgagcccccagcattaaaccgtagtcggtttaacatcaggaacactcgcacaacagatattgtataaaaaacatgctctaggtaaacataaaaaattattgatctgacaatgttgtacaatctagaaataggcatgacaaattgcatataaaatattgcgtacctttgtagatacatgccggatgtatctacgaaattagtagattaatttaaaaaatcaatctcctaattatcttgttgcgtactcgttcgatatcatgtgatctgacatcttttggtacgccgcggagcttgaggcttgaatgatctcgataggccaagttgttgacgacgatggttccgatcttgtcgaggcacgtactctggtcaagttagatcctccatagccgaagttatcgagtagtatgctgtcagagaatccatctcttaaacccatctcgtcgaaaccttgaagcaccaaaagatcccttacctggcgcgccact

SEQ ID NO: 51504 - DNA, 582 bp, Oryza sativa
tgtcaaggtacaccaatatataagccgtttgccttgttgatccaatggctaaggttgtgtttgggaggaggggaaataagaacattgagaagatacgcacaacaaggtgagctattagcgcatgattaattgagtattaattatttcaaacttgaaaaatatattagtatgatttctaaagcaacttttctattgaaacttttatagaaaatgtatcgtttagcagtttcagaaacatgtgcatgtaaaacgaaatatgattaatgtatatgtaatatgttcagttgtttcaaaataaaagtgacaaattagtgtgtatgattttctcatgcgatgcactagtattggtattgctaatgcccttacaaataaggttttgcaagcagcacttcaccccggagtatgctggtgtatcatatttatcccaaggataaactactacctctaattatatgtattttcatattaatccattagagttcaccctttcctcttttacatatattctagttgatgtgactagtaggaattaaaccctaaaccctaaaccctgacatgcttgggaccctaagcacccaactc

SEQ ID NO: 51505 - DNA, 1501 bp, Oryza sativa
tggcatagtagggtttcatttgcaaaagcagcatttagcaaatattttagaatttaaaaaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcacgaaagacattgttcgacccgcccataaccgcgggcatggctattcgaatagttttactctgatcagaggtgtaccactgtacccacaagacacaaccccacatcatgtcaccatgtgcctcaataccaccacggtatctcggaaaggagttgtgacaataccccttgcataacacaatccactgcagtgcaccttcctggatcataatcacccccttaaaaacaaggcatggactccccagcgacccccgtgggcttatctccgccacttctcagtctggtgccccgcaatgaaccatgctatacaaaagataaagtcgttgcccacgctggcttgtggctggcacggttaatgtttcacaactgaaactcgtgaaccggtccttaattgtcatgagcacgactctcaaaaccatgtgctcacaacccaccattatcaggttttagttggcacattaattaattaactaatcacgattgaccatcgtgaactatcattaagccatcattaaataatagtgagtcataagtaatcccaatagtgagctaatgtttctaagcagggctaagcaattatatctaatatctagttgaaccaatatacataaagctcaactagtcaaattataataacccaaggtatcaaggaataaagtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaaacgaaaagaagcaaaaacaccaaaacagcacataaacaagcatgaacagtatatgtggatatttttaacatgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagaaggattattgcgtcagcgggctagggtttcggtggaccgggcgcacggcggcggttcacgcgaacggacggccgagatcaatccatccaaaacggacggccgagatcgatcggtccacgaccggctcacgggagagggcgacga

SEQ ID NO: 51506 - DNA, 1501 bp, Oryza sativa
agtgctccaccttctcacctatcatctcagtcgtcttgccaagtgaaattggattcttccttagctgtcacatcataaactcctcgaagaccatgttcaactccatcttccgtctttgatttgattcgatctaatccatggccagataacccacgtcatcaccaaataaataaatcaaactcaccagacttgaagagaaccctttcttccttgtcgacttatgaaccgagctaataaatccaacatccacgcttttccgcatccgtagactgagctccatgataaattgagaaaatttaccgtttccttgaatcacttgaagaattaccacgatagccttcgctcttcctcttcagtgacgcagatttccatatatccccatcatgccgacctgcatatcctggatatatcctgtactgccaaacagtattgtcgaccccatcaacgatatttgacccgctgttgcccgggacttttcttcagttctggcttaactccatatatctcaactcctcgtcgaatcctagatatatcttgtttccgccagatatttttatatgcgacctgaccagcctgtcgccaccagtctactcgtccttcacacttgcaaactatccatctgtagaaccttcttgtccttcttttggatctgttaacaagttcctgtaacgaaccacacgtccgttgaacccggtctaaccgtccaaactctgcagtctaactggtccgtcgatctgatcaccctgctggcccgacttaaccgatttacacgcacctctcttgcacgcttcaaccaagccttctgtctcgatgaccaacactatgattttagcctgcatgccaacgttgagtgcccttgcggtcgtgcgctgtctcgtttcctttgatccttcgacgtccaaagtccgaattgaatatatatgcagccgacttctccctcatcacctcggatcgtgtactacgatgaagagtctgttacaaactccctctccaaacagcacccaactcaagtgtggagattatgcataccccatacctacacggcatgtatagtccgactgggtatggggtgccatgtatggatagaatatctttaagaggactcgggttaagtaccaaacttgtatgtcaaggaaacacccaggatcctagtcggttacgattgtattttatctgtaattacctattccgttagggatatggtctgtactttgtaatacggacctcttcccctatataaggaggggttcgggtgcctttagggacacgatttttctcccagatcatacgatcaataatacactcggcggatcaatccccagacaggagtagggtattacttcttggttaagaaggcctgaacctgtataaaattccttgtctctgaacccatccacttttccagcttgatagccatccccttttagtattgccgaaatcttgtttcgatagttggcgcaccaggtaggggtagcatcaagttcttcgccgactagtgcga

SEQ ID NO: 51507 - DNA, 1501 bp, Oryza sativa
taaattccaatataaaatgggaccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccaagttggcccagtccgccgccgcgcgcgcgcgcgtccgcccgctgacaggtggggcccacctgtcaggcccgtcgtctacctccggccgccgccgcccgaaaccctagtttcgcgccgccgccgttcccttccaaatccggccgttcctttccttctccggccgaatcaaaagaggggaaatgatctccgggatctcctctaccttttctcttttggaatcatcggccaaatcggcttggaaagtgtttgattcgaggtcgaatcggatcggcttttctctctccgagcccgacctttccttctcgtcgccggtcgtcgtgggccttcgccgccgcctccgagcccctttaaaagcttccccggtgtctcctctacccgccgccaccctcgccttcgcctttcgtcgccggaagagccctagcgccgtgtgccctagcgccgccgtcgccgccgtcgctccagccgtgcgccgccgccgttccaaacgtcgccgtcgctcgggaagaccgccgtcgtggtcgccaagtcaccgccgtcctcgtccgccccttcgccgtcgccgaagatcaccggagcaccgtcgccgccgtcgacccgatctccgccgccgtttcaatctcgtcgccgtcgccgtccgttcctcttccgccgtcgctttggtcaccggtgagttcgccgcgtcgcgctctacccgatggtgccttccgttcgcgccgccgtgccgtcgttcgccggcgagcatgcaagcccgagccgcccgagccgccgccgccggtgatgacgtcaccgctgacgtcatcgtcgccctctcccgtgagccggtcgtggaccgatcgatctcggccgtccgttttggatggattgatctcggccgtccgttcgcgtgaaccgccgccgtgcgcccggtccaccgaaaccctagcccgctgacgcaataatccttcttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatatactgttcatgcttgtttatgtgctgttttggtgtttttgcttcttttcgtttagattccgtcgtttccggagagtccgttttcgccggagaagagtttgaagagttccaaggccagcaaggcaagtcacacagatcccaaacaaccctttgagcatgtt

SEQ ID NO: 51508 - DNA, 1501 bp, Oryza sativa
ttcatggcagccacgaaaactacttgttggtgggtgtcgacggtttccaggaggtgtggcaacaaagggagaggaagaggagtgaggcggcactccagaccgtcgcttccctagctgacgtgcggtggggattgtgtggtagagccatgggagtactgctgcacacaatcgcatgggagccatgggagaatcaaagggatgacgtggcttaacaatcgctcaggaaattgctaataactacactaagtggggatcacttgtatagtattataggattacccctctaacaatgtattagtaatggttttagtcctcggtgtcatacacttatatgtggtttaacaattggcattctaatagcttggtgggctgcacccatcatcctctaccaacactatatttgaaggcaacggggctcgggaggctctgttgaggctgcggaggcgcttagcaaaagtggcgaagatgttgaggtggcatcatgcctgaggggctgaaaggggtagaatccgagctccgtcaagggatgtaggtggaggcggaatggtcgatgtgttggtccgtggtgtggcagaggagcacaggtcaccgctgctaaagactactcgccgagcttcgtcaaggtccacggatttgatgggatcttgctctcctccctgaccttctcgcttcttcctcttctccccaagctcatatgctcacacttccatcctccccaagatcggcagttgccatgcaactcctccttgacctttgatgcgaggaggttgtagagtctgacaaagtggatgcagagctcgaggtccacaggaccgtgcgcctcgcatctcctccatgtcctactcatcaaccgcatcatccgccattgtctcgttgatctcgagcactgcctatgcctctagttccacttctgcctttgctaagctccacatctgccactgctgcctcatcgaggtcaagctccacgctcgccgccgccgtgcctccccaagcaccaccaccactaccgcaagttactctccttcttgagggtcatagccgacggatggcctcccgagtgtcatcgctgccgcaagttccgctcctccttgagtgttgccgctccccgagagcttcctcctcaagttttctctcctccgctgctcgagctcggcgctctccatctcctcttgcctcgcccctagatcaagccagcaaagtgatgaggaaaaaaatggaggtcaatgacaagtgggctgtaccaatatcttaccacatcattcgccatattggagtgccagatgggacaagtgggaccgaaaccaccttaaaacaggaggatggggataatgtgtccggattaaataattgaatggtgtaatttctcttgatgagctggtacatcacaacactaaactcatatgatgatcagtgcagcatagaaacctatagagcatgcccagagaatcccaaaatgaaatccaatatgtcggtgatatggtaacaagggttccccgtattg

SEQ ID NO: 51509 - DNA, 1501 bp, Oryza sativa
agtcaacggtgtcaaatatttagaaacagagggaatatttatttatttcattaagaatatagtcattggaaaaaggtgctacggttatacagttccagtacctgcagcttaaagggatgttgcggaccaggagactgccagaaccctgttccttccgtcctccatatcccctcctagggggacttcttcctctgccaccatatcccctccttggtggactgcgataaggtggactatacctcctcattgttttgtctgcaattacacgtaaatacaggaacattagcgataagaagacaaatgcaaccaaagaataactgccaaacttgtcagcacagatatagttttttgttaagaataatatactacagcgtaatttaaaagtatagggaacaaaaaaacccataggtaacttcaagtacatggaaagaagtcttcaaacacaagcatggcatcatgttaaaaaggatttaagattaaaaactaccaaatcaaaattggcatagcccaatgaatcatgcaccttgcaagttcatgcgctattcacatcagtcaacaaatctgagttgtaaacactgttccaaaaattttgaattgcagctcaaatttcgaactatgactttcctttatcctttggatctaaggatacgataatggtatagaacacagtaacaaacaaatgaatacatcgatataacaccaagatccagcatattaagttgatctagaaaatagcaattactcccaaccacccacgtatccagctccaaccaagaatttactgcatatatgactaattcacgacaactctgaagcaacaaccctagccttcaaccccgacatggcaggaggggatctgagattcagaaaccttgcagctacggggtaaaaacaaatagaacattccctatctcgttaaaccgctcgtcaaggcatctccagcaagcgaaaccgccgaatcccgcgcggatctaagcggtgacgggcgagctcgctgacacgccgcaggcggacctagggttttctgtggcggcagacaccgcacgcacgagcgcagaagaacacgcatacgaggtacggagaaggagggggggaggagccagggttaccgggtgagtacgcttgccgccggcgaggctccgtcgctgccgctgccgctgccgccgccgccgacgcgggggtggggagggtaggcgagttggcgagggagaaagcgaggcgaccgcgaggcgagagggagagcgcgtctcccatagataagagaggaggtgggtgggctcttttgggcctgggctttaatgggccgtacgacgttcactgtttcggcttttcaggcccaataagctgctaagggctaacgcgtccacccggccataccgaacagctctcggccctcgggcctaggaagaacatttttctatctttttattcttggctaaataaccaaccagctgatgaatataccgtgcattgaaaaaaaaaagctgctatataccggaat

SEQ ID NO: 51510 - DNA, 1385 bp, Oryza sativa
tcatgatgcgcgtttgatcagttttatatttctatggaatatcgtcttgttatatttgtggtatttaaaaaaattatgtaagttggttacccatatctaaaatcctcgatattccactagacttcattccattttccctatgatttaggatgtgttcgttccacctcgttgggaacatatctcttgcgcacgtaaaacggaaacggagcagtacattagcacgtgattaatttagcattagtttttttttgaaaactagatcagtatgatttgttaaagcaactttcgtatagaattttttttgcaaaaacacaccgtttagctgtttgaaaagcgtgcgcgcgaaaaacgagggagatgagttgagaaagttttggaaagaactcagcttagtctcatttcagttagtagttctttagtttgtaagcccagctcaacagaaagtaattagaatgtttagtctttcagggactagttgatttagaatttttcagccaatcgtagttggttattttgcacgcagattaagggagactataagcccagaaaagctgatgaagtttgcagcgcaaaacctctgccccagctcttcttgttctgctttcatctttcgtcaggtactgtagctgttcgacaacattcacaacagagctatggtagaaagagtgagttcaggatttaggtggtgtttggatccagggacttaactttagtccctatatttagacactaatttaaagtattaaatatagactacttacaaaactaattatataaatgaaaactaattcgcgagacaaattttttaatcctagttaatccataattagagaatgtttactgtagcatcacatagactaataataaattaattaggctcaatagattcgtcttgcgaattagtctaagattatagatgggttttattaatagtctacgtttaatatttataattagtgcccaaacatccgatgagataggaatttaaaaagttttagtcccctctaaacagggtctaaagtctgaagggcgatttcggacacactacacaactgtaccagtacaaacatatatatatatatatatatatatatatatatatatatatatatatatatatatatatatatatatatatatatatatacacacacacaccaacgtggatctatgcatcatatgcatttagggtacttgctctaataagctccatacatgacaaaaaatagcaatagtgcgactggatggactccagatgcacaatatatcttaatagaaactctttgcatttagcataatagatgtcactgagtgacatctattatgctagtgacatctattatgctaaatgcaaagagtttctattaagatagagagactccaga

SEQ ID NO: 51511 - DNA, 158 bp, Oryza sativa
tttggatgccatccacgctgaaaccggcccacaccagcaaaaccgatgccggcgggaggagtccgagagatggagatggagcaggaccatccactgccttagtccctaaccaatggtgggaatggcagcggcggtggaaaatcgggcgatggggagga

SEQ ID NO: 51512 - DNA, 1501 bp, Oryza sativa
ataggtatcacctgatatctcgcaagtattatcttttacgtgataagaatcacatgatacctaataggtatcacctgatatctcgcaagtatcacattctatgtggtaagaatcgtatgatacctgataggtatcacctgatacgtggtagaacagcatgatatttgataagtatcacctgataccggttaggtattagtctattaggacttgatatctaactggtatcatcctgtttttgaacggattccggtatatagcagcttttttttttcaatgcacggtatattcatcagctggttggttatttagccaagaataaaaagatagaaaaatgttcttcctaggcccgagggccgagagctgttcggtatggccgggtggacgcgttagcccttagcagcttattgggcctgaaaagccgaaacagtgaacgtcgtacggcccattaaagcccaggcccaaaagagcccacccacctcctctcttatctatgggagacgcgctctccctctcgcctcgcggtcgcctcgctttctccctcgccaactcgcctaccctccccacccccgcgtcggcggcggcggcagcggcagcggcagcgacggagcctcgccggcggcaagcgtactcacccggtaaccctggctcctccccccctccttctccgtacctcgtatgcgtgttcttctgcgctcgtgcgtgcggtgtctgccgccacagaaaaccctaggtccgcctgcggcgtgtcagcgagctcgcccgtcaccgcttagatccgcgcgggattcggcggtttcgcttgctggagatgccttgacgagcggtttaacgagatagggaatgttctatttgtttttaccccgtagctgcaaggtttctgaatctcagatcccctcctgccatgtcggggttgaaggctagggttgttgcttcagagttgtcgtgaattagtcatatatgcagtaaattcttggttggagctggatacgtgggtggttgggagtaattgctattttctagatcaacttaatatgctggatcttggtgttatatcgatgtattcatttgtttgttactgtgttctataccattatcgtatccttagatccaaaggataaaggaaagtcatagttcgaaatttgagctgcaattcaaaatttttggaacagtgtttacaactcagatttgttgactgatgtgaatagcgcatgaacttgcaaggtgcatgattcattgggctatgccaattttgatttggtagtttttaatcttaaatcctttttaacatgatgccatgcttgtgtttgaagacttctttccatgtacttgaagttacctatgggtttttttgttccctatacttttaaattacgctgtagtatattattcttaacaaaaaactatatctgtgctgacaagtttggcagttattctttggttgcatttgtcttcttatcgctaatgttcctgtatttacgtgtaattgcagacaaaacaa

SEQ ID NO: 51513 - DNA, 1501 bp, Oryza sativa
ttttcactacatcgtttcaatttcaaccaaactttcaattttaacgtgaactagacaccctaagttactgatctctctccctccgtagaaatgcgaaaaattaactctacgtaaaatacttgtcgatctcggcaccatctccaattagtctctccaacttgcacgcatgatcatcagtctggttcattgagtaaactcacgtatatattctgctgcatgccactagctctatacacatgtagccagctatgtattttccggccgtgctccggctgtgcggcgacatgtcttcgatcgccggcgccgacgtgccacaccgtcgctccataccggccggcccgctggtcccaagctggcatgcagtcggcggccggcgccgttggtcgacatcgataacgattgatcatatgccgccgccgccgccgtcgcccgcggccggccggccggccaccggaaaagatgggtattgagcgtgtacgtgcagtggacattacacgggatgtgtacgcggtacgttgaaggaattaattaatttatggaagactaattttccttttattaaaaaaatagaagaaatacttcttccgtcccgaaataagttaatctaatatggaatgtggtatttcctactattataagtttgaacatatgtgtttgtctaaaatcgttgtattagaaatatcacattccatactagattaattttgttctgacgaaggtagtaggaagaaggaattaattggtaggaagattaatttcctcagacaaatatgaggaagaggaattaatttgtaggaatattacattacgtcgatcgggagagagagagagatcgatttgtcgcggtggatggcgatgggaggaagcggcaggaggcctcaaagtccgggaggtggcctgcgcgggtgcacgtgcgcgcgccgcgcgctcatcagcagctagctgcggcttctatcccggccgggacctgacttccagggatttatgctattttatttatatacactactactgctgctggataattcattatgaattactgctcacaccttgtttggttgttaattactaatacaaaaccagtaaacatatctaagaattataatttttttagtttcaagtactttttttgaaacaaatatgagtataaccatattaattttagaagttgagttgaaattattcgaaggtctattactgtatctatcctaaaatataagatttcactcatgcatatatagttgtatatatggacaaagtctctcatattataatataagtagtcaaagtttaaacatgttaactacatgtatctaaaatgtcacttatttgtcagtggtcgaagcaacttagtttttagagttaattgaaaaagacttcgataactttcgttatgcaagcttggctttcggttttggaccgccgctcatgagtcatgagccgcacaaccgcaaaaatgctttccaagcagctcaaaattatttttctgtaattattaagt

SEQ ID NO: 51514 - DNA, 1501 bp, Oryza sativa
cttagttagaaaccgaatatgatgtgtggcatttgttggaattaagctagcttaatggctaggttaattttgaggtatcttcaaccaactcacgagggttcaaatgctaaatttttttccatgcattttgatgcctatgacaatattcaggcatgtgtagagaatcgatgtgtatgagtgtgtgtagtagctataatacggtgcatttatttacatatttatatgtatccaattgtacttaaaaaatcgatgtggcatttatcattcaacggatgacaaattaaaatgggtttttaattgtcacatgaccccccatttaattcacaagaagtcaaatatcaggtttgaatataatttcagatcgtatcacacgcgcgctaaccgcaatgtttgaaccatcacaagatctctacttgggataagtaaattattatgagtgataaccaatgcaaaagttgaatcctcacttgaaacaataacaaattactagtagcctttaggaatagataatgaacaacatgtagggaatagaagagagaatagaaatggaatatggaataatggaatgcagggcttaattccctgactcccacaaggctggtcaaaggatgatctaaagttgttttagtttatttatgaactatatataaaactttacacatgcatgcgcatggaccatcatatcatatagaacctaacgtcttctcctttcaaggaataaatccaaacctatttggctagctctctgtcagttgtcacgcacaataaaacaaattaagcttcaagaaaatatatactacattgcacgtagcaattaatgatctctagagagggcatatatgcaaaaaaagatcatcactatttgcagatggagacatgtcattgctccttatgaggccatttttgtggccggtgcgtcccctggtccaaagacaacgctcctcctttcctttagtccttccaaaaccggccatgaccaatgcaaacacactgtcactgactgaccatgcacaaatcaaatcattattcacaacagctaatctccatcactctccctacatgccatagtactactttatataaccccatgtcatgtcctttgggtgagcatctcaaatcagatcatctcaagttcccaaaccctagctatctctgctggtctcccccaagctctcctttatataacacaaactacatcatctcctttctcttgtgtgcaacatcacaaacacaacctttcactcccatcttggctttctttcctgtctctagcttagctacctgttgcttccaagctgagaaaaaccaagcaaaagaagctgtttgtgtgcctttccaaggtatagatttgcatgcatatacactttatcctgtccagttagaaacttatataaggacttgtaagtttctttactgaattaaggttaagtaaacttgctaaatgcatgagttttctgatgcattgtgaatttgtgggtatttctcagagtgaaaaaaaaaa

SEQ ID NO: 51515 - DNA, 1501 bp, Oryza sativa
ctccacatccgccatatcatttactccctcgcccccctccacgttttcctcaatcaattcttccttcctactacacctctccgacagttcgtgacagctaatgggtgattctatgagttgactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcacaccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaactctactcctacaaattacctacccttcactacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcagtggttagtttcgaattaagtttttgaaaagggtcaatttgtcaaaaaaacgggaaactaatctcttcttcaggtattcctaccaacaaattctgccactgccactgccacttggttatgaatgtacatccatccaaattatggt

SEQ ID NO: 51516 - DNA, 1501 bp, Oryza sativa
gttttgctgtcaatttatacttcgttagctaaagaggtgcattatgatagatctcattaggtgcaattgctgttggaaatttttagtgtggaccaaccgattattactcaattgagttaaagccagaggtattactctgattaaaaaccagaacaagtgcttgcaacttataatactctagctggataaaaccaagtttctcagaacgaacttctaacaacttacaaataacacgatgattataaattaactcctatcaatttggacacaagcatgcccccactgcattttggcaagaaaaatgcggtcacacttatttgattattctacctatttataatgtcggatataggaattctttcgagcctagatgaaactcgttacaatataccaccataccattttatacaatgatgtaatattttcatctcttatgccagtgaattaggacaatcggccagtattatttaaacttttaagatcgaaaatgtatgacataaataatatactagaaaaaaaaatatgccggtccaatatttcggagataatcataaggatatgatgtacgtgtgtatgtttatagtggtgaatgtgcacgtgttataagcgcatacgtttatactgtgtttctataataaaagtagaaatacgaaaacatgagttcacccaatccagagcttccaacctcatatacaggccgagtttagttccaaaattattatttaaacttctaacttttccatcacatgaaaactttcctatacacataaagcttttccgtcacatcgttctaatttcagccaaacttctaattttagtgtgaactagacccaccattagtcacacactctccactccccaatttgatctaacactgccaaattacccagaccaaaaactttgactccaaacacgctctcttcatctagctcgagtccaacaaaccctgcccgaaatacgcccccaaagtccaaccgtgtagcccactttttcctccatttctcacacatacgtgccgtcgaatcccccacctcctccacaccggacagcctgcccccagcttccttccttccttctcaccttcctcctctcttcgcctcctcccctcttcttccccactcctccccctcccaatcccaaatcgcaattactccccaagccgcgagagagcccgagagtaaactaatcgccatccgccaccgcgcagccgcggcagctagctcgcgagaagaaaacgccacgcgacccgagagcgagagagagagagagctaagccgccgtgcgccacgccaccaccaccaacccatcccaatctctctctctctctctcctcgtgctcctagctacaagaagaaccccctcacccccaccccggacacctacctagccgctacccctctctcttcctcttcttcttcttcttccctcttcttgtggtggtgggtttgacccaagaacggaggagggatagggcgggcggcgatgggggcagttcggggga

SEQ ID NO: 51517 - DNA, 1501 bp, Oryza sativa
tttgcctctgaacccatatgtcatagacacatatggatccacatttcattgagataggggtggcaaatagttaaataccaaatttaaaagtggcaaatagttaaatgccccggaaaatgttagctcgaggtcctcctcttttattttagtttttaaatcgtactttgaacaatattacgcaaatcccattaacttttaaaacatttgtaaatgaggtccatcgacggtattgtttacggttttagctgaggtggctcttttgactaggtcttcgtcccatatgacatttgcatgacgcttacgtggcaattcaattcgataaaaatcgtggagctcatgtgtcagtttaaccaaaaaaaataattaaaaaacatggggccttacgcgggacccacatgtcatctcattctcattttctcttccctttccttcctctcttatgttatcccttccccactcctctctctctctcacacactcctctcaggctggttaatctcagcgcaaagacagtttgtgctgagttcacggtttatttcttgttaaagtttcttttactgtatagtttcacaataagttttttgaaaaggaccatttaaaaaaaaacgggaggggggagagagtaggaacaggggacccgtgggctggtctgtcgggacaagttcgcggcccatgaaatgaaatccggccattaggcccatcccagtcatggtgccctgtcttgcatgccatttgttcgaccgatggaatccagtgtcgcacgctaaatacctcttctgctcttcatccatccgatcactctgaatccaagtgaatctccggattaggatcggccgcgagttattttgctctgtgaaagttgcttggctgcgtatagcactcctcattcatcaacatcgtggtgaagagaaacgaggggctcaaaaatcaaaggcaaattttactacagtacatcgtggctttgcagttttaactgcaggacaccaaagtgactttggggtgaagacactttcaaaagttggatatttgctggtggacactggacccactaaaataataatttttggtttaagaggagggagaaatcgtgtgaaatgtatgaaatgtccttgggcccacatgtcagatttccatctctcttctctctctatcccctccttccacactggcacacagccatgcgacgggcttcagggggcaggaggagggttgtgacgagggggacagcggcagccaacggcctaggccttgccgggccagatcggcgtcgccgccacggagcccgcatcttgccaagaccttaagagtggcatttaaatgtcgttcacgaaatcaacacgacatgttgtttcttgtttataggataaattatatgaatatagccacatccactatcagggccggccctggccctatggagccgaggcgaccgccgggggcccatgatggtggggtggggggcataatggtggggggcaacacctaatactagtagtctagt

SEQ ID NO: 51518 - DNA, 1501 bp, Oryza sativa
atccatactcttaatatgtatctttgccttgtcattatatttgtttttgcaccataaagctcttatgcttgagaagatgagtctaactttaagatgataataacttgtaagcatgttgtcatttttgcatggcaagctatatttgataatttaagtgttccttcaaaatagcaaatttgtaggtttgttgtcatttacttgatacactacaattgataagtaacttgtatttttaaatgacgtacttgtaactttgttgtcatgtaaaatatatcagacagtaaggcatattggtgtaagtaattttaccatgtcataagcctttttactgcttattgacccatataacttgcctatatatattatttaactatttgaaaaacacatattatgataattttacacatctgaccacggagagctgtgaggctacacgtgggcccgtgtcactcaaatccacccaggcgcacggatttgcttcccgtgcacctaggacggctccccgcgtgctcccgctctatgtgaatcgtgtttgcagacgagtggacccactcgggataccgcgcgggggaccgagtccactagccttgtgcactcgtcctaggccacatcctcgtccggtccactcggtcccccgttcgtcgtagctgctccgtcgtgtgttcgctcggctgtgcccacgcagcacgctgggccacacgccgccttcagcccaaaaaggcagaagccatcccctttttcctttttctttttccatttaattcaataatactttttttctttagacagagaatcaattaatcttagaaaatccatatctcttcaactgtctgttcgattgactctgttcaacttctaaaattcctcaaaaatcgagatctattcagtggcacacttagtactcactaatacgagcttttccttggtcgttttgttgagttatctcgttccacgtgtagcttcggagccagaagagtcctagtgcgcggaatacgaggaagaagctcaagatatcaagcaaggtaggtcacctttgattattttgagcccataatttgaaactaagtatttcatttctcaaaatgcacatctctaaattacacatgaaatgttggccgcagtttgcaatataaccaacaggccccacctacaattgctgcattaacctccttggtcgactacaatgctaggtctcagtattcgtgccctcaggtacggataccaatgaccctcctcaaaatttgaatgatcaactatgggtaaaacttgggtttacaaaatccctggaaaacccgacacacctgggtcggtgccttgaaaacaaatgagtttactaaactcgtatttcggtagaagtactggtggtatggttttctcgttcttgctcatatggaccgattcctttagaatttcatccaaccataacatgtgtgaccacatgggtgaattgtgacatgcctggctgagtaattagctaggtcaggcaaatcttgatgccaat

SEQ ID NO: 51519 - DNA, 1501 bp, Oryza sativa
cgtactgatggcgggtgcccaccagaacgatctggaatcggaatccgccgccgccgccgggaaggcgaaacaccgcgccgttccgcacctcggtctgtccctggtcgcactccggcgggaaggcaacgcggcgctggtcgccggagacggggtcccacacgaggaagcagccgcgcagccgcggcatcactgggttgacggcgaggacgaggccgtcgcggcagccgaggatcctgcagcggaagtcgtcgaaccgcagcgagaagcgcccgccggcgcccacggccgcggggacgcggtcggggggatccatggtggagacgaaggaggggctcacccggtggctgtggaagaagccgaggaggggcgcgccgcggcggtggtgggcgcggaagcggcggaggaaggcggggtcggcggtgacgaggcggcgccagcgcgcgcagacggcggcggcgcgcgggagggaggagggccgcggcgggaggcggagaagtatctcggcgaggaggtcgtcgtcttccagcggccgcgggtgcgggtgcgccatcaccgggtttcggttccccgcgcttctccgcttaggtgggaagtggagactggagaatgtaggcagactgtgagactgggactgtgttgtttaggcgagtttacttccaaacttttttttcaaactttcaacttttttatcacattaaaatttttctacacacaaatttttaacttttccgtcacatcgttccaatttcaaccaaattttcaattttagtggaactaaaaccaaatagatagaaaaaatttaggccaaaaacgtcacatcaaatatttatatatatatatatggggtattaaatgtgggaaaaaaaatcaattgcacagtttgcatgtaaatcgcgagacgaatcttttaagcctaattacgtcatgatttaacaatgtgatgctacagtaaacatttgctaatgatagattaattaggcttaataaattcgtctcgcagtttacatgcggaatttgtaatttgttttgttattagtctatatttaatactttaaatgtgtgtccgtatactccaaaaactttacactcaaataactaaacacacccttagatgaggaaaatgttgagatatttaactatttgccacttttagatgtggcaattaactatttgcctctgaacccatatgtcatagacacatatggatccacatttcattgagataggggtggcaaatagttaaataccaaatttaaaagtggcaaatagttaaatgccccggaaaatgttagctcgaggtcctcctcttttattttagtttttaaatcgtactttgaacaatattacgcaaatcccattaacttttaaaacatttgtaaatgaggtccatcgacggtattgtttacggttttagctgaggtggctcttttgactaggtcttcgtcccatatgacatttgcatgacgcttacgtggcaattcaattcgataaaaatcgtgga

SEQ ID NO: 51520 - DNA, 333 bp, Oryza sativa
gctcataaacagaaaaaggagagagagattgcttttgcaaaatcaaagtggcaaaaatctggttttccctcgaggaaaccggtcagaccgtagtgggtcccgcggtcagaccgcgacaggtcagaccggctgaacagcctcggtcagaccgaccaccggtcagaccgacggtgaagcctcggtcagaccgaccaccggtcagaccggccactatacctcggtcagaccggcgtcggaggaatttttctaaaaattctaaaattgattttgcacatggatatatgcctattggatcttctggtcgtgtgtctcagtactggattcctaaatttt

SEQ ID NO: 51521 - DNA, 575 bp, Oryza sativa
gttgttttaactttttagcagaaatcatgttaaacatcaaactagcatgaaaagcaatttgatatttttgcaacaactttttagttaaaaacaactcatccaaagtgcatgtgtgcaaagcaaaactacagcaagagaagatctatttttcaaatcatgtgcagcattaacatctctaatttttgaaatctcattcattaaaacctcacaattttcacaatcatcatcattaggaataagagattttaacctatcaatttcagatttaagagattcaatgataaattcctgttttctatacttcttctcacactttttattttttgcactcaaaatattaatagcttcctcaaaagcactcacctcattatcttcatactctatgtcagattcaccacgcgccatgaagcaaacatcggagacattcaccatctgcatcacttagtggctcgaagacggcgcaaacttgttgaaaagccttcctaagattctccatcttcccccttggtatgaaccctttgacttgttgttgttgggcttgttgttgttggtcttctcaccatctttgtcttctc

SEQ ID NO: 51522 - DNA, 644 bp, Oryza sativa
tatcaatcagtttcgaccgtcaatattaccaaaatagaggagagtagtggtgcttgcaatgcatttgtttgttagaataataatattccactattattaggtctactaaccgtttgcagaaaatgacaataaagtggaggagaattacatcaacatagacgataaatcaatcgaacgatgtcgagagatagacttatgtatgaatgggccaagaagtcaaaattgacacgatgaattgggctaaaattcacaagtctacaaagtgaagcaatagaggaagtcgccaaccaaagatgggctggtttgggccagcccatggttcggccgacccagggggttaggccaaacccccatctccaccattgaggccagggtttggcatgtacgtccaagattgcacccctatgacggttggagtgtactacggacaattccccttccacaaccgtcatacctacctctatataaggagctcactctcttcacttcaacacacaactcaagcaagagctctctcattcctctcaagtttagtttagtagtatctagctggtggaatagaattagaataggaatcaggagtccggaagtcttcgaaagagttcgggtatggctctagtagctttcctttcctcttttgtaag

SEQ ID NO: 51523 - DNA, 172 bp, Oryza sativa
cctgcagcccccatttatgtagaaatctctgcaaacaattaataccccaagtacaagtgaaaatatattactctaaagcaaaatatgcattgcaagtatagctagttctcttttattttagttgtattgacagtcgaagctggtctataacgaccatcaacactaatccaga

SEQ ID NO: 51524 - DNA, 521 bp, Oryza sativa
cggtactactacagtatcactgcttgtacattgctaaatttttaaatctcaatcttgtgtacaagtgttaaaaaagtgcatgtgctggtcacaagttaacacaagtgttaaaagtacatctagcaagctcaatacaagtaaacttttagaattctaatctttaaacaacaatatctctcacatcgcatattattttttagaaccgttttcaccataatgctttaaaacaacgttacaacaagacaatagtcatgttactacactacgatcattgagacaaaaatccttaacgaaacttgatccatcatgactattttataacgttgttactacagaaaggaaagtagtcctgttactgcacattgaacgtcctattactacgccgtttcagcaagatgagaactaaaaaaaagtaaatctcaatctttagagagcaatatctctcacgttatatagtatttttctaatccgtttgcactatgatgttcgtaaaaaagtgcttaacaaaactagatccatca

SEQ ID NO: 51525 - DNA, 1053 bp, Oryza sativa
  unsure (1)..(1053): unsure at all n locations
aattttgaatggggggaagacaacactggtggaaaaaccatttttactcccggctgataacccctttagtcccaggatttcaaccgggagtataaattcggaactaaagatgggcatgactaaagatccagtcccgattggtaacagcaaccgggactaaagagagggatctttagtcccggttgatgttactaaccggaagtaagtagagaatagcggcagtcccaaatggtcccattttcctttttttttctcccgaatcaaatggcatgcatatccccaaatcaaaccccaaatccccaaatccccaaatcaaagtaacatcccaaatccacatcaaaaatcttaaaagttacttatacacacaaatcaaatacatcacaaatcctaaaaaattacacacaaatcaaatacatcacatattatacatctcatatccatatgatacaatgaatcagaaaattatacatctctgtgaatcacaaattatcaaaaaaaaaaagacagaaaacaacgccgctgccgccggcccgccgccgggcgtggccccgccggctgccggatgggaaggggaggagggggaggagagaggaggaggtggaggagaggggaggggatgagcaagagaggatcgatctgatctgtagaagatctgtataacaggggagcaggaaggggaaggaggagggggagagattcgatctgtgtgatttgcgattgtggaggagaggataagtgatagggattatatactacacgttgaattttagttccgagattaaagatatgatctttagtcatatctttagtctcgattagtattaccaaccggcactaaagtggtgatcttaaagatcctaggccccctgacatgcatttgacagggaatgatctttagtcccggcatcaatcgaaactaaatatcatagaatggctgtggggtttctaaccgggactaaanataatcttttaaaccggggactatcgtggtttggtcgaccagcaaaatatttttttcctgggcaagtattttggaaggataagtagtgacca

SEQ ID NO: 51526 - DNA, 555 bp, Oryza sativa
tgcttgcacggttgccttcctcgctggatataccgaccggccaccctcgaccgtccgatcgacgccgtggcttggtccacggtggcctgctgccccttgtaccctgacgagtggggcccacctttggtggactcggtccacacccgccccactgctgatgcaataaccattgacttcctttaagaaaaataattaataatagcacaaaaaatcaagtttaattctagaaattcatttaaatggctcaaaacttctaaaattctcaactaattcatacgaactccaaattgggccattcatcttgcaaaattcatctaaaattgagatttgcatgattgtttactttcacatactacttatttggtttttattagagcttttcctcgttttgcgtgccagcgtctagaatccaccgtttcggaagatcgcgttcgcgaggatgagtgttcgaaggattgtttgaagattcgagcaagtacacattccccttgagcatattgaacccactttataattttttacaaataaaattgcatgttttgctaattacatggt

SEQ ID NO: 51527 - DNA, 605 bp, Oryza sativa
gctcggtacccgatggcatatgatggatggacatcgtgtgggagagatcttcgcaacgggcttcacgaggtgtgcgtgcaagtgccggtgttcgctaagggaattgtaaagttggagtagtatatggtgctacagtacacgaggtactgtagcgtgcaggtatgcatgcatgtacggtgctgtacgtgtatgtgtgatcgatacatgcatggtgaagcatgtatgtgtgcatgactggttggccgagcagcaggagagcggctcggtgggcttcggtggctgttggcgacatgccaagtcggcccaggagaaagcaagggccctgctggcagcgagtcggtgacggtcacacgtggatttctggtgcgaatccgttttggatttctggtgcggccggttgtttgctgcacgtttggaaattgtaaaacgtatggaaactgaaggatggagtcctattgtgtataggagttctacacctactttgagtaggagtttttgtggtataaatagagagggagcgtgaggcttcctgtatcgctttagagagcaatagagttgagttttggtttagggtttcgagtttagtcgaaatttttgtaagaagt

SEQ ID NO: 51528 - DNA, 707 bp, Oryza sativa
actgagctactgggtttctatcatcttattaaagctcagttggttttgaaacgcggaagcaaagccatctagcttgacatttatgttttctaagaccttatcattggcagcaagctttttgcttagcgcatcagtggttttagcttgcgcaaaaacaagatacttcaaggagggctggttagagatgttggcagagggagcagcgaactcgcgaagagtcttgctgggcattgaattgaaggtcggtggcattggtacggctggtttatctgtcggtagagttttctgtggagcaatgactcgcggcctgacgctccggaagaaagcttctggattttctttgaagttttctggcaggttgaaaccagtcatgcactaccctgttttcacaataaaaagtgaaaacaaccaaagttagcctgcaaaggaaaatgattatacaaagataaatataaagtattagttcaaataatctctatcatgaatctttcccggcaacggcgccagaaatgcttgttggtatttcttaacgacattactagaaatgtaattcccagtaatagcgcagaaatgtatattatggttacagagttcatccgcaagcgcacggatataccatcgtactatttcacccgagagtattccaagggtatcgtatttattttatcccatgggcagatcacatagagagaagtcaactaataatt

SEQ ID NO: 51529 - DNA, 1501 bp, Oryza sativa
ccaaaccaggaatgtaccattccaaaccaggagctaatcaaattattactagttatagcatcattcattatggtgagaagtgtgagactaatcacaaaagacattgttagacccgcccataaccgcgggcacaattattcgaatagttttactctggccagaggtgtaccactgtatccacaagacacgattccacacatgttaccatgccctgaagtaccaccacggcactgcaaagggggaaatcgtgactgtacccttcgcacaacacaactcaccacattgcaccattcccggatcatagtcacccccttataaacaaggtatggactccccagcgacccccgtgggcttatctccaccacttctcaacctggtgctctgcaatgaaccatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtaagtcataagttatcccaatagtgtgctaatgtttctaagcatggctaagcaatcatatctaatatctagctgaaccaatatataaagctcaactagtcaagttataatatcccaaggtatcaaggaatagagtaatcaatgcaaacaggccataacaaaggaataggttcacaccacccggtgacatttgaaaataaatgcacagttgaaataaatagagaatttaaatataggatcaacatgctcaaaggattgtgtttaggatctgtgtgacttgccttgcaataatcggtcttcaattaatcttcttgaatacttctggcgcactcgcgaaccttcgccacgacggaaacgacaagctaacacgcaaaacgaggaaaaagactaataaaaaccaaataaacaatacataaaaagtaaacaaacatgtagatcataattttagatgaattatgagacttgaacggcctcattctgacttaatatgaatttaatatgaattttacaagattaaatctaattaaagcccatttaaaaagaattaaataaatttaattcaatttatggacaattttaatatgtagatctttattttatataatttttgcaacttgaaccacattaaactgagttcaaatgaattagttatgaattttcaaagattaaatcggattaaaacacttatatggattttaattgaattatgacgcaataatgaattatttttgaaaaggaaaagggaatttattgcgtcagcggctagggtttcgcggtggaccgggcgcacggcggcggttcacgcgaacggatggccgagatcgatccatccaaaacggacggccgagatcgatcggtccacaaccggctcacggaaaagggcaacaa

SEQ ID NO: 51530 - DNA, 1501 bp, Oryza sativa
  unsure (1)..(1501): unsure at all n locations
ggtttttaaattcgttcgcttttggaaatacaaatctgtatttgagtcgggttttaagttcgttcccttttgaaaatgcagaagcagttgtataagaagtcgctttaaaaaaaacttacatgctaacttgagatgatcagactcctaattgcagctcatgattttctaaaaaaatatttattccaaccaattcttaccattgatttgaaccttacctaacccgtccattattattaaatttaaaatagccttcacccattgcaatgcacgggcaatttttctagtctatatactaatataaaaagaagttgtccctagcaatcttacacgtgaaatcatcccctgtcttctaatctgtgtatccactatctaatctaatctaatccgtccgttatcttcctcgttgtatgctattaataagggattccaccaactccgttgattaattccccgcccgatgactccgccccccgatcttcctcgtctcctcgctctgcagcatgctccctcctcctcgcgacagatctgcaacgatgcaccgctagactagcgcaccgctgccgtgactcctcgccgcacgcatccnctttccgctagagccttggccgggactttccccgatggcgccgtggtgttttgtgcccgcgtcgtccaagtttggccatcggtccgccaaaccttcttcaaaattcttgggaacttgtgatttgtgcacttcttcacaaggtgaagcgcccattgggttggccggggatcatctcactcaggtattggatccttctagattccctgtttattctcatgcaagtgctaccgtgctattttgagctggttgggactggagtcaccaagttagttgggttggcataaaactgttttgagctagcgagttgcatatttcgaggttgttcagtgaggaaaattgaagggtagatccgttgatttggggttataatggtactaatcatcaaaattcctactgattattgacatagcaattgaatggtttagctgtataataatgtttagttatatataattgctgaactaaattatatgtttaccaaactgctttgatttttatccaattcctcttggaacatcaggtcagcagctatcaatttaagaaattcctttttccatatttcccatcacattttgagtcgaactatattcctgaattcatctatgggcatgctgctcgcctagcgagtcactctccacaaagggtgcccatgtgctgttactattcatgctatttgattcttttgtgtgtacatatcccaaaagtttgattgcattttttaggtagttgacagatgaactaatatacttgcaagtaacatatatacggccgatcatcaatatatgtcttttttaacactaatttggcatctttttttatcggtgaatgacatgcaaaacacatatttcaggggtttgccattgctcaaataccattatatgtgtcgacgggggatacccgtagaccggatataga

SEQ ID NO: 51531 - DNA, 1501 bp, Oryza sativa
aatggtcggtaataccctccaaccgtcattggggcttcatctcaaccgtccagccaaaacctggatccaacgaaggcgagggaggttcggccgaaccaccaggttcagccgaaccttgggctggcccaatccagtccaatttcggctggcggcctcctctgctgcttcacttcgtagacttgtgaattttggcctgattcatcgtgtcaaatctgtgtgcttggcccattcatacacaagtctggttctcgacattgtccaattgatttatcgtctgagttgatgtcgattctccttcactttattgtcattctctacaaaaggttagtagacctaatactagtggaatattattattctaacatatttatgcatagcaagtatcactagttctctcctgttttagtaatattgacggtcgaaactgatcgataatgaccgtcacatgcagctacctctatctcaatgtcttcaacaaaaggtaaaacttgttatgatggcttgcgttctcgggattagtgcttccatctttatgatactctaatcttgtttatgtaattcgtcaagttatcatatatcttacataatctctagcaatatcgctatctaacccacaatcggctaacatctgttaatagagggcaaccgattaggttaaatatcgacgttggtttagattatataagatatctaccactctatgaaacttccagcggcttaattgtctagatatggtcttcttttcatacttaatgctgcatcagttgagtttgatctattaagtcgtgcttagaatatcaatctttagccctgccttctggttgccgattagggcagtatcggggtttcagccaatcttatctggtttaactatatttgctctatacgctccattgacaagttagatccgccctttatgtcaagatattattgcatttaagtatattacgcttctgtttagtatattctacttgttttaacatcttaacatagagttgtatcggagtactagccgatacatgctagatctatctgattggctatgctataaacatatatagtcctgttattaatatatatttcaacctaagtgattaatactgtctcggcatggcgaccgatctatcccaatcacttggtttaagtatatatcgatataagaactatatattgttgatatctatagccaatcgagtagatttagttctttattatctatttataaccgccgatcgatttacatatgatatcggctcaaaaataaatgatacgtcatcggcacctagccgatcggctatcatttataggtttaaccacggtttctttgtctctatttcttgttgattgcaggatcaaatcaactggcacgctaacacacccgaaggcgagctttggacctgcactggagttaagtagatctcccaggccttgtgtttcacgtcaacacgctcttggcacgcctggtgggaccaagaagaagttagcaagcaattcttcctca

SEQ ID NO: 51532 - DNA, 261 bp, Oryza sativa
tccagactttgaccgggtatgcttactctttgggtgaacgtgaagcttatattttgtcatgccatcttaagtttctattttaataggcctatagtctaacgttactgattttaactttttgtttatgaagattgattggcttaacaagtttgtcgaaaacatttggccttatcttgacaaggttggctcatacaagctagtgcaatattatttgtccaagtttttatttggcactgttttgtaaatattgtcttttacagg

SEQ ID NO: 51533 - DNA, 1501 bp, Oryza sativa
aaccgggatgaagaaatcccgtatcttgactggcacatcctccgttatccccgccgggtaactgttgacgtgaaacacgaggcctaggagatctgcttaactccagtgcaggtccaaagctcgccttcgggtgtgttagcgtgccagttgatttgatcctgcaatcaacaagaaatagagacaaagaaaccgtggttaaacctataaatgatagccgatcggctaggtgccgagacagtattaatcacttatgttgaaatatatattaataacaagactatatatgtttatagcatagccgatcagatagatctagcatgtatcggctagtactccgattcaactctatgttaagatgttaaaacaagcagaatataccaaacagaagcttaatatacttaaatgcaataatatcttgacataaagggaagatctaacatgtcaatggagcatatagagcaaatatagttaaaccagataagatcggctgaaaccccgatactgccctaatcggcaaccagaaggcaggctagagattgatattctaagcacgacttaatagatcgaactcaactgatgcagcattaagtatgaaaagaagaacaatatctagacaatcaagccgctggaagtttcatagagtggtagatatcttatataatctaaaccaacatcgatatttaacctaatcggctgctctctattaacagatgttagccaattgtgggttagatagcgatattgctagagattatgtaagatatatgataactcgacgaattacataaacaagattagagtatcataaagatggaagcactaatcccgagaacacaagccatcataacaagttttaccttttgttgaagatcgaaaccgatgcagctcaacccaaaagcaagaactcgtcgaaataaaacaaaagcaaaagggtggcgatgcgccgaaattgtattgaacgtgtgtgtttaaaaattacatagggctcggggtttatttatacccaagaattacaagatatgtccataccggacacgactattatctcaaacaagctctaagataccataagtctctacggcagacttttgcctatatttatccctaaggaatttacataaattatcctaattaatagatacaattgcctccccaggactctatccatctatggcaatcatcatgaagtacgtcaactcaaaaccgatatcgcatacaagtcatattgtcggaatcggctgtatcacttaacccaatctgactcggatcctgccgatcctaatcgtagctgatctggactccagccgattctttctctgttctcgaatcgatctccaccttcgactccacttcgatctaatcctctttttcgatgctgatattagcaaatttggtcgttaacacatgccccccaagtccggaatatttggtaatgtttcggatttgcttaacatcgactccgagcaagtttcgcactttaccgttttccgaccgttattca

SEQ ID NO: 51534 - DNA, 1501 bp, Oryza sativa
tttgggggagaaagtggggagggagctcagcctaaggaagaacgtaaagtggctggcaatagaaagggaggaggaagatggagggttttttttgctgtcttaagttcctgaggtggggttgcacgcccaagaggtggtctaggagatatggagcgggcctaggtcagtgacatgtggggccaagtcgaactgggcccataggacagataaatcaaggctagaaacataggtacacaatgaaattagtgaattttcaggaattttctctcctggttaactagtttgacctagctacaagaattccaaaaatgggtgatctggtgtgtgtatagcttgagttacctagtttccatttttcaaagtttcactcaaaaattcgaaatattttaattctggcaaaaaggtgaaatggggtatgctgagaactaaattgaatttcaatgaggtcaaaactaagtgtaaaaattctagaaaaattatattaactcatgataaataatctagtatttgaataaattataaaacctatatccttctgatcaatttttaagcacatttaggagttgcttcattttcctgattaggtttctaattaatcactgtgactatacttgactgatatatctgaggtagtaaaaagggtgataaaatgatgaaacctttacagtggtcatcttaggttgtctaattgacatgaggaccttcatggaattttatgttgcttagatttgttacagagtatctatattcatttaacatttaccaattagccaaacaaagaaaatcatttaagccaataaattggactacactacaaccaggtacacaagcatacaatcactagttacttaatctactagccaaaagctatgcgtgatcgggtagattatcaaataagcgaaatatgagttacaaaattaccgattggtcattcattatagttaaatacaaagaggtttcaacttggcttaaaagctaaaagggagaaaaagaaaggtggatcttcgtgaattatctggtattgagttggcttagtctcttatattctcgttccattcgtgcaaggaaaaatattggtgagtaggtctttagttgtgttggtaaattttattagcgtcaaagcactatttgaaaaattggatgattcttccttaacccagcaacttagatttcgccaccaaggttatatggttattttgttttctggaaaaaaaatgctttccctataatggtagctaaagattgacatcatcccaaacaaaagtctagcaaaaggtttaaatttctagccattttaaacataagaatcatctgaagaattttttttctaagaaagtttttgaaattcctataattttatccgaaacataacatatgacacgttaaactactaattaaattttcagttgttacagaggtggctcacggtgaagtgagttgccggccggagatgagagggggcgacggatgctcacctcgagcagaggggacggagttccga

SEQ ID NO: 51535 - DNA, 1501 bp, Oryza sativa
agcttccattcaccccaccatctgtcgaaatttttgcttctaaaccctgccaactcaatattatcaatgctgcccagagagggtcctggtaggttaagtagccgatccatcattagagtggatgcgatttctcctcagcactgaatcttgtcgacaaagaataagccgattgggagttgtcctaatccaagttgtctagccgagctcattgggtgataaaactcataggaaacttggatatttcttccttgatgaatgccgacaggaaggatgcatgggctgattgcggctgtaagaacttccctggatttttgatacttttcatgattgatatcttcaaatctaaagactgatggaagttcaagatctgctgagtcttcataaggaaaccaaactcgggcatctttcttaaagccttcatagaagccgcagaaccaatccttgagtagctcggccgatagctttgctctagcatcggttggtgtggacgcatattccccatatgatgtgcatctacgatgagtgcgttcttctccatcatctcctgcaatcggctctggcaatgggaactcagcatctgtcacagatggccgattgacgactttcatgaccattaggttcaaccaggtttgcagcagccaccattgtccacctgcaccaactactgagccaacggctatcttggccgatgcattgttcaatgtttcgtataagtagccgaggagaatcttgcctaagggaaattctttctttgattctaaggcttcggctacaaattgccagttggttgtaggaccacaactggatccacaaaagagaaatttttcgagccacattagcaagaaggctacatgctctcgaggagtaacagatccttggcccatatatgccgccacatagccagaccagccacctatgcttttggttctgaagtcaaactgatttttgctgttcatgctcatgggattagccgatgaggttacatctaaaccggtgatcatggtaatgtcaatcaaagttgtggtcatcggcccttggttgaacaagaaggcgttaatggtgttggactaaaaataagaggcggctgccattaagggctcgtcgttagctgagttggctatggttaggtcaagtgcttggccgattccaatctcatcccagtgtactttcttactagctgatacgcgctggtaccatgtaacccaagttttctcaggggtggttttctcaagagatggccaagacttgaaagtgtttttctagtggctcaggttagggttggctagcctcaaggggatcctattggtttcaccgatgataaaatcagtggggtcaagattgccgattggacccagaaaatagtgattttcatgcgacaggcttggaatcgcaactaggttggaaaggtgctgcaaatccaaagcaaccgagaagaagagagcaatatgagacgagaaaaatcgatttgctgttgagaaaggggatctagccgatggggact

SEQ ID NO: 51536 - DNA, 338 bp, Oryza sativa
aatggtgagattttggtaaacctgaaactacaaaactgtggttaatcggctggtatcatgtctaccttgaatgcatcttcttcaaaatccaatgtcgtgcatgcaaaatatcctgttgttgcttctattgctaaatcttctaatgctaccaatgtgtctaatcatcatgaaaaatatacttgttctttttgtggcaaagatggacatattgttggtttttgtttcagattagctcataaacagaaaaaggagagagagattgcttttgcaaaatcaaagtggatatatgcctattggatcttctggtcatgtgtctcagtactggattcctaaatttt

SEQ ID NO: 51537 - DNA, 1501 bp, Oryza sativa
gcaaatggtgaagaatgccgccatgatcaaaaatcaagaagtagctttgaaggcaaaacaagaagaagtgtcaagttgtgaagaaattgaagatgaagagatggcttttattgtcaagagattcaagcactttcttcgcaagagtggctatggaaaagggaggaaggatgatgacaagggaaagaggcaatcaaagagagcttgcttcaattgtggcgaatatggccacttcattgccgattgtcccaagtcaaatgaagctaaggctaagggaggcaagaagaagctagagcgtgctcatgtggcagaggtgtggtactccggagatgaaagaagatctcccaggtcaagggccaagagctaaaaccaaaaacaaaagtttaaaagaagaggggggtttcgaccctgtcccttaaatgatatcctctaagagaagagagtgtcttttcacacttgagagaagtggggaggagtctccatcactacttttgtgttacggccccaagccccaaagtgagatgactcaaaagccctctcacatctctcttgatgttgattctagtgatgaggaaagtgataatgaattagatgatgtgcttgagagctttagcaaacccgctatgcaacatttggctaagttaatgagagctttggatagtaaagaacaatcactcgaaaggcaagaagaattgcttattcttgagaagaaaagaaaccttgccttagaggagagcctagctacaaaatgtgctaaaaatgaacaactagctaatgagcttaatttggctaatggttctctagctatccttagggatgtcaatgaaactcttcaagacaaatttgctaatttagacaaaagtcataaagatcttgaagttcaatttgacactctttggaatagcacctctcaaccaaatgtggtttctaatccttccaacccatctactagcaatgattgtgctaggtgttacaatattgatttgaactcttgtgctactaatgttgatgctatgcaagctcttaagaaagagaatgaaaggttgggcacattggtaaaatatggatacatgaagacataccattcaaaagatgccctttataagaccatcaccgctcatcctaacaaggatggacacgggctcgggttttctagtggaagtcctgtgtctaagcgtgtgatggtaaatgggaaagaatgcttgatgtttttgagagaaggtaaagctccacaagcaagtgaggtgacttgtcccttcactggtcagacactcggaagttccgggcaaaatgacgggaagttcctgccctgtaagacaggaagttccgaacattttgtcaggaagttccggacttctgatgagtcgaaggggctgaccggaagttcctggtataatgccaggaagttccggccagaaggtctttactatgatttatatgtaatttccaaaaattcagagggcaaagtggttgcttattttaatgggaattacaatgatgagta

SEQ ID NO: 51538 - DNA, 618 bp, Oryza sativa
aaattctagaaacactgttcttggtgctttaggtagattgttaattagcaagaagcatggggatattcagaggaggatggaactaaagtcacttggtaatatctgagaaagagataactggagttacaatgtaattacactaaattcaagtgctaataattactgaactaaatcaattatccccccacatagcttatgcacctatatcatttctttcaattgtaagctatgaaatcaaatttctgctaaggggcagccagtagcagttccacttgtcacattaagtcaacgcgcatagttacttcattccaagtctaaattgggtgattcaaattgtattagaaccagtgaatttggctccttggtgtgatataaattttattcacgtaaggctgctaaaaatctcagtatatggttgggtctgtttgttctattttcaaaagttgccattttagtgtatatggctggttagttgtgtatctcctaagctagagcagcaaatgtagtttttatgtcaacttgtacgctgcccactgtatttatctatcaatttatagagcatgttgcatatgcatgtttatttgaatcttatttgcatatttgtcttttatcggtaga

SEQ ID NO: 51539 - DNA, 1501 bp, Oryza sativa
gcggccaaggagtctgtaacaaggctttttagaaactccgtcccaacactgccttcccccatgagacacctttccctcacatagacaagaaagtccccatggcgaacctaaactcctatcatctagctacctgggccaacagtgccaagactcagaatcctactgggccaggttcttcccatgagaacatgtggttgcacgttaggctcagatccatgacttatgaagtgaagtccttaattgaccaaggcaacttgccaaactacaatagcacacagctcaacagtaggctcacacagagaccatacccagcaacgatcacacagatacattaccacctaaccaggttcacactgaaccacccatcaccccggtcaaaaatgttttatccgcccgttgttttacacgttgcaacacatgctaccgaaaagatagcacacagccacacagttcatataaaagtgattataagtatatgattaatcaaaattatattttgcttgtaaaacaaccttgagcgggctaagcataactactctaccatgagttgagcccaatgttcaactcacaaatactagggagacaagatatcatgggcaatcaataattatcaaaggtaggataataataacaattaggtcacgctacccatcgatagtttataaacaaaacaatgcatgtattcaaaacaaaacatttcacaaataggttcaatatgttcaaagagtgcacttgccttgatcccaatactgtccttgcacagcgtcttctgaagcaaactgctcttccgctccaacgtctacacgattgcaaacgaaaaacaaataaacacaaagaaaaactaactaaataacatcatatgaaataaccaattaaaccaagaggttgagctcgattttagaagaatttaggaagaagaatgggtcgaatcggagttcaaacggaaaagttatagcctccggaagtttgaattcagggaaaatccgaggataaaagaaaagggaatattccgagaatattctctggatttttaatttcagaaattgaattaattttggataggaaaatatatgtgggcccactatcagtggcatagagtgtatgggtgaacttggtgtatgtgaactcgatgacgtggaacgacacgtggcgacataaggcgatgaggtggcactgacatggatggatctagggctgaggtggcataggttagggattatgtagatccaacggttgggatttgatctagggatttggacggctgtgattatttggagtttttggatggcaagtcccacacgtcagtgtcacagggaagaggacaagcagcagctgctccaccacaggcctgggcgtgcccggccatggcggcatggcgactccggcacagcgacgtcggcggcgttctccagcgacggcgcgcagctgcagcgacgagcagctacgtcggcaagagaaggcggaggcgaatccggtggcgcagcaccgagctccgggacga

SEQ ID NO: 51540 - DNA, 1082 bp, Oryza sativa
catattagccgcacgcaaaaatcggttgtgtagtagtgtgctttttataaaataatcatcaacattcacatgatagcacaatactgtcattgcgatgagcattaaccattaacatatatgggtgtgtttggttgctcgcatcccctaagcaagggtcatctctctcatataggctgaatttgacctatctctgagcatgcacatgcagttgtttggttgtttacattagtctagccaggttgacatgagattgtatttagttactcgcatgagagatacggtttggaagagattgtgtttggttagttgtattgactcgagtgcggttacctattcatttagttgggtgagattacctatacaccatatatatatatatatatatatatatatatatatatatatatatatatatatatataattatattagttttttatttaaaaaattagataatcttttatataatattagatctggaaaatcactatcttgtctatataaaaatcattagtagtacatacagcgtttagttatatgagagaaaaaccgaaagaaaaaagaaagcggaaaacgagagaaaaaaagggaaaggggatcggcgttgcctcgtcgccatcagcaactcccttccgctcgccgctgtcgatgcggacatctgcctgtcgctcccctccactgcctgctaccgatgcgcccatattcccgtcgctcccctccccctgttgctcaccactccacccatctccccacgctcccattcgcccgccgctcgccgctccgctccatcagatctggaggccagtgattaaagataggagacgacggtgcccggcgattgaaggttgggggacggcatgaagaggaggagggatgcagcagcaggacggatcagctgttgtgctcgtcgttgtgccccccgtcaagcttcgtcgccttcgagccgttcgctgcctcttcgccatgtccatagtctcgttgcttgttgggtagaatgaagagggggagaggggcagggtggtaactccaatgcctgctcttgcatgcgtgggtgcaatgctgcatgtatgggtgcagtgcaa

SEQ ID NO: 51541 - DNA, 582 bp, Oryza sativa
aaatgaataaattttaaagttcaatttggacaggggctggattcactgggatttggtttttcttttttacagaccgagtacttatatagctacctccttcgtcccaaattacctggctttcaagaatggttaacatattctaaggtttaaaaccaaaaactataatacccttataaaataatttacggttaaggatagaaggttggttgagggtgttgacgatcaaatttggtaagatgtgaactaggttcgacattgggatcgaggcggattcaataaagagatcgattcgaagaacagggtatgcatcggatgcgaaggcatcggctgaagtctgcatcggcttagatggatcggtcagagaatagccgatacggctgatagaggtgatgcagctgattccaatgaagacggttttaaggctctttgaatcgttcaaagtgcttcacaggaattgccacgatagagataaagctcttggtttaggcaattgtatctattaattaggatatttcatgtaatttccttagagatatgtttgggcaaaagtctgccgcaaagacttatgatatcttagagttt

SEQ ID NO: 51542 - DNA, 441 bp, Oryza sativa
cgtaaccctgacaatatgcattgtttcaagttgtagaaccatactatctttttttatgaaaatgctgaaccataatattatcatttacagtatatataattatacatttatgtgtccatctatactctttataggctattttcaagtcttaactaccaatgtctctacaggaacgagctccacttgatgatcttgctaattaaagtgccatgacattatcaagctctaaggacggcttgtcataacaagctatagttttttttttcggggataacaacctatagttacttctatgaattttgtgaaataaaagatgatccatttgtgaccattgttcgagactaaaaacattacagattgcaagagcaaaaggcaataatgtgagggcagggagaaaattctttttcagcagagttaagtctgtgaccatgttttcatagg

SEQ ID NO: 51543 - DNA, 433 bp, Oryza sativa
agggaggggcggcccgagagagagatgggaaaggaaaaagagagggacggaagagagacttcggccgcaggccgagggggaggaggggaactttgggctagacttggcccaaaagaaaaggaggattatttttagttttctttttcataaactttcttaattgttgttgttgcttaataattatttccggcgttctgaaaattcaagtaaattttgagggctccttttagaccaaggagaatttaacaaaaatcctccggaccacattcgaaattttcttgtacgcattttaaggtttgctaatttcttttcgaattttaattaattctattattttttttagagaatgatttttatttcgggatgaatttaacaggaagtgacaattttgttgcagtggcttcgaagagaaggaagtagcaaggaatggata

SEQ ID NO: 51544 - DNA, 1501 bp, Oryza sativa
tttctttgccaaagattgcagaaacgtcgctgccgtcgctgacccgtccccgtcgccgcctctacctcgctgccggccgtctgccgtcatcatccatcgtcacgctgcccctcagtgagctttcctctctcctttgtcgttcatcggtgtagtttatccatagggtcttaatccaatctaatctaatttggccctagtgtcgtcatcatcttcatgtgttgtcgccggaaaatcatcgccgccgtggacagtacctcgccgcccttcgaagctcatcgccggccatcttccgtcgctgtccatcgtcgcgtaagtgttggtaagaatcgccgtcgccttctctacctcccggtgccctccgtttgcattattgggccatggttcgccggcaaccgccgctcctatgtcgttcactggtgtagtttatccctagggtcttaatcccatctaatctaatctaatcttgtttggccctagtgtcgtcatcgtctccgtgtgttgtcgccggaccgtcatcgtcgacccttcctctccgatcgctttggttcggtgagacgtctatctgtgttccctcggtttagtttttaatctctcgtttgtgtcgtcgagtagccgccgccgtgccacgcttagctgctgcgccttgctttcgtgctctgtcgtcgttgtgtgtcgtcgtcgctgtgccgttgccctaaccctagccgcgtgcctccgccgagtcgccgccgcctagccaagccaagtcgccctagtgccgccgtgtcgcagctgtgtgccgctttaacctagctgccgctttaaccgttgctcggtagtcaagttgtctagccgtaggtgcatccctaaattcctaccggcctatcgtttgcggtacccgggctttaccgtgaatcgtgtctagctcaccggtttagtcgcagtcgttgttaagtcgttcgctcgttcgttcgaaagaggtgttccccgtgcttcgttcgttcgtccatgttgagtcgtcctttagtttagagccgttcagagccgccggttccgttcgccggtttcggttgatcatttgggtgatcccgtgtcacgtagaattgactcgttgagtcggtatctcttgaggcttgcttgccagattaatctaatccgatcttggtcgactcggtcaagattaatctcagccatataaatccgttccctctcttcaatggcatattagttctttttatcatatgtcatctaccaaatataatctaatcttttctggaggttgttttaatctttatctcagttataaatcatttgtaaacggtttaattaattttgaatagtcttttctttaataggattaattggaattaaatcttgtaaaattcataattaatttatatgatattgaatgaggccgttcaagtctctaaattcatctaaaatcatgatctacatgtttgtttactttatatgtactgtttatttggtttttattagtctttttcttcgttttgcgtgttag

SEQ ID NO: 51545 - DNA, 446 bp, Oryza sativa
atggttgtggtgtcggcttggttataatttctgctcggggggcaagttttgagtttgcttatactattaaaccttatgcaactaacaatcagactgagtatgaggtagttctcaaagggttgcagttactcaaggaagttgaagccgatgctattgagattatgggagattctttgctagtgatcagtcaattggcaggggagtataactgcaaaaatgatacattgatggtttataatgagaagtgccgagaattgatgaaagagtttcggctggtgactttgaagcatgtatctcgagagcagaatattgatgttaatgatttggcccaagggacttcgggatataagccgatgatcaaagatgtcaaaattgaggttgctgcattaacagccgatgattggagatatgatgtacattaatatttacagaatccatctcaatcg

SEQ ID NO: 51546 - DNA, 1501 bp, Oryza sativa
gctccacttgtgggctagattgaagaaaggcagatcgagcagagggaggtagcggactgggttggtactgaaaaggaagaaaataataggttttaggcccaaaacgaaggaacaattttcattaactttttcaattataatgaatattgatcctaatgtttccattcatcgcttagtctctaatagcggttgtaccactgaaaaaacatttttatccattgcaacgtacggatatattttctagtaaaacaaaacgtgaacttttcctaaagataaaagtatcaaggctatcagatggcttaattaataataattaatatttttaaaattaaattattagtatttttttggaggatttatcaaaacaggatggacggtgtttctaacagcgtccagacctggacgcgcattcaaacagcggccagatgtcgatgctactggaaacagcgtacaccagcttgttggtgcagccagaccagaaatgcataacaaaacgagaattatagaaaggaaaacctattgcgtcgatggcacaacgtgaaaaaaatcgatcgacctagaggtttagggttcgccgctcgccgttcgctggcacatcgtcgtatgtgttagctgtgatctccgtacgtcgtcactcccgctgtcgacaccagcgccttcgatttcaccatcagtcagtgccaccaatccagccaaggtgtccttggcgctgcgtccgttggctgctcaccgtgtgaggcaacagcggctctgcaagttccatcacacatgcatacgtctattgatcagcatgcattttccgctgtgaggcaacatgcaggtgttgggatacgtgtagactacgatagcataagtcaaaattttctatcgcgtaaacaaggaaccatgcaagtattagatcatagatcgttaccactcgacgcgctgtgcagcggaagaagacgctgagaagtcaaaggaactctcgcgaagtagcgcgcatcgatgtagaggaagtagtcgattgcaccggctcgaccttctcctcctcgtgcgttctcctcgccgtactcccacgccgatcagcaccgcaaaccagcggcgcctctaccggtatccacacgtacagggacggaacgccacgcgcagatgtgctagcacccgcgcgcggctagggttttgctcggggagggaagtgacggctagggtttctcacgtgatgcgatgcctccgccggtcacacctctcacgaatatataggatccatcactcgggcctccaaggctcgtaggactcctattcggatccctatcggaattaagctcatattggatctctatccaatccccttattccggcccattaagcgtgcgaccctgtaggttcatatatactcggctgtaacccgaaaactccttttcggtccacgtgtcacaagcggcccctagcagaatgtattgacccaccggacatacataaagatcatatcggctgaacctctagtgtatacttgtatgaaccc

SEQ ID NO: 51547 - DNA, 877 bp, Oryza sativa
ctacttgaaatgacagtgtgaaatataaatatttagttggatgagttcccaataaaacatgcaatctcatcatttccctatcaagtcaaatatccaacataatatgaaacccgaagcatcgagtagggagcataggatatattgctgggactcggcgtgccaatcaactttagcctgagacataccaatcaaaccacatgaaggcggcggccagttgtgttccacatctccagagactgactatctgctagagctctacgtcatctcaaatgctctaaactcatactcatatgaaactagctcccagttaatagtttcatacttccatctaagcaaatgataaacagaacgtcctgccgctacagcacccatcgatcgactgcgctctcacaccatcgcgcgcacacggcaaccttggccagacaccctgccgctgctgcaccttgccatcccctgcagaaattggctgctcacagtcagcccaagggctagtgcggcattcggcggccagcacccacctccatttggcgcggcaatgccattgccatctgtcccatcatgcctggctcgacaccatatggcaaaattcattctatatattcagcacacttcaacaatttttacatgactaacttcctgtaactgatattcaagtcttgcacgtgtcgaaggaaagcttaatctgctagctactctaatactcctcccacatgaaaaattgatgagggcttacatctacgacaagcaaataaaattcatttcagaggatgaggcttatagtgacaaacggaggttgtcggacacctgctcctgatggcagcggcggtggtgcagcgatagagcgcagttgagggccgagttgctgcaagcgagagaa

SEQ ID NO: 51548 - DNA, 1501 bp, Oryza sativa
cctctagaaatcacgtatccgttcccaaggctcctagctagctcgcacaccaccaaattatacaggttcgggccgctatgaagcgtaataccctactcctgtgaatgggatttagactgagagttacaagggttcctaaactcgggagaacactcttcgttccctcctccacgagcttaggttttctaagagtcgtcctctttcttggtgggcaaggtcctccttttgtacctcaaggggataccacatgcaccgcctctacctactcttctttcgagtggggacccaccctatcttgaccggaactcgacccgtgccttcgcctggaagctaaaccacagcttgtccttgagtggggctcagcgccatccctcgcctgacacggggaacagccctgtcattccctcatttatgggtaaagacttgtggtggctgccgtccgaatgaccctccgatgggacgggtcatacctacctccactccgccggaagcagacgcgacgtgggagcacggttgtccgtccagtcagacgtgaccggtgtcaggccggtcagacgccggtcacagactggtcattcttgaccatcgcgcgtcactttagcacgccgcatgtctgccccactgcattaaatgtgacaggggcagttggggcgctgcgcgcattaaaggaggttcagcctgggccccctcctcgctcgctccccccgccaaatggcggctgggcgagggcctcggggcaaggcggtgcaagggcccgagggacatgacttggcaccccgaggccccgacccccctggccactcctgcggttcgcggaatgcgggggcaggatcaggctgtagggacacgtggtaagatgtgggaaggtagattcccctcatttcgcatacccccgggcccatatctccgacagtagcccccggcaccacatcggacattggcctcctgaggtcggtctgacgtggtgcctcactacttcccaagctggggttgtgggcccggcagggaatctaagcggatgccgccgagtggccaggttggcatatcaaccacaacagcggtttgaccgccacttaccgcgctgatgatgaggatgcttaaggcgcgaaaatcagggggtcggttagaccacacctcgactccctcgcacgccacgcatgcggaggtactggtgacggttcacccagattgtgcccgtgaccgtcgcacgcccaacgccgagtgtgccgctgacaggcgcgctaaatgcggggcgcggattccgtgggcgacgtgatgagtagttgcaggaaacgatgaggcaactgcaggcgcgagaattgtgggcgcaaccgtgagggcgtgaaacaaggaggcgagcgcgggcgaggcagggataaaaggatacggaggcggggactttgcctccttcctttcgccaactgctcacccgcacactcgctccctaagcccaaacattctcgccactccatgctactccgcacaccaagcccctcgtcgc

SEQ ID NO: 51549 - DNA, 1501 bp, Oryza sativa
gaagtgacattccatgcgccgtacttagcggacatatgtgtccatttgtgcgtcggtgcagtggtattctttggatacttgattcacgaccagctgggagtcgcctaggaccaggagacggcggatgcccattccggccgctgccctcaaccccgcgaggagtccttcgtattccgccatgttgttcgtggctcggaagtcgagccgaacgacgtatttgaggatgtccccgcttggcgaagtcagcgtgactccggcacctgcaccttgaaggttgagggagccatcgaaatgcataacccagtgcccgccacgaatgtcggcgtttgggtcctctccatctccggggagggaaggaacgttggatagaacaaggtcgtcaactggggtccactccgcgacgaagtcagccaggacctggcttttgatcgtgtgctgtggttcgaagtgcaggtcaaactcagcaagctcgatggcccactttacaacccgaccagtaccctctcggttgtgcaagatttggtcgagagggtaggatgtcactacggacacccgatgcgcttggaaatagtggcacaatttccttgaggccattaagattgcataaagcatcttctgggcctgtgggtatcgggtcttcgcgtcacctttcggtggggccggtccgtgctgtcaggggcagatgatctggggcacccttgctcaggggcaccggtcattcttgaccatcgcgcgtcactttagcacgccgcacgtctgttccactgcattaaatgcgacagggggtagttggggtgctgcgtgcattaaaggaggttcagcgtgggctccctcctcgctcgctccaaccgccaaatggcggctgggcgagggcctcggggcaaggcggtgcaagggcccgaggggcatgacgtggcaccctgaggccccgacccccccggccgctcctgcggttcgcggaatgcgggggcaggaccaggctgtaaggacacgtggcaggatgggaaggtagattccccttattttgtatacccccaggcccatatctccgacagggtggcaacccccatctcaatcgggcacggtgtccgtcacagcctataagtcacagatgtgaaaaattatctcaatcgggcaaacggctgtcatcgatagctttgacccagacgaatagtcaaactatagcccgtcacggatgacctatctcaatcgagccacaactagcgcccgtcacagatgactactcatctcaattgggcattcactatagcccatcacagatgaccctcatctcaatcgggtgttggtatttcttaacaacattactagaaatataattcccagcaatggcgcaaaaatacttctggtatattatggttatagagttcatctgcaagtgcacgaatataccattgtagcatttcacccgagagtattccaagggtatcgtatttattttatcccgtgggaagatcatgtagagagaacttgactaataatt

SEQ ID NO: 51550 - DNA, 1501 bp, Oryza sativa
gctaggggccgctgttgacgcgtggaccgaaaaggagttttcggtttacaaccgagtatatatgaacctacagggtcgcacgcttaatgggccggaataaggggattggatggagatccaatatgagtttaatttggatagggatccgaataggattcctacgggccttggaggcccaagtgatggatcctatatattcgtgaggggtgtgaccggcggaggtattgcatcacgtgagaaaccctagccgtcacttccctccccgagcaaaaccatagccgcgcgcgggtgctagcacatctgcgcgtggcgttccgtccctgtacgtgtggataccggtagaggcgtcgctggtttgcggtgctgatcagcgtgggagtacggcgaggagaacgtacgaggaggagaaggtcgagccgatgcgatcgactacgttctctacatcgacgcgcgctacttcccgagagttccttcgacttctcagcgtcttcttccgctgcgcggcgcgtcgagtggtaacgatctatgatctaatacttgcatggttcctggtttacgcgatagaaaattttgatttatgctatcgtagcctatgcgtatcgtatcccaacagtggtatcagagccgccatgtatagcttatgatctagatcattgcatatagttgatatacagtatagtaaatgagatctatcttgttgtagatgagttcttaggtgatcggaatgtgtgttggtgacttcactggaatgtctagtactcaccaaggccgagcgcgattgtgttcatcggatagtccgatgtccactggaacgcacgccaatgagaaaaaatgagccaatgagattgactcggtttcagcataatttgattacgccgttaaggttttcacatggcgggtcgtagatgagatctatgtaccccgtgacctttgcatgagtcgtagaaaaaacgggaccgccgtgtgcgttgccccttagatttctcttaggtttttatatctatcttactttattgttgttgtatatttgatataacatggtaggatagattctctcagaaaaattaagtgtaatttatgctcttccaataattgcacctattacggttgtgatcataagtgatgggtttgccatagtaaagtgtcactttttatcatgataaaataggatagatgtcggacatctatatgcagagattattggtttacttgacaaggttatcaaaacagttttggaccttggggcataggttgggttggacatggagatgtcaccccaacagcacaagagtcacatatgatgtgattagcaaggtgttgcttacctattttgatagttgtctagctgtgatgccaaagctcactagacactaataaaatgaggatcttgactcactatattactagagggaattttgtttcacaatacatagtggaagtatattttgttaaattgtttaatgaaaggttaaatgtaaacatggtgctgattttgcataca

SEQ ID NO: 51551 - DNA, 1501 bp, Oryza sativa; identical to SEQ ID NO: 44964

SEQ ID NO: 51552 - DNA, 1501 bp, Oryza sativa
ctccatcgcgccattgttgccaccccgccctgcagtcgccctcgctgtctgtcgccgaagcaccagggagaccggtgcgtgcgtggacgcgtgacgcgggactccgggcaccctctccttccccttccccggcccgaggccggagagctcgccacgcaccgccgccgcccatcactgcgcccggctcagtagtgcctccctccgttctccttcctcgttctccctcgccctctctagcttgcatgatagctcagttagcccctcgaacgcgcgtagacgccgccccgagctccgccgccgctcggcatggccttgccgccgtcggcgccccctcccggaggccgcctctcgtcgccggacctccacggcgcctccccaccctatctgatcccagaaacgaaacccttgagccccggagatgctcccgccacctttaattgagtcctcgtcgcccctcggtgatttcccctttctctcgccgccggccgccactgtcgaattccaccgctgtcgaactccctctagcgaatccgagccgttggctcgctccttctcgatgccctcgtcactccggtgtgctccccgaagaccaaatccgtcgcgcttgctccggtgaacatggcctccgtccgccatccatctcggcctccccttcttcctcctcccgccggcctgcgtggctgccacgtaggcgccacgtcggcgccacctcggctttgaccgagccgagccggtcagccgcctcctccctcccccctcggacgcgcggtccatggtgcgccaaccggctgcgcgtgggcccgccgcatccctggtccatccggtgcacgcgcatgaaccgcgctcacccgaaaccctagcaccgccctcatgcgccgctcccacggtgagccgcgccaccgacaagcgggccccactcgggaccccacaaggtggactcggcccaccggccctttctctccctcacttaccccgcgcccccttgggccgcctctccgggccggccggcccattagttcggccgagccgtgcctctcctcttgggccgcacccaagccgcccgaggaagtctaaatcatatccctccttcaatttctttccaaaaagggtttaataaattattaaatcctttttcctttagacagaaattccttaatccttagaaaatccatatcttctcaaccgctcatccgattgactccgttaaacttccaataattccgtaaaaattgagatctatctaatggtactattatctagtctaaataggatctttattttgggtcttgtgtagatttttaattgtttgcgtatagttgcggttaccggattttcgtcgatcgcgggttttctcgaagattcgtgaagcttcgtgaagacctcgagcaaggcaaatcaccctttgaccaattgctcctataattggaaaatcattattaatttgtttgcaacttgcattattagcaacacacatttatagcatgcttggcctcggtttgcg

SEQ ID NO: 51553 - DNA, 1501 bp, Oryza sativa; identical to SEQ ID NO: 44977

SEQ ID NO: 51554 - DNA, 1501 bp, Oryza sativa; identical to SEQ ID NO: 44978

SEQ ID NO: 51555 - DNA, 766 bp, Oryza sativa
aaccagtgacatgtacatacatgtaatgacaagttgatctcacaattaacacacgtaaacactatctgctattgtaaaaaaaaattgacctcacaattaacacacataaacactatctgctattgtaaaaaaaaaaggagggataacatatttgatacaaaaatcagattgctcatatgagcacatgaaatggttaagagcgagcattcagacaataagcaatatggcttggcagcaacggaagcacgcacaagtattagagtccaccgattctcaaacttccatatcgatgttaaatcttagcagcagctagcccgctgctaaaccgtgctgaacaatcacatactaccttttatccaccaaaccatcaaatctgatttacccgcttgaatggatggcaatcaacacaaggaacagaccgcagaacagaaaaaagatgtccccagaacaaaaacgatatttcgtgactaactaatgacagaatcaactgaaaacgaccatgtacccgattaacccgtaactcatcagaatcaactaagcatacacacgagcatgagcaggtagagggaggggagagaagcgacgttacctacgtcgtgaggcggcggcggagggcggcggcgtccccctctgcgtggcggcggaggaggagggggagagaaatttaggggagggtttctcctgaggctcttataccgtgtggctttgatgggcctcaatgggcccatctaatctctgcactaatgggcctcaaggcccacaaaat

SEQ ID NO: 51556 - DNA, 265 bp, Oryza sativa
gtctggttacattgggtaactggtcccttgaagtgttttacggcctttatccgccgcatgtgctaataaacacttttaagttgcacaaataaactgtgggttccattttgtcttatatttttagatttactggatattgcttgggaatgtaagttgcagagtgttgtagtaaatgatataatgggtttgttgttctgtgcaatttactctactgtttccaaaggaaggggttcatatacatgttcccaattatcttatttctaaa

SEQ ID NO: 51557 - DNA, 812 bp, Oryza sativa
tcatgattgttgaagtgtaccccaacttttcctgggacggggatcaatgcactagcatttgggaaaggccacactagcttatttgagcgcagcattggtcctgtagtcttctcatagattccagtatgtctttagtactttacttttcttgtaagactatagttgcaataaaagaattatcttctttattatattgtgttcatagttcatatcatagtttactagttacgtgttcgatgaatagattatacttcatttatgtgcttcactagcttatgctagttgatctatgctacgataatggtccaatgatcttaacgagttgcattagttctaacttgttcattcgaagggtgagagtcccgggggaattaatgaaattatttattaagatatgcatggtgcttaggttagttaaatgccattggatgcgagtatgccccacggaaagtgaggtaggcggtagatggtggcagtcctctccatccattgtattcctccacgtccaggtatgacgtaagagttggtaaaatgccattaccacgctgacaaaccaactaggagtggtctctcggtagttcttaggtgcctagactaagtcctagccttgtaagcatatatgtatttagtgtaaactaaacattggtaatatagaagtacatatatatggaccttagctttctatagtttttctccactgcctaatgtgtcattattagagatgaatctcctgtgtgacacactatctcattgtcatttatcaattaaccattgttcaaactattgtaaagtaattatagcttgattaagga

SEQ ID NO: 51558 - DNA, 1501 bp, Oryza sativa
caaaggagtcgggcccacctgtcatttgcccatatgattcctttagaaagaaaaataaaataaaataaaagaaaataggaagaccccacctgtcagtcactatagcctgtggataaggttgtattaaaaataaatgaattaggaacagtaccatttcacaattattagaattaattcaaatttgaatctttacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtgccaataaataaaaaaaatggatattgtacagtagcataattatctttaatatgtcttgtcactgtagcaaccaaataaattagttataatcaatccttcaaattaatgggtgtaaaggaaaatattagtgccatttactagcctatgtccaaatataattaattctatgacttataaattatttacataaagtttagcctcatattttctaactaaactataaacacacatagatgaatctttaacttgtttaggagagtaatcacagagctagttgtatttggaccacttaaaaaaattagttgattcaatgtcatgtgaagtagaatatatatatatatagtcggttgatatccattagttaaccaaatagagccatcttaaaatcaacatgtattgtatagcttacagtaaaaagaaactactcaaatatatgatccaataataagatattgttgcttacacataaactatacatcccattatagtggtacggtatagtattaatttgcgtgttgcatatatgaaattaagagagagtgtatgacaaacatgtatattagataaatactagttataaatcttgacctcatataattataattatagtttaactgtaaattaggattattcattgtaaaattatgtgatgggataatctgtaaccataatatgattaacctaaacaactctaacatacgaagcatggataattattaaccttttataatttattgtgacaagtaaaatatgttcataattaaagtaaagcttccatcaataaaataaataatacaaatgattcactgtaattatttgattgatcctaaatccatccgacaacagaacctctagtatacgaccattttatttagatagatgcatgtgtagccataatccttccatagccattagctagactaaaccccaaattagccagatacgtatctcattcatactacattggctagctcctaaatagaccaccatgataacagaaagattaagaaactttagcccttagcatgttggaacccattagcaagcgcgaataatatgagcaaccttaggttcaacctcaaccaatatattttgtttgtgcatatttgaatgttgcttgaatattggtttttctagc

SEQ ID NO: 51559 - DNA, 1501 bp, Oryza sativa
gccaagtgtaatacatgtcccagtgctcattaaccgcgagcacggctattcgaatagatttggtttgctcacactgcagtggatgtacactttacccacactccgcgactgcccaacacatgagcctcgtcccaacacatgagacgcgtcacggcaaagcttttcgataacctcgcattggcagtacccgctccatgaacttaaatcctcatgcattctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatatcccttcgagaagtacggttgtacgggggtcgtttcatgcttaacttcatggctcggtccttaattgactggggacggtactagccttttccagataccacccaaatcctccatccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtacgatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctgaaagttgctgacgttgcctcacaactttccgatccacaaagtctataatacgctagaaaaaccaatattcaagcaacattcaaatatgcacaaacaaaatatattggttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttggggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattataaaaggttaataattatcca

SEQ ID NO: 51560 - DNA, 817 bp, Oryza sativa
aatcccagtacctaattttgtcccctctaacagtcagcagtagataactgtagagaatttcacttatgttactccatctctaatcctatttagaaattgattcaaaaaaaactcttctttttggtttctgtctatatgtcttagagtttccttatgcgttgcacataaatatagcctttatctggcctcttggtttggatactgaaggtaaaacatatataagattaagatgagattggagaggtggtgggctactgggctcctcttccctaactccctaagaccaacttaaatcgtcttgtatgtgcaagttggctggtatttgttatattagaagagattctgtttttctctaaaagattagaaaatgaccgcatgaatgtaacagtaataccatgtattaggagcatgggcacataaaacagttctggagttagaaagcagtcggctttctgatatatgttaagaacacacttgctgaatgttcatagttaattttcatactgtgattacaggctcattttcatcagttactaattaaaaaatgttgttttttaagtgttaccgctgaatctatataggttctaaaagagtatgtgaatttctctcatatttctaacttgtaacctcagtccgccgtatgcttgtgtgtttcattttcttctctaaatcagccggcgacgttgaggcctatgaatgcttgtcagtaacaactcagcactaacaatgctggtgacttaccgtcctctgataccatgagggagtaattgatcatttttgtcttgatttgtgctcaaacctgtgaatcctaatcagg

SEQ ID NO: 51561 - DNA, 218 bp, Oryza sativa
  unsure (1)..(218): unsure at all n locations
agttgaatggcccaatttggagttcgtatgaattagatatgaatttagaagttttgagccatttaaatgaatttctagaattaaactcgatttattgcacaattattatttattttacaaaaggaaatggacttcgctaatgtcacaaagggcgggccggcgccgacacgcgggccccagacgtcagcgagtcaaaggggaagggcgcacggtgnaca

SEQ ID NO: 51562 - DNA, 379 bp, Oryza sativa
actgggttaaaggagatttggtgagagaaagcaccgagaggtacttcttaattatctagaatgactcggtagttcttattgtagtatgtagtttatctccacagcaattgatcattgtaatgtaatgataacatcgcattcctccttgttttccctcccttctgatgtgcattgtagcctaattcttgaccgtcagaagaagatcggcgcctgcaacctaaggaatgtgtgggtcgctgctggagtggcttttgcggaataattaactatttgccactcttacaagtggtgataaattatttatcactgaacccacatatcatagaaacataagggcccacatgttatagagttgaatgtcccgggttttgttggtagt

SEQ ID NO: 51563 - DNA, 531 bp, Oryza sativa
tttcctgtgcatgcatatcctcctagcaatcaaagcaaggtttcagttttgcattattatataaataaaggttcattgcataaggtacttaataaaagaaggaaagaagaagtaatagtttaatacttactatagctttcttcacaggttcactaaaacctttagttttgctgcaatgcaactccttaaagagatcaattgcagtgggctcactgtcaattgcagtgcccatgctcttcccccttagctgcacttgtctactgccagtgagggtgcctaacataaaacatttacatgtgtcaataaaaagatccttcacttgatatgaatgaagcatagcacatataaggacaaaagaacaagaatccaagttacttgccttgttcagtagtgctcaattccattggcttcagttctgtacttaaagtgcggttgctcaattgcattgacgccgcccaatatggccgcccagggcaaaggccccgtctgtggcgcgagaaggaagggttgacgatgatggccggctgcagc

SEQ ID NO: 51564 - DNA, 905 bp, Oryza sativa
tctttttaatcctacgtccgccattgaggctaagatcaagatctgaaggatgctaccaaaaggagttggtagaaagattcttgcttatcaatatggcctaaaggagttggtagaaagattcttgctttatcaatatggcctacaatggaggctttaactaggagtaaatttcaaaagactgcaaatattatgccaaaacttatcaattaattcgttgcaactatagcctagattccacaaagctgcaacagtagctaatgattttttattagaactgcaaaatttgttccactagtaggccaggaacacctgttagggcacccgcaatggttatctataggctctctacaagagatccatgtcagcatattttcctacttggaagagattaaatgaagagagagaggaaatctatctactaacctggagatagtttatagagaaaaacgaggcaatggattagagagctatagatacccatgtagacataccattgaagtggtttactattaatctagtctattgctgagatgtacatgttttatagatagcaccttactttaccattgtgggtgctcttaggcacatctaaagtcttcaaaccagcccgagaatgcagcgccctcagcgttttgcgctggcgtggcccctgccgcgtcgcgacgcgtggacaggcgctggagaatggctggatttcgcgagctctcgtgcggccgcgtcgtccttgcaacttttgcaggaaagcccttcggtttctatgtaattctatcgaggtccctcaacaacagtgctcctgatatgatatttttacatttagttccgtaggaaatccaggtatttcacgcgaagaacaaaaaaacaagaacagggaccgcgctctaaaatgtagaagccgaggggttttg

SEQ ID NO: 51565 - DNA, 483 bp, Oryza sativa
ggcaaggggcctgaatgccggggagccagtgggggccggctattttgcagtggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctaatttggaattaatacattaccgttgcattggcttacacaagaagatattacgttgtagatgtttattgcatgaaagagtaatatgatctagttatttcgttgacagata

SEQ ID NO: 51566 - DNA, 1501 bp, Oryza sativa
taatacaggcttcaaagaaaggctgttgtttttgcaattgattttatttgaactcttttctaaaaacaactaagtgagtgcttctcaaacgacacgggtgagacagtgcgtctcgtccggtcggagtatgtgcaatgtatcagtctttagaattgaaacaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacttcacatccgcccatgaccgtgggcacggctgttcgaacagtttgttaacctctgcagagggggtacactttacccacacgacattactaacccggatcacccagcccgtggggatcggccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtactcccagtacgttccccggtccgtggttttggaaattcatttagttcgcaagcaccgacccaggtgtcgggttttccaagtcttttgtaaaaccctagttttacccaagttgttaatcagatttttaagtttgaaggcgtccgtcgatacccgcacagggtgcacgaatatcgagacgcaactagatggttacaaggggacatgacataacaattaacaaatgaaagatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaagcggggcaactcaacaaacggcaaaaaaaaaataaagccctattgatgacctctaagcgtgccattagatagatctcgagatttgaggaattttggaagttgaacggagtcaaacggatttacggttgggaagatattgaatttctaagattattggatttttgtctaaaggaaaaggatttaattaaatcctttttggaaaagaaaagaaaagaaaagaaaagagggagggaaaatagacttttctcgggcggctagggcgcggcccaagggaaatggagcggaccggccgagctaaa

SEQ ID NO: 51567 - DNA, 1501 bp, Oryza sativa
ccacaacgaataaaagattacgtgagaatatatgtactcctttaaaagactctaatggtgatggcagtaaatttgctacccaactgttcatattgtttttgcagtttttacaaattgtcccctgatatttattaatattgtgaaatgatccactatttagttcaaacaaatggataacatataatcaaatgagcaaacaagtgatattaagatatttgataaaaaaaatattttgctatggcatattatgattcttctgttaatagcaaaatatgggtattttgctagtaagcatgaaatgaggaaagagaagaaaaggacatatttatacacactatataagcgagaaatgcgtagttttaaaaaagcatatcaaaatagtaatgtttgtattagcggagtattaatgtgacgtggatgattaaaaaatattttactaatagtatgcaactatttaacatataaataacgatagaacgttctcttgaaagtttaaaaacaactctcgtcattagatgaaagatctttcttatttgactttacatgaagagagccgacagttcacaaacgcactaccacatacgtattgggacatcccataaaaaatcaacctagtactgaatatgacatatcctactactataaatctgaatatatctctatctagatttattatattagaatgtgtcacatccagtcctatatgcctttttttgggatggaggttgttcgcattggggaaacctgtttacacgtacaggtacgcgcaaattaaacaacatgatgcgcagtactccctccgtccaaaaatataagcatttttagcatagtgacaagtcaaatatttttaactttaatcattaatagaaaaaaataaaaaagataaattgattttactagatttatcattaaataaactatcataacatgtaatattttttatttaaaacatcatacttttatagatattgttagtgaaagtagcatatcagaaaccatgtcaagatttaaaaatatttatattttgggatggagtgagtagtatttagcaggacaagttcaggtgggaaggaagtcaattaaaggaccgaggtacaacgtgcaccagagcggcctcccaattccgaaacaaccgagccagcagtaaaatcagtgaacttcggtgatgtcgaccgtcgacgaagcgcgcgctcgcgttcagaccaatgtcaacctcgtcaatgaagctggcttaatatatgacaattaatttttttttcttaatcttcaactaacagtattatttatttatttatttactcagctaaataatgccatcaaaagtactttaagcatttgtctatttgcaacaatatttttatataagtcaaatgaattaaaaaggacaaccgaggtagtatgtcgtcataagcagcactatcatctactcctaactggagtatttatatgggtatgacagccggcaacattagcaagtagagcaacgaggctagagtttagc

SEQ ID NO: 51568 - DNA, 388 bp, Oryza sativa
cctgcagccccaagaatgtggtagttgaagggcacaatgtactggaattatcctttttctttctctgtaagaacagtttcgtttctcctttttgaaaaatatagaaaagaacagttagtatcttgggagcagaaaaactctaagaatgaggcgtagaagagcccatggtaggccccatgatacaaggaacatgttggaggcccaaacaaaagtaagcccatcaaggtccagtgcggcccattatctatgtcctcgtcgatgccccacctataaaaggagattcattcgtaaaccctagagcttcgcttctccgcagccgccgccgccgccgccgcgttccaccacctaccacccccaccggagaagaagaagaaaaaggagaggaaga

SEQ ID NO: 51569 - DNA, 387 bp, Oryza sativa
taattcgcataggattgcttcttatccatatactctgttctcaaaaccctagccaaactccatccatccactcacccgccgctaccatctactcactctcctcctccatccactgcgccgcctgctctccgcccccagccacctcttcgcccttccccgcctcactcccccacccagggaaggacagtggcgcgcggatccgccgcctcccctcctcgggagcgacggcggcgcatgaatccagcggcctccgtcctcgggagcggcctggcgtgagcgggagcgccggcagcacgcggatccgcccgcctccgccctccggagcagcggcggagggcttaggaaggcgggagcgagcggctacggtggcggcggctgcggcaacga

SEQ ID NO: 51570 - DNA, 732 bp, Oryza sativa
cctcggtgggcggcggctagggctagggctaaaacaaaaaaaaatgaatggaaaaacagggggtgttctaacttatataggagagggcagaactaaaggaggtgcggccggtgggaggcacgacagagggggagagggagtcggactcagataggggaagagagggaggcgcgtgcacggcaaagggagagggggagcggcggccgatttggaggggacaggaggagaaaaaaaaagaaaaggattaggatagggaatttcccaaattggaaaagtatatatttatagcatagtaggagtctctcatgctgttttgtggcgaccccaaaaccctcgtgggtccggaggccacagtactatacctgtgtaacatgcaccagccccaggatacacaacctggtacacacagaacatcggtgatccaaagaagtctaataatattacattgctgggatagtccttacataagttgccatcgtggacagaccccagatggacaacgacacgacacagaagataataacaaaagcgacaacaacggagtggaagcgaacagcggaaggcgacttaacgactaaatgctagtctaggcacctatgcgactaacttattccacaggcatggtttgggaactaggcccgaaaccctaaaagtcttcatagttggcgtgctcctgaagatactcctcggcggttggatcatatccttcttcttcatcttcaaagcctaata

SEQ ID NO: 51571 - DNA, 1501 bp, Oryza sativa
atactatcttcaaaatatattttttttgaatttagaaaaaaaaatattaaagtggcatattatatagcaaatgagaacttaaactgaaattccaaatcaaattcaaaataaaacaaattatagaaatttgaaaagaataagagtaagtagtcaagagaacaaaacttattttgtaaaacatattaattctaaaagaatgctaggaggaagagaaaacatattaattctaaaagaatgctaggaggaagagaaaaggaaaaaacccaaaaatacaaaagaaaataggagaggagggataccaggattccaacctagcaccctagggctcacagcctaagccatcaaccacctgctataacggttttgcttccatatgttgcctgcgcaactatttaaatcgtcgcgatttatttggcgctgagctatgatgactcagcaaattcgtgccaccttggattagagcttagcgccaataaagttggcgctgacacgttatatctcagcgccaaggtctatggcgctaagtccacggcctatttttttgttgaagtttttttctgggactagtttcgaaataagtttttgaaaataatcaatttgttaaaaaaaaggcacctcttgagctagtttttttaaggtgtagtaaggcttcctccagattttttttggggcaaacatatgtatgtgcacaacaatcaataatgccaataattaatgcaggtgtgttcttccgttcttctcttgtttaccatataagggcatgtacaaaggtagagtcagatataagctctagttatctagagactagcatcctacaacagttataaataaaatggtctctaatcattaatgtatccaaatacgttttcttacttttctttcctttctttcaccaccatgcaacaaaatttgctctaataaattctaagagtcgactctgagccgttgtcatgaataacaaccatactcctttctctttcatccatgtcatcaaatttacttgcatggtaatagagagaccactaataaacaccgttgtacatgccctaagagtatatactcccatccataatcatgaattcatgatatctgtcttagttaatttaatttaatttatgttgggtggacgtggatgcgcatgatgagcgctataggcagctgagcacaagatcgatcgatcgatcgaaataattaaaaggaaggaagggatctagtggccggtggatgggtttcaatccgccggtgccgcagaaggacagcgagtgggagatccgggtggctgtgctgctcagcctcctccttcaggtcatcctcatcttcgtggggcccatgcgcaagcgcacctcccaccctgtcccgtgcttcgccatctgggcatgctacctcctcgccgactgggtcgccgacctcgccctcggcctcctcctcaacaacctcggcaacatcggcagcagcagcagccacctctctgccggtgccggcggcggcccgcccatcttcg

SEQ ID NO: 51572 - DNA, 1501 bp, Oryza sativa
cctctgctacaaagtacggttgcaaagcactaccgtactaaccacatgtctaatgggtaaggcttaactcggtgctcagtctagtcctgaacaaaaggacacggatagagatggatgaagtcgttgcaacgatggatatctctaaggcaaatgaaggctacgcgagttacggctcggtaatcgagatgtctaggcaaatgaaggctacacgggccggtgtccgttagtcgagatgtcgtggcactagactagtacgcaggtggtctcacccctatgtgtgtggtgcacccggtctaggtcctgttgctaggggctcaatcctggcctgcctgtcccgggataccggccgtaggcaaggttgggtcggtacttttgttcacggctagcatgggtgaagggttatgtgacatgtttacgacgcgttccaaggccttggaatgcagagtaaagatgtgttttgtgggtaaagatgtacacctctaatcagagtataatctattcgaataaccgcgctctcggttatgggcaagcctagcaatgtacccaagttagtggtttaactcttaaaacttgcttaacaactaaaatgtggaatggttggcctgggttggcttgggacgagctaggacccaggtcggattgccagttcggtttgaatcatcgtaagccttgggttaggcaggttcatgtgggttcacggccttgattaataatattgtgtagctctaggatcgtttttacaaaatagctttgggcaactaagtgtctttcaaatgttgtttactgcaaaacctaacccctattattaccccttgtacccccttgcattaatcatgcatctcccggtgtgacttgctaagtactgtggttgtattcattcttgctctatctttccccccgttcagtaagagaagctttgagaagaagtcctaggtggagtcctggcttataccctagttgagcgcctttgaagatggagccgtaggcccgctagtccgctgctgtttatttttgattgtcaggcctgaagtgaatttgtaataatgtaaatattatcgatataataaagatgtgtcttttgtatcatgtttgtgtggttgttggtatttcttaacgacattactagaaatataattcccagtaatggcgcagaaatacttctggtatattatggttacagatttcatccgcaagcgcacgaacataccactgtagcatttctccttcactttattgtcattctctgcaaaaggttagtagacctaatactagtggaatattattgttctaacaaatttatgcattgcaagcatcactagttctcctttattttggtagtattgacggtcgaaactgatcgataacgaccgtcaacaattggaaaagatgggaataaacctggtcaagccgggaaccctagcgacctaagtggttcagccaaccctagaagatcaaattagagaagctcaagaaagtgatgaagaaatcaatactatcaagg

SEQ ID NO: 51573 - DNA, 1501 bp, Oryza sativa
actctggttgtctttccttatccggaactcatcctatatccgcagtttgtttccatataggacatggtatgtggtgggtcctgccgagatttagtcaactactattaggtatgtggtatccataaccctgacagtagcccccgacttcaatgcaaatgaacaaattcatattctcaaccgcagaccttggagtaactgttatcgagctcacgtgaccgttctcggtgagttcagagataacgttagacttcctttattagcctcgtgcgggcacctaaagggtttgtctgagtcaaatctccgtcgtcaaccaaaaaagtatagagcatacgactaagtctcccatcttgctgtaatcgagaatttagattgaagtcaagaaattttatctcggcgggtacaccatctcttcattccgtaatccttgtcgagatccactaaccgttctcgagtgatcgagaaggcgcagaatctgcgacggagccttgtcaacatttgttgtactcgccttagtcgatcttggtgtagaaccatagagacatgaagtcttcaacaatgtcgaatagaattttcctgaaatcaatactcagaaaaaaatattagatagaaatagcccccgagcgaatgctcaaagggtgacatgttataatatgtatgaaaaattgaaaatgaattaaacttacagaccaatgttttgtatatgagcgtcttctcttttaccgacttcgatcagtcagtttgttgagtcatacactctccttagcccctagccttgtcgtcggagaatcgttctcggaggataaggctcttagaccttcgacctgcctcggttgaataagcactgatcctaacccccagccgtgaagttggaaagtccatttccaattacacggcttggttaatacgcatggcgagaactcttacacgaccagatcttacatggtctttcgtctctacaggatccgacaaggccttatccgctctgggcgtccccagccgaagttcccttaggttcctcaaaggccttgtcaggacggcgtaaagggacatgaggatatgtttcaactataggtgccgtcgtggtaagggatctctgggtaaaacacttggcgatattgtgtaccagataccaactttgttgaggtacaggtagtgggagaatcgctgcacctctggtcaaggactaggtagtagtcataactcgatcacttgaagtagaaatagtgggagattgctacggtttactggttcgagaaccaacgcgtagaattatctctcgagcaccaacggaagtcacggtgtgagggattgctacgggtttgctggttcgaggaccagcgcgtagaattatctctctagcaccaacggaagtcgcggtgtgagggattgctacaggtttgctggttcgaggaccagcgcgtagaattatctctcgagcaccaacggaagtcgcggtgtgagggattgctacgggtttgctggttcgaggaccagcgcgtag

SEQ ID NO: 51574 - DNA, 1501 bp, Oryza sativa
cacccctgatcatataggtggcatgcataattaaataaaagggattaatttaggagtataaaatttactcgtgttattttttttccaaggaatttaaatttggaaatttttatttttatattttatttagaattttttagaaaagaaaaatgtatcctatgtactcctaaaagagagtatcatttatactgtgtttggtaaggtttattagctaagctaatcaggcacacataaatgatatagataattagttgcacgactaatcaattagtaagcatttttttatttacaaaatatatttgtttaatttttaaagaaatttttatatatatattttacgagacacaccgtgtagcatttggatcgaaaaatgtgcttaacgaaaatgaaccgggtagctgtttacaactcagctttgccttcacagctggagcagtaaccaatatattcgcacatgtgaagaaaagaataggtccgtaccgacacagcaaccagccacctccccgccggcatcggcatcacaacagacacgtcacacccattcatttatcacacctaagcaaaacctatccaatccggatgctgcggagtaatcacctacttagagcagtactacaccatagcagactataagccagctataaacttatttcgagaagataaaagataagggagaagatcagcggggctataaatttgtagccggctacagcatgaactccaagatatatgtgtgtatgacaagtgggaccatgtattaattgtgtagtatatgtttaaaggtaattattgtatgaactgactattagattgattatagatgatttggagctatacaggttgactatactattaaacttgctcttagagagagttgacataagcgggctatacaagttgccatgtcagatttttgcttgtgtggaggagagagagaataaaagcgggctacagatctgtagccagctgcagcacgagctctaataaaccatgtgagaaagatgggtagattatgtattaatgatgtagtgtatttctacagctaactattatatgaatgagttattagattgatgccatatttggaagattagcccagggctaattttaagagctaatgtttagtcatgaattggtaggctaaatattggcctagctttttgatggtccccatataaaattagccccattagcatccctgggaggggctaatgttttgaggggggctaattcacattagctcaaaattagcccatctgtttggattcttgagggctaatttgaggctaaaatgtgagggctaaacagtggggtatattattaaaattgctcttagtgactgattaaattaattaccaccccatccattaacttcctgcctgctgtctgatgctgaaaccaatccaacacagacacacctctatctcctttgtttctgttcccaatttctatttcacacacatcgatgatcgatcgatcgctgcacctctgaatcttagct

SEQ ID NO: 51575 - DNA, 1501 bp, Oryza sativa
tttattagaatactcttctaaatacatttatggtactgggatacttcccaagtatatgagtacctactttacattatgttcatgttatactgagtatactgctagcttatctgggagatgctttggtgcggttatagtgtttgctgatgcaattactctatgtcatgacgatgatattagagtagtatctggtagtttagacgtggtgtctagattacgggatatcattatttggggttatatattgcggatgagaggtgggccactgatggtgacagctcagtacgggtattcctccgcgcctatatataatcctaagttattttcctggggagggtattccttcgtatttagcctcggttggatggttatgacgggctgtcgtaaggaactcggtagtcagggatggcttctcgaagtaccaggagggtatcggatagagggtattagctagtaaaccagttaactagaatgtatgtatactatgtatattagaagtataggaatagattctctttctcttttctttccacctagcttagattaattattatgaggatgagtagtaatgcttgtgtgtcactctacccttggattatcttaacccctgcttagaataagattatcacaagtaatatataagttaatagttgagttctctctatatgatcttcccacgggataaaataaatacgatacctttggaatactctcgggtgaaatgctacaatggtatatctgtgcgcttgcggatgaactctgtaaccataatataccagaagtatttctgcgccattgctgggaattatatttctagtaatgtcgttaagaaataccaacaaagctatgggtagttggagggtaaatggctggtttggagtttggatagcaggctggctggctagggtttcatttgattaagccgatatcgaggtaggacgaatattggctggacaaaatatagattttgaatttagatgaatttaggtccaacattcactggaatcggatttacggtttaggagatatgggctcctaaagaataggatttgaattaaatctagaaaatacggaaaggtactttttatgggcccacctgtcagtctttttcccttttctttttctttctcttcttcttcctcccgtctcttccttcttcttctcttccagcacaggcaaacagggaggatggggaggaggggcgccggtggtagagcggctaggaggtggcgactctggaggccagtggtgttcccgagcatcgcgcatcctgggagggtggtggccggcagagggagagaagggtatgtccggaacgggctaggggaaaagcttatctccggcggcaaggagaggtggtggtggtggcttatttcgaagggggaaaggaaggggaagtggggaaatgggtttgcctcgtcgaggcgaagctagtggcgcgagggttgtgccaatggggcaccggtgagggagatcgaccggtggcggcaatggccggata

SEQ ID NO: 51576 - DNA, 1501 bp, Oryza sativa
tgatacatcttagtagcggatctgataccaaatatagggtgtgatgtcacgagacttcagatgtgataccactaattctgatatttatgggttatatactcctattcaacaatcaaataaaaagatggaccatgcatagctaggccagaaagtacagccaaacttgctcatgtgctgctgacatgctttgtttaggctcatgctactagctctagtgcttaattctaactttgctagttgaagcaggtgtcagatccatatggacctaaagaggtgtagaagtagtgctgtactagagtatttcatagctattttgtaatgtaggagaaaagagacctctcgtcagtcgtcactagtcagcagccgtcatgtgaaaggacagtacatgacacgcttttagagagaaaaagaatcggtgagtgattggtaagtataaattataaactataccgttgagacggtataccgtcctatagtttttatcgtattttaatgtatgacgccgttgactttttggccaacgtttgaccattcgttttattcaaaaattttgtgcaaatatgaaaacatttatgtcatgcttaaagaacatttgatgatgaatcaagtcacaataaaataaatgataattacataatttttttaaataagacgaatggtcaaacgttgcataaaaaatcaacgacgttatacattaaaatagtacttcatccgtttcacaatataaatcattctagcatttcccacatttatattgatgttaatgaatctagatatatatctatctagattcattaacatcaatataaatgtgggaaatactaaaatgacttacattataaaaaggaggagtattagtggtagcactattaacgtcaggtttaaaaggacagtagtcaatcgtgccagtctgactcgaatcgtcggtcgttctgacagcagatattttttttaaaaaagtacaagttgtagacttggagagaagattcgccaggttgagcgaaaacctgagacggtttacgtgccagggttggcttcgtgatcccctcgtccagaaaggcaatggaatatactctactgctcctacgcgcacgccccaacccatcggcgaattcggccttgcgatgtgatgcccagtattgcgggcgagcgcgcagctgaaatactgaatcctgaagaatggacgaacagtgagtcgacaaggcgacggcactccgtttcgcgcggtcgcagctgcgcctcccccacccctcacctgctgaccaacctacgctagctatcttcctcttgtcgtcctcctcctccgtcgcatggcggcgcgcggtttctgcaggtataaatagcggccgtgtccagacacgctagtctcacaccaacatacggagttcgagtgacatacgagcagcagccaacacaagctcgatcgaaagttctctcacaagttcagagtagcatttggttagtgacagtaactggtcagcgtctctcaccatgtcgtcca

SEQ ID NO: 51577 - DNA, 1501 bp, Oryza sativa
agaactcgtagacaatgaaaccggcacgatatagaacagtcccggtccttttcgagtaggactctggtagtctccagcccgtaaggacattttccataatgtctatatttccttatcatgtacgaaaacatattgtaggatatgaggtatgtcaatccagtataattggtaaatcgtaggataagaagtactccctccatattttaatgtatgacgccgttgactttttaaccaacatttgaccactcgtcttatttaaaaattttatgcaaatataaaaatacttatgtcgtgtttaaagaacatttgatgataaatcaagtcacaataaaataaattataattacataaattttttaaataagacgaaaggtcaaacatttgtaaaaaagtcaacggcgtcatacattaaaatacggagggagtatgtattatttgtaacctgataaaatttcccatatgatttgattgtaaaaaaacaagaagttattcgttcgtgggctgtgtgagtcggggtggttgattaggcttatgggctttgctttgttaactggggtatatttagttcacgtcaaaattaaaagtttggttgaaattaaaacgatgtgatggaaaagttgaaagtttgtgtgtgtaggaaagttttgatataatggaaaagttgaaagtttaaagaaaaactttggatgtaaactcagcctgaagctcgagaaagcattgaaaatagactatcgaggcttactgagtacttctgactactggagcggcgtacatcctaaatatttcgcatatgttttgggtatgccacagtgcataccaggaacacacatctgtctcttggaataaattcccattaaatcttctaggaaagattaatcgaacgagagctaaagggttaaagaaacattagccatttgattaatgtataatggacggttaaaaatattttggtgtagctgaaaaaatccaagggtgcatagcaattgactgggccagactgatcacgtgcaagtggaacgcatgcacatctccctgcttttctgagaaatccttgcaaccacactggtcgtattcgtatcaatcaggcaggcagcttcgccaacgaagaagcacgtgtgcctaagcatacatcttcttttccactccaatcttccaactaatgaacgaatcgcgtgtacagtactccctccgtattttaatgtatgacgccgttgactttttaattaatgtttgaccatttgtcttattcaaattttttatacaaatacaaaaatacttatgtcatgcttaaagaatatttgatgataaatcaagtcacaataaaataaatgataattatataatttttttaataagacgaaaggtcaaacatttgttaaaaaatcaacggcgtcatacattaaaatacggagggagtaaaatctataatctatttatatggaaatcaggcggccatttaagcaaacagagcaacgagacaatagttttagctatcatgaca

SEQ ID NO: 51578 - DNA, 1501 bp, Oryza sativa
cagctttagaagaggtgggactagagttagagctgtgccatctgtggaccatatatccactgtgatattgaatttattttttataggggagggtccatcacagtgtattgctactgggggccctcacgtgtcgcctaggcgttgcactgatgccagggcctggcacacccccaaccaaaacagcttttaaaagtttgatgatttctcatgctgaacgctgatcctctacgtctgtttaagttgtttactgcaggaagagttgagttgagtactgatgttgagtgccattaatttgctacgaaattggtgatccatgaaactcaaaatttcggatagctttcgtcgtaaatttgctaaaaaattggtcactgacctgttgacccatgaacaaaaactctgcaagagtctgcccaaaatctagacatcgtcagagttcagacttcagatgtgtccaactcttataagggcgtttacaatatgcggacgtggcattcagcctccaccccaaaaaccgaatattccttgccacatcatccaaatgcacaacttccttagctcctagtagccaacattggctacccgttcttcgtctccggtgggacccacaggcgggctagaggagagaggggagatgggcaaggcagcagacagggatttggatcgtctgccttcgcagagtgaaggcacgagcatgcagtcagccccttatccaccattgaagtaatccaacggctcacgtcgcatgtgcgcttaaatagacgaatgaatttgtctgtgaaagaccacgatggttctatcgcaaaaaaaaaaatcccacgatggttgttttggtctgggaagtgtacgcgagctaaagaaacttacaaactatattagtgctaatacacatgaaaaaaaatggatgatatcaccaaattaaaaatacaagaaaactgaaagtttcaaataacaacactaattcattacaaagtagttctccatctttttcatattataagtcatttgactttttttctagtcaaaaatcgttaagtttgactaatttatataaaaaatagtaatatataaaatatcaaattaactttattaaatctaacgttgaatatatttttataatatatttgttttgtgttaaaaagtaaaaaaaaagaagtttgactagaaaaaaaagtcaagcgacttaggccttgtttagttggagaaaatttttgggtttggttgtcacatcggatatacggacacatatttgaaatactaaacgtagtctaataacaaaacaaattacagatttcgctaggaaactgcgagacaaatttattaagcctaattaatccgtcattagtaaacgtttactgtagcaccacattgttaaattatggtgtaattaggtttaaaagattcatctcacaatttacacgcacactgtgtaattagtttttttttccacatgaaaagtttttattttgggaactaatagagggagcatgacgcaatgtcaagt

SEQ ID NO: 51579 - DNA, 1501 bp, Oryza sativa
ggatgaggagctccttcaccacccacgacccaatgaagccacctgctccggtcacacagaccagctgcttctcgccattgttgttgttgttggcctcaaaattggacgacatggtgagagacgctgaccagttactgtcactaaccaaatgctactctgaacttgtgagagaactttcgatcgagcttgtgttggctgctgctcgtatgtcactcgaactccgtatgttggtgtgagactagcgtgtctggacacggccgctatttatacctgcagaaaccgcgcgccgccatgcgacggaggaggaggacgacaagaggaagatagctagcgtaggttggtcagcaggtgaggggtgggggaggcgcagctgcgaccgcgcgaaacggagtgccgtcgccttgtcgactcactgttcgtccattcttcaggattcagtatttcagctgcgcgctcgcccgcaatactgggcatcacatcgcaaggccgaattcgccgatgggttggggcgtgcgcgtaggagcagtagagtatattccattgcctttctggacgaggggatcacgaagccaaccctggcacgtaaaccgtctcaggttttcgctcaacctggcgaatcttctctccaagtctacaacttgtacttttttaaaaaaaatatctgctgtcagaacgaccgacgattcgagtcagactggcacgattgactactgtccttttaaacctgacgttaatagtgctaccactaatactcctcctttttataatgtaagtcattttagtatttcccacatttatattgatgttaatgaatctagatagatatatatctagattcattaacatcaatataaatgtgggaaatgctagaatgatttatattgtgaaacggatgaagtactattttaatgtataacgtcgttgattttttatgcaacgtttgaccattcgtcttatttaaaaaaattatgtaattatcatttattttattgtgacttgattcatcatcaaatgttctttaagcatgacataaatgttttcatatttgcacaaaatttttgaataaaacgaatggtcaaacgttggccaaaaagtcaacggcgtcatacattaaaatacgataaaaactataggacggtataccgtctcaacggtatagtttataatttatacttaccaatcactcaccgattctttttctctctaaaagcgtgtcatgtactgtcctttcacatgacggctgctgactagtgacgactgacgagaggtctcttttctcctacattacaaaatagctatgaaatactctagtacagcactacttctacacctctttaggtccatatggatctgacacctgcttcaactagcaaagttagaattaagcactagagctagtagcatgagcctaaacaaagcatgtcagcagcacatgagcaagtttggctgtactttctggcctagctatgcatggtccatctttttatttgattgttgaata

SEQ ID NO: 51580 - DNA, 1501 bp, Oryza sativa
gagggccaggtcaatagctggatcatcgggtgctcgccatcttccgcggtcactcgtttgacggctggtttggctgtatccgtaatgtcagatcctcattttaatagtagtgcaaataagtactcctggtatcattttgttttttttttcttcctcctatcacgtatactacctggcaaatatctaacctcaaatacaacgtacacatattcatcaccataagtagtacctgtggaaatgtgaccatcgatgtcgaacaaatttgtcatggcaggataattttggggaaacaaatccggttcaccaggaaagggcagtacttctactaaaattattgatccatgcgtcagaatttcagtggaacgagttgtttctgtatgcgaagcggggcgcatgggcagtgcaggtgcagcggtgtggtggcgcccgtgggtgcggctgcggtgagatgcggaggttttgaccaggagaagcgaccggttttgtggtggctgccgcggcctctctgcctaacacgctgccaaaattaactccgacggcgcccacacatccacatggccctgcgcctgcgactgcgcgtcgtcagcggcagcacccccgcgacacatggacgtacgtcggccccagcacaccacccctcttggcctttggggccttgggcgatcgtgcgacgcatgcacacacccgggcgcccgagtgcaccctgtcggttggaagtggaaactgtgggtgcgcgcccacgcatcgaaacttgcgcccgctttccttcttccaaacttgtaaaatggggtgaattctcaggtgcgggctggcaccggcgacaccggcgacggcgaggcagtttgggccgtcgtaaagcgcaaccagacgcacccaatgcttccttcgatcggtccgtccgcttgtcgccatcacggcacgccctgacgctccgcacagcagctaaaaaaagcccctccacaatagaccaggcatcggcgaacagaaaatttaaatgctgccgttttttccaattcgaaaaaattcgccaggtgcatttcgatctgtccaacggcgtcacatttctgattcaacattgctggatgctaatccaatcagtaatactaaaaccaaactattagaatttgcaaagtatcctatcgtgcatgtatctccaggtgagaaaaagatcacgcgaaaagaagcaggataataaaaaagaaagaaatggaaaaagccgggcccgccacagcaggcacacatatccacagtagacacctcaatcccaactgtccccacacatctcccgatgccaaacccccgccaaaatccgcagtcaataatcccctcccctctttagagactaaacacagaattaagatcgctaatcaccacccttaatcgcaccaaaacccgttcatcccacccctacctaccttataacagcctccctctcccctcaccccgctctcccccatcatatcatccccaaccctaacgcgcgccgccgccgccgccatgg

SEQ ID NO: 51581 - DNA, 395 bp, Oryza sativa
agagcgatatttcagctaagctctcgtctcgtcttctggcagatgcccatgggagttttggttagtggtggcttgtgagatcggggagatcgaaggctttactgcaagctgattcttgcatggcaagagctcgatggattggagatggaagaagaccagctgctgcgctgccgcttctcggcctctgtgcgtttctctgcgccgttatgctcgtcgtgtcgctggctcctcctccgggggaagaagaagaagaagcaaaggtgaggtcgtcgtcgttgccagcggcggcgacgtcggtcccggccggtggacggcgccttctgctgccggcggcgaggacgaggaggttccggccacggaggtggaactcggccggcatcgacgacagcaagcat

SEQ ID NO: 51582 - DNA, 696 bp, Oryza sativa
aaaaccgggactaaagatcgatctttagtcccggttttttcacccgggactaaagatacccggattggtagtcccggttttacagggggttacgaaccgggactaaaaagcacttctccaccagtgtatgataatctagcatctatgtatcacatactagagtttctaagatgtagtataaccaagagcccaacatgacatatctaattagaatccattgtatccatatataatctaggtaattatttgtctggtctaatccgtgcatggtataggacacatgcaaatagatgcaaccaatcttagacacatagctaggctactaggctctgccataacaagtaccctacataactagggtacgggactactagtagctattacagggatttggtatgcacaacaagctagtagtacctccggttttatttactagctaggctagtatcaaaagcaggacttaagcatgctgagtactagctagctgtcaggaacaaaactatacactgatacacacagcaaatgtgcgtgatgataatcctagcagcacgcgacatactcgggagaagccggcacgtggggccgcggcatggaggataagtggtataccgttcaacggtataccgttgtgtagtctttctctaaaatacggatggagtatgttcgagggaatttgacgatatttaaaatttatca

SEQ ID NO: 51583 - DNA, 1501 bp, Oryza sativa
ctggccctcttttcggcgcgtcacagtttaacttagcatccctaaaaactgccacgatcacggatctagccagctgcttaatgacctgggagagtgattacactgagcagtgggtcccatcaccaatagaggtccgtgggcccacgtctattttttctgtgcagatttccttcattctctttttcagcacacacgaaatcgattttatctatcacaatatcttttcttaccaaactcagcgcgtgtgatcttcttttctggctgctttgtttgaagagaagtgcacgattacagtgacgtcgttagtatcgatcccagatgaaagccggatactatattatcgccattagattagactatttgtttcacaacgcatgtggcaagccagttggtagttagcaggcatgttagccggatggattctggcaggaagttgtgtggatggagtatattagtagcactccttgcacaaaagatatactattagtagcaccaaattaacaatgctggttaatccatccgggcaatgtaataatgtacacctttgtgtttccaaccaactaatgcatgtgtgatcgagtagcagggcctgtgtttttttaagcatgcaaagaaggttaaagaaatcattagaaacctgacaatcaaggtgtctaatgggcaaccaagcaaagcaagcgagtgaatcctgcatcaccgttgcatagctggaaaggataactgatgatcctacatttttaataactgatagaaagtggcgtgccgtgggtgacggcggccatgattagctgtgcataattaccactttacaagattgctaatcagcgaaatcatgctgtttttttccttaaataaaactgcagaaaatttacgtgcgtacgtgcactttaaagcccaatcagttttttttttcggatttactcggctacagtttctgtccatgagaccaggggagaggcattgaccgagcgtcatctccttaatgggcccacgtggcagtcacagcgaaatatgggcccaccaggccggggagtggggagggtgacgcggcatgcatttgagctggtggcgtacgagcggcgcggcccacccaacacgttgctgcatcatctctccacacatatgcgttcacaggtgtagtaaagttgactcggtaaaattgactaagtaattcttactgtaacttttttttagaaaaaaaagataaatttaataactgttggttacttcgtgttagtgtagtattttcacgattgataatgatataagccgacaatattattaaggatttaagggcgtgtgaaaagaatagtggacggaatggccgaataggttctccgccaaagaggagatgctgctgatcgcaaagaagaggagtacacgtacgctttgcctcaatgagatttagagagcgatgtgcatataatgtgggtctcgattagggatggcaaccggggacccataacccacaacccgatgggtttttactctattaggagac

SEQ ID NO: 51584 - DNA, 164 bp, Oryza sativa
ctccctccatccttaaaaaaaaaaagtacaccaaaacgtctaatattagtttgggtttttttcgaaggaagtatatctagtgcctgtaacagtagtatgtttttaaccttgtccacggaccgttagatctcctccacgcccattcaaccgagcgatcacggcca

SEQ ID NO: 51585 - DNA, 1501 bp, Oryza sativa
gtgatgtgctaacctatttgacaacaacagttctttaattatagcgtcaagtttcttcatcaacattttgtatcaactctaatttgtcattttatttgcctacacagaaattaaagacaggtgtggtaaagaagacaacaaacccagtttggaacgaagagctgactttagctgtcaggaatccagaaacacctatccagctagtaagcatctgtatctctatacttatatcaaatgctcaaacactaaactaagtagacagttcttaccactcttactgaatttttttttcaaaaagacaggaaacttacgatataggctgcctctttttctcaaacaggaggtatttgacaaggacacattcagtaaagatgaccagatgggtgacgcagagttcgacattgaggcgctgatgcaaatcgtgaggatggatctgcaggacatccgcagtggcaccgtcgtacgcaccgtgcgacccggcagacagtgctgcctagcagacgagagtcacattgtgtgggagaatggtcagattgtgcaagacatgcttctcaagttgagaaatgttgagaccggcgtggtgcacctgcagctgaaatgggtgaacattccaggtatgtactctgcacaattataaggctggggtgctggattcggactcatgatacgtcaacatttagcataatagcactagatggtcaagtacaaaagatttggcataaagagatcaaaagattagaacagattgtccactgtttactattattaccggattcatgctagaaatgatgcattcagattagcaaaacaccattattattaatcatgttgaaaccagtagcaggtttaatttgtttaacatttttattttatgatttatcttgttgaaccaatagcagtaatggtagaggatttgtatcaataacaacctgcatgacatagtgttccaacttgaatcttcagagagtaagcctgttgcaattgaatcaagagtatttggacatcgatcttacgagaaaaagaaaagagtatcggacatccagtcttgtccattgttcattgctattgcctaaaatcctagcatctttcagactaacttttttttaaagataataacggattaaacaatccagcctacacagccagtctttcagactaagtagtaattaggatgattttatatgctatctcttgcaagctgcagcagttggcaaaggtaatctaacgaattttctttcacattaggctgaagaagaatctgaatttcggtacattcatgcaaaggtaaaatgttatagagtaaatgtaatattggctttattaagttttcctcctctagacctgttgatcattcatcggcacatcggaaactaatctaacataagcaatttgatggtgcagatattggttcctcaaattggtgaagaaaccggtgttgttttgtttcagcattttgccatacacattaattgttgtgttgttcttcagactgtatgtagct

SEQ ID NO: 51586 - DNA, 1501 bp, Oryza sativa
tgtaaaattgatgttactagatttattattaacaaactatcacaatatgaactctttttatttaaaacctcttacttttctagatattgttggtcaaattagcatctcggagaccgtgtcagagtccaaaatgcttatatttttgggacagatggagtaaaattttaaaataaaacatgatataaaaaattaatggtgccatatattaaaaacagaggtacgaagtagtatttatttatactatcatctgaatagttgaataatttttttactagtagtagaactcagagagcttattgtataatccctccgtttcaaaatataagcttttctaggacttctacatggtcttcgagatactactttaacaaacaatatttataaatgtaagatgtttaaaataaagaaagttgcatattatgatagtttctttaattctagtaacattaattttacatgattaatcttttttttttgctattaatagtcatagttaaaaatgtttgagtatgttaaaaatattatattttaagactgagatgctaagttctcaattacagtaaagttggaaggctgatttggacaaaatgtagctctaatgctgagtagatatcgtcgggcgagataacatgctgacatgcatgttcccgatcgagtccagtttgaactggaacaaaaccatgccaaagtgacctaacgattttgatattagatacagcaattggaccgatggtcccaaccctaatcacgcctaaaagatatttatccccatcaaactgtctagttagctgaattcatctcgatccttttattaattagttttcgagttttcgtcgaaaaagacaaaaccgcctcttgttaatgttaatgggtctcgtgcagtgaatgcaactctggttcgaaatttcggacccccggcaaatcattatctcgtctaaaattttcgtttttttaatttggttaaaatttattcaaatttagttaaattatgttaaaattttaaataattttggtctaaaaagggctgaaaatcctcaaatttcgggggtttcaatgctactgaaatagtcgaattttttagcaaaatcgaaagtgaaaactctggtcatgcgacgaggcgcactcctactcaactcctactcaaattcaatggaacatatttttctgatttttcagtcacttacgcatccgcgtcctgaacaacaaaaccaagaaattagcagaggggactgtaaatttgcacgcgtgaggcgggtgagtgacgcacaaattaaaaagccacgtatgtgtagcactacaacttcccatacgttcttgagatggagacagaaaggcgaatctacagtatagagtgaccttgcaatgcaacactagctagagctcacttctctgtatatatatatgcagctgctgctcatcgccaaatcgacggcaacaactaacgattgatcgccatcaagtatagctatagctagctagcttgtgaattcatcaatggaga

SEQ ID NO: 51587 - DNA, 409 bp, Oryza sativa
tttgttttggttcgtttcctacttttcttttctctatactttcccatttttttctcttgttggtgacctcgtcacgagttgccgcacgagctttgctggtcttgcgcttgcagagaccagggaccccgtcgtgcgcacgttcgccacgcgttaactggccatctatataacgcatgcttcctactcatcatcatccaccacaacatctgcaatcagcagcagccagcagcagcagagctcaccatcacttcggagtttgtcagtaccaaggcgaagctaatcattaagctaggggcctagggctcgatcgatctctcgtttcggagctttgtcgatcgtgatcgatctctcgaggccggagggagaccatcagccatggcgtttaggtgtaagggcggcgtcgcttggg

SEQ ID NO: 51588 - DNA, 1068 bp, Oryza sativa
cggacgtactccctccgtcccacaaaaaaagaaaaaacctggtttccgtgtccaacgtttacccgtccgtcttatttgaaaaaattatgaaaaaaataaaagacaagtcacgcataaaatattaatcatattttatcatctaacaacaatgaaaatacaaattataaaaaaatttcatataagacggacagttaaagttggacatgaaaacctatagtttgtctttttttggatggagggagtaatcctctattagtttctcatcaatactagtagtacgtactaccgctagtccgctactagctaaccgtgcctctggccttttaagcaatactccataagcaaggatcattaatacagaacatcacatatgtattgcctcatatgtaccggttcagaatttctagccatacaattggtcaaagttgagattctttagaaaaaaaactgatacatacaatggtgccactcatatatgtatttctaaactaattttttcatataaagttggatgaagataaatatattaaaattgtagagctaaaactttgtaggtgatgactttttatttgagattatttagatgtgcgaaaatctgctattaagtcacggatctatttggataagtgaatttttaaagttttcaaatgacttatgatgaatacaaaatctatataaaagttatagatcttgtcgatatctacaactttttggttgacaatatttttatttgatcttgtctacgatatctaatatgtattataagcttcatatataagagtagtcaaaagaataatatctgcaactaaaacaacaaatgcttaattcgtgaaatggtaaggaggcttcttaggcctcctttaatggttgagctagtgcactagctcatgcttgtccacctcatacaagagatagcaaaaagtctacctttccaatagattgtctcatagcacattgtttaaaatgctttgggttccacaattcctctcacattttctttaggagcttagctcttgaagaagagatagtgtattctctctccttatcttctctttcttccacatcaga

SEQ ID NO: 51589 - DNA, 198 bp, Oryza sativa
ctgtggcatactccaacatcttctggttttttgggaagctgggaacgaagaggtcagaggtgaattttatagctctctacaccctcttttcacaacccgtgcgatgtacaaaacattcatctgtattctgtctcaaattttgagttcattacctaagttatatgtgggcatgtccgcatgtgatcaaagccatcagca

SEQ ID NO: 51590 - DNA, 640 bp, Oryza sativa
tgccaagattacacgcggtggacaagaatgaccgatttgcgaccggtctgacactgaccatatcgtcagcgcacagccatgctcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctgacacttgtagctcattcatacacagatccaccaaaacacaggagtagggtattacgcttctcagcggcccgaacctgtatagatcgtcggtgtctcgtgttttctggctggcagacgatatttccacatacagagagagcgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaa

SEQ ID NO: 51591 - DNA, 1501 bp, Oryza sativa
cgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtgggtagtactcagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttttgtaagacctttataatgtttgtaagacgtggatctgtatgtcaacattgtcgtttgtgtaccccggctggtcctggacgggggttttaatacacattctgcttggaattctattcgggaatttctgggcgcgacaagttggtatcagagccgaccttgaccgtaggacaagccaaatggaaagacctaagagccctctgaatccttttcattgcatatcttctttgcaattggattttgtcccgggaaaatggggatctgttcttgtggttcaagggaaaaatcttgtcgcttgtttaagtgagatttttcaaaacgagtcagtctagggttttagtaaaattattgggagtttttcggcagtcagttgggatgtgatgggtgaaatgcattaggtcctagctcggtatcatgggttgcaaggtgtttatacttcgtttgttattattaatatgtatctaatttctcattattttatcgttatgtgagtctgtcttatttattcgctctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggtgaaggcatgatcgactttgtggcagagctggcacgca

SEQ ID NO: 51592 - DNA, 1456 bp, Oryza sativa
tttagttaccaaaagtttttcttaaaacatcacatcgaatctttagatacatacatggaccattaatatagatttaaagaaaacctaattgcacagttaagggggaaatcgcgagacgaatcttttaatcctaattagtccataattagccataagtgctacagtaacctacatgtgctaatgatggattaattaggctcaaaagatttatctcgtggtttccaggcgagttatgaaattagttttttcattcgtgtccgaaaaccccttctgacatctggtcaaacatccgatgtgacacccaaaaattttcatttggcgaactaaacaggctagtaacttccaaagttagaagtttggtttgaaattggtatgatgtgactgaaaacttgtgtgtgtatgataggttgatgtgatagaaaaagttgaaagtttggatctaaacacaaccctttttgttctaaaaaaaactccatccatcccataatgtagcaatcccagatttgtagtcctaggatgggtctcatcccatcctagattgctacattatgggacggagtatctttttattttaaatattttaatataaattaagatttaagtaaaaaattactatagtatccttattaagtaatatatataagttatgattggattttggtagttaaaggatagtataatagaaaaaaattaaacgaaaggagagacaaatgaaataagtagtacagtactttagagtaacacatattttaaggtaaaatttaaatagtagaaagataactattttgggacagtggtaacactcacttccttggtttttaggggctggttggatctatacagaggttgccgctatgtgccatatttttatgtttgcctaaattgcgattaacaaaaggacactgttacaatacattctactacaaacggtgtggtaggatttaaatctaactatcgatttttatgagtataaaagtattttaatctatacgcactatcaaatgtagggtgtgtttagttcacgctaaaattgaaagtttggttgaaattggaataatgtgatggaaaagttggaagtttatgtatgtaggaaagttttgatatgatgaaaaagttggaagtttcaagaaaaactttagatctaaactcgaccgtaacagagtacaatcaaatcaaatccattggatctaataataaaaaattagatggctcataattatttataccttagaaaacccctgataaaaagcaaatcacaaaagaatattgtgcctcacattttcaaattgatgacatatatgctggaatcctgctataaatatagctaagtacggctaggaatgaattaaagaattaaaatggtatgataaacttagccaatgtttggaagtaaaccaaacatccccttaccatttgcatggcacctttaatttggctgtctcgttttataattaga

SEQ ID NO: 51593 - DNA, 1501 bp, Oryza sativa
agggcgcaggggatgtagcggttcagcaccggcccccgtggctggaagtagcagccaccaactaccgatggcggcgacaccgactgcacagtgaagaaccaccggaacagccgaagagatgggcgcaccccaataaacatctcgcacagatgcgcgaagatggccaatgtcatcaccgcgttgggggtgaggtgcgccatctggagatcgtagaactccagaacatccatgaagaaagaagaaaatggcggaactagccctgccattgcaaaggggagaaagaagacggaccgccccgggtagtctggcgccgggcgtccctcgcccagcgtaactatctcccggccggtggcagattccggcatgaagcggcgcggcagcccagcctgcctctcgctcacgatgcgggaaggcggcagcacgctaccatcgagcagagcggagccccgtgccatgacgccggaggaagagaagattaagagcgagcgcgtgtggcgagggtagggcgcaggaaagaaggagttagggcgcaagcggcgaagacaaggggaataatggcgaaaggaaggaaacaaatcccttcctcagtgcctttatacccttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgaggtagatcatatcgtgcgcgcgttaattacgctcgccaaccgaagcgacgttaccatatctccagatgaaacgaatcgccatgtccagattcgtgtgctactcgagtaatgtggcagtcttgaagagaccgctcattattgacagccgagttaccattgccgatgtgcgtgatttttgaccgttgggtttctgcccaattgtggagaccggtcccacctgtcaccgggccttaggagtggcgtcacgcccgaccgcttcccttaaggagggcgaacgccctggcataacgccgagggctactgtcggtgacatgggatcgggagtatcatgactagaggtttgaggcagacataatcgccaacgtggcctggcaccctcgggggacgttgggcccgagggtgatgtgttcgccctcctcttagtccccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctga

SEQ ID NO: 51594 - DNA, 1501 bp, Oryza sativa
cgaacacaccggcctgggagatctgcttagctccagtgcaggtccaaaggttgttgagatgcgggcgtgccagtcagtttgatcctgcaactgataagatatgcaaatagtatatcaaaatagccgattggctgacaagctgatggagcaatctcagccgatgccgataccagccgatagcgatagggttttagcaatcggctatatgtccaatgatataaaggcaatcggctgatgatggtgtaataaaataacaatataatccaatataaaccaatcggcaaataattatatgataaataagcatcgatccgaaggttaaagcacacatcagctggaggtccgatgtcatgaaatccacaagattagattgaacagtgaaacctttgttgtcatcggctaaatccaacttatatgtatacgctatccttataagccgatgcaacgtccagataactcaccggctgaaaccccgatgaaacccttattggcaatcaagaagcaggctagggattatggttctaagcacgacttagtagatcaaactcaactgatgcagcactaagtatgaaaagaaacataatatctagacaatcaagccgttgactgagttttcagggtggtagatatctaagctaatctaacctagcaacacgatttagccgataccggcagaaaccctaaaacgagaagcagccgatagagctaaattgatatgctaagactagattaacataaacatatgataaataggtaggcaaatatatcatccaaaccagagcaatccaagaggtcgaatgcactgatgcagccttgaacgacaccgacgtaaacgatacaattgcctgggccgacggaacattggacttaccccttcgccggagatcgaacaccgatgcagccctacgtcaggtgccaagtcccgtcggacgataaaataaagtagaaaaggtaaaaggtggcgatgcgccgaattgtattgatcgtgaagatagattacatagaccctgggtgtacatatttatacctatgggttgatacaagtccttgtcggacaagaaagaaactttcctaaagataaaaggaaaagataaagtccttataggacactgtcggtgacatgggatcgggagtatcatgactagaggtttgaggcagatacaatcgcccacgtggcctggcaccctcgggggacgtcgggcccgagggtgatgtgttcgccctcctcttagtccccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccggtctgtgaccagtcacagaccggtcagatcgcgggttaggtggcgacaggcggtctgacgcacgcctcgccccatcccgtca

SEQ ID NO: 51595 - DNA, 1501 bp, Oryza sativa
gtcaaaaagccctgcagatcgctgaggaaaatcattagttcccatcgaccggctattggctactgatgagaattcgagagtggcaatatttaagctagatgggtagagatggacaagataatgtgatactacaacttgcacatagctgctctagaaagaaagagaaagtgatcgatcgagagcaagcatgggcaacgttcgtctcaatcctatatttcttactaccttacccatacacgcgttttggtacataaatagtatacatacaactccaaccattaagattcaaactattacaaaggggattgaattcttctctgttcaccacctctcgagcttgctactagctagctttgtccctagctgccctcttttttttcaggcacgatatattacaaggtaacttataagaaaaaagtccaaacctaaataaataggcaaatttttcgtttagcttttataaaggcacaagtcacccttatactgttaagctaaaactaagttggagtaacttttttttcgcttgtataaagtggaaaagtgacaccaccacaatgctatagatttgatttttgcggacaatgccctttccaggctacagacaggccgtaactgcctccgcatgtaaaaatcactttatcggggtagtttaaggcccgtctgtggtaacacattatcacagggccccccttaagagacccgcctgcgataatgggtgcattatcacatgagggcatcttaaagggccgcttgcgataatgcggttattgcaagcgggcccttaagagtcctgcccgcgatgatatgcccatatatttgatcccaacccgagctaaccccatttcaaccaaaagtttatctcttcaaaacaagcaacaaatagggtgggggaggttttgaactttaaattgatatacaaggttatatacttccttacctcctccatttgccgccatttttttaaaaaatatttcatcggtgcaatgcggagaattttgcagttttagaagacgactcttatgagctatttttgcaaattttaactataatagaatatttagatgagcaaaattactattgtaagcactagttttcatgctagttcaatgtaatggtgcattattttcgaggagatgcgtgtatttttcatgttttggtggaaaacacctatagtttaattttattcgtgtcgtgattatttacagatggatcagacatggatgtacgagatgcgaagaattcattcatcatattgatgattatttacagatggacgagaacagttctactcgtattgatgattttaaagctctttctggtctgggggatatgccacgtcacgctaaaccaaaggtgctaatgggttcagcgagaggattagataattaggagacgttagtttagtcagcgaaggatcttctttacgacgaatccaagggatgtgagaaagattttacgatattgccttcgatgcttgaacttctcagattgaagaccagac

SEQ ID NO: 51596 - DNA, 625 bp, Oryza sativa
taacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttgcatgcgtcgtgacacactcagccaatccgcaataaatgtggttaggtgagccccactgtgctcacctaactcatacgcgcggagcgaaaacccacgaggggtcggggcgcctcgaccctcggggccgaggggggtgcagcccgaccccctcggggggactaagaggagggcgaacacatcaccctcgagcccgacgtcccccgggggtgccaggccacgtgggcgattgtgtctgcctcaagcctctagtcatgatactcccgatcccatgtcaccgacagtagcccccggcgttatgccagggcgatcgccctcctcaagggaagcggtcgggcgtgacgccactcctaaggcctggtgacaggtgggaccggtctccaccattgggcagaaacccaatggtcaaaaatcacgcacatcggcaatagtaactcggctgtcaataa

SEQ ID NO: 51597 - DNA, 311 bp, Oryza sativa
agggccaacgtgcagattgctaagctgacgcgtggtggacaagaatgaccgatttgtgaccagtctgacaccggtcatgtcgccagcagaccgccatgattccgcgtcgcgcctgctcccggcgaaagtggaggtagttgtgggccgtcccatcagaaggcgactcggacggcaacgatgcaaatctccgtccatttatgaaaaggtagagtaagtccccagggagagggggagaatggtgcatgtggtatccccttaagatatgaaaggaggaccttgcccactgaggagaaggagagattttcgagagc

SEQ ID NO: 51598 - DNA, 252 bp, Oryza sativa
catctcaatcggcttctaggaaattaagatataaggcgttgaagtacactcgattggatgatgagctttattatcggacgattgatggagtgttacttaagtgtttgagtgccgatcaggctaaagttgcaatcggcgaagttcatgaaggaatttgtggcactcaccaatcggcccataagatgaagtggttacttcggcgtgcagggtatttttggccgacaatgctggaggattgcttcagatattata

SEQ ID NO: 51599 - DNA, 1134 bp, Oryza sativa
atatgatcggagtatctaatgatccagagactaagaaattcaatggaacttgagtctctgtgagaggatgaaattcttggttcaaaaataacggaatatccgatatgacatcagactatccgatcgattggattgtccgaaattctctagaatttcgttctctgtctctggcctgcttgggggtcaaaaacatcggactatccgatgtcacctcggactttccgaggtgggatgaaaagattctctcccaacggccacattttgggggcttctatgaataccccccacctaacccttttctagggttacccaactcattcattcacattcactttgggttgagcttggtgctaaggtgctttggatctttgagctctctctccctctctcaaatcccctcttgttctttgtgtggtggatcttggtggttgtggatttggggtttgagggcctagtgtgtgtttcactcgatcttgagcactagggttgaccaagagttgtgtgatgtttgttactcttggaggttgaggactcctagacggctaggtgtcactcccgagccaccgatctacatgtggttggccgggagaagtttgtgaaggccggatctcgcctccacaaggaaagagataccccttagtggaaggaggagtgcttagtgcaacctcttgagaaaagggttagcaaagacccggctcttagtgagctcctcaacggagagtagaatcccctcaaggatttgaactccgggaagaactcggtgaacttcattgttggtgatatctcttcttccattatttagctttgttttttgtgccgctataaatctagtcgctgtttgggccatactcttgtttgtgcactagatctacttgtagtgttcttttagtggatcagacagtctgatccaacatcagactatctgatattttcggatagtctgactgtggatcagactatcagttttagcttcggcataaagttttaaattagcctattcaccccccctctaggcctaattgaccttttcaattggtatcagagcctaatctccaaattaggctaaccgcttggagggatcatgtcgggccaaatgggggaaggcaaagatggtgataagggagctaagtttcc

SEQ ID NO: 51600 - DNA, 468 bp, Oryza sativa
cctttccacagaaggcaacttaaacttccaccttgtaaaacccgacaaacaattggtggatatcttcaccaagcctcttgatgaagctaggttttgtgagttgagaagtgagctaatatcttggatttcggaatgtggcttgatcttttgcatgcatttgtttttcatttactagaataggtttgcttgccacatcatgacaaagtgaacattcaattcatgaataaacactagtcataatctatgaggataacttgaatctatgtgtacggggatctcattctctaatgaatcttggtccttgcacaatttcctatagattcgtacattccctctcttgagggtgcctagttttctttcttttgctgcatttgtccaagtaatagtctagccgagttcatcctataaaaatgttgttgaaaaaaaaaatcttccttgagccatcctttattgtctctgccacaaagg

SEQ ID NO: 51601 - DNA, 1501 bp, Oryza sativa; identical to SEQ ID NO: 50670

SEQ ID NO: 51602 - DNA, 1501 bp, Oryza sativa
atggtcgacgacatcagcggctgccaaagcggtggcctccgtgccaatgctagtagaggcgtagctaacgggggatggccccaagaatacggagatccgaggcggattcatggatctcctatctctccacccctctaccctctcggttctcactctcacaagtagagcggtggaggaggaggtgaggaggatgaggagaggagagaaaagccgagccgacaaccaagtaggtcgtgccgtgctgggcatggcccaacggccaggctaggccaacatgagcccaacaacagtcgggccgtgccgttcttggactaggtcaaattctagtgccatgtgccgggccatcgggctgcgggccttttggcaaactatacctgtagcaaaatttaccaaaagaaaatgtagcagaattttccaagccggacaatagcttaaaaaaatattgtaaatgatgatcagtcgattcagtaaatatacgaacaatcgtttcagtaaagtaataataatagtaaattgcatcgccggtatacaaacttgtcaggtgggtataatttagtgcacgaacttgtgaaatgctcgttttggtgcatgaacttgtcttgtgcatgcggaggaaggcgaaaaggacactacattactaatcttattgatttagggcatatctcttagaagtttgctattagacatacacttcttcaataaagaatagaatatgatatagtgatagtagaaaaagaataaaaagacaagcaatggtacaaaggttagaaatatatgaaattcatcatttccatggtgaagaataaaatggagaccaaatttataaatattgaatatcctatagatactcactacacgtatgcaagtcacattctaatcaacatcacttcataaaattaacattgtcaagttattttggtcctcgttcgcaccaactaggcaagttcgtgtactgaaatgaacattttacaagtttatatactaaggccctgtttgattcagcttaggattattataatctggattattagaaataagctaaaacaaacggatagcttattatgatagattattacaatctataaaccagattactataatctcaactctaaaggtgctttttagattattgggtggctaacaactaacaagccgcttataatctaggaaaacaaacagctcacagcttattttatgccaacttatcataattcaaattatagtaatctagttcaataatctagattaatcttaagctcgaacaaaaatggcgagaatgcttctcattgggtgtccgggccgacgcaaaaaatcggatggtagtaaccctcttcacccgagacaacagaagtcctcacgtgcacgcagggagttagtacacatcagcacacgtcaagtgcatgcgtccatgcatattcaaatattcaaaatttaaatacatgtttctctacaattatttatccacctacgatttaattataccattagattcattataatt

SEQ ID NO: 51603 - DNA, 1501 bp, Oryza sativa
ctaatggctcattttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcaaagtcactttgaacagtaatagtgaagaggtcccctcagtgatgtttgaagctggaggaagaaactacatccatgcatgtcaggaggtggcaaggatcgccataggagagctccgtgatcgctacagtgatcagttggccgacattgagtatcgctaccatcctcgccaaccccagggaaggaccgtggcagttaccttgagactgaaggaattgagaatgatgttaccacgaaacatttggttgagatgttgtgggctatggatgaaagtcgtgcggagactgtattagcagctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaattggcgccaaaggttcgtgtggtggagaaggaagttgccccagctcaagcggatccttcggtcatcatcataagtagtgatgaagaagaagaatctaagcacaacaattccaagattgagtgggtagcaactcaagatgataaaaacgagccttcaatcgacctccgatgcttggaagaactagagtgacttgttaagtcgttgtcttagatcgttgtgttagttggtttgctttaagtttgcttgtgtgtggctcgcatgtgatttacatcagtggtgggatgtaattgcatgtgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacaacaatggagagaatcccactctggcccaagttcttgctcaacagacacagcttatgaacatgatgatgcagcaatttcagaatcagcaaaaccaagg

SEQ ID NO: 51604 - DNA, 195 bp, Oryza sativa
aaatttggtaaggtttttttggcatcaaagtgaacaggccctaaattaatgctctgatatctggtgaatttagttaaaatacaactgtggtctgttaataataattgtagataacttgtgggatagaaagaaacaagatttggttagcaaatcttgaatccagttaattttgactatttttgaccttgtttcagg

SEQ ID NO: 51605 - DNA, 1501 bp, Oryza sativa
agttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttgtattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgtgctattaattggataaaggtcttaactccctcctttcacttgtctttaga

SEQ ID NO: 51606 - DNA, 1501 bp, Oryza sativa
cctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcgctggggacttaccctaccttttcataaatggacggagatttgcatggttgccgtccgagtcaccttctgatgggacggcccacaactacctccactttcgccggaagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacatcaccctcgggcccaacgtcccccgagggtgccaggccacgttggcgattatgtctgcctcaaacctctagtcatgatactcccgatcccatgtcaccgacagtagccctcggcgttatgccagggcgttcgccctccttaagggaagcggtcgggcgtgacgccactcctaaggcccggtgacaggtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaacgtcgcttcggttggcgagcgtaattaacgcgcgcacgatatgatctacctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagggtataaaggcactgaggaagggatttgtttccttcctttcgccattattccccttgtcttcgccgcttgcgccctaactccttctttcctgcgccctaccctcgccacacgcgctcgctcttaatcttctcttcctccggcgtca

SEQ ID NO: 51607 - DNA, 1501 bp, Oryza sativa
tatttgaagttgttgaagtagaatgtctgctctgaatcaaagatgaagataatgactcctgaagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcaagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaagcaccagtcggcggcggcataatcagtcggcgacggaagatgatgatgtccatcagtagtggtagctgtataaaccagacgtagaggtaagggcactagtcagcaacagacgagacgaccggcgattaagatgtagatgcccaacaacggcggcataataggccagccgtgcaggcggaaacatcagtcggtgacggacgaggcggccggccgatgaagacgtagacgcccaacaacggcggcataataggccagccgtgcagacggaaacaccagtcggcggcgatggaggcaggccggtggtggagtcgtagacgcccaacaacgacagcataataggccagccgtgcagacggagacaccagtcggcggcggcgaaggcaagccggtcggtgaagacgtagacgcccatcaacgatggcataataggccagcgtgcaggcggaaacaccagtcggcgacggacgaggcggccggtggtgaagacgtagacgcccaacaacggcggcataaaggccagccgtgcaggcggaaacaccagtcggcggcggtcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatg

SEQ ID NO: 51608 - DNA, 1501 bp, Oryza sativa
agaaactcggcggggttgacgctgccatcatatttttcggcgatggtgggccggaaccttgggggccaacggacattccgaagactcgccacaaaggctctacagccgacaccaccaaccgggggcacggagggctggtccccgcgtccgtgttgaggtgacactctagacgaggaagcgccctccgttgcgtgggcagcacgtcggtcattacgccggcgctcgatgctggcgcgggcgtccggccccccacgcagatcttcccgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagtatctaggcgctgccgtgcagtcatgaccaatttggccacatcgtccagccaacgttgggctggagactccgggtcatgggcgacaggcgggtgacacaggagcgcacccgcagcttggagcgcgccctggggcgtgctgccgtcgccgtagacgaggaggcgacggtccccatctcgccgcccctttccacctcctgtggatgtcgaagtcgcggatccttcggccctctcgagcgcctccccctgcttaggactttggcgtggagggggcggtggagtacgagctcgacggcgtgggttcggctccccgtcgtcgccactcacactcggagagaggtcgtgcgcctttgcttgctcagccataaggctaaacaggaaaagcttggtgcacacgaaagagtgcaagagctcagaagatcactcgcagagtcccctacctggcgcgccagatgacggagcgtggggctcctcaccgggagaccgcgctggccctcctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcattggggacttaccctaccttttcataaatggacggagatttgcatggttgccgtccgagtcaccttctgatgggacggcccacaactacctccactttcgccgggagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgc

SEQ ID NO: 51609 - DNA, 1501 bp, Oryza sativa
gtaatttgcattctgttgttccctgccgagcaagctctcaatctcctctgcattgtcttcagcttcagcccatgggtgctgctggtatctccttaacatctccagcctctcagcaacctctttcatcgttggccgttcttctccattcatgcttatgcatcgcatcaggaggtatgtgatctcttctagcatttcagcgctcatctcattccttacttggctatctagtagctcttgatggcgaccaactttcattgctgtggtgaagcatgacaccaggctcctgttttcctctggcccgtccaagtacaatgctttcttccttgtcagaagctctagcatgacgacaccaaaactgtaaacatcgctcttatcagtcaactggcatgtcataaggtattcggggtccaagtacccgcaagttccctgcaccaacgttgcaatctcggcctcatcagttggtgctagctttgatgccccaaaatcagaaactttggcgttaaacttgtcatcaagcaagatgtttgccgtcttgacatctccatggaggattgggggtgaagccgatgagtgcatgtaggagagtgcctcggctgactctgccgctatccgaagacgagtatcaagtggtatgtcagctttgggttccttgccatggatgtagtggtagagggtgccatttgagacgaattcatagaccaacatgggcacttcaacttcgaggcagcaaccaagcagcttgacgacattccgatggttgatttgggagaggatgaacatttctctcgcaaactccttggtctcggcctcctccatcatcttcgacttcttgatggccactactgtcttgtcttcgaggacgcccttatagacaacaccgtgaccaccacgacccagaacacggtcagaggcgaagttgtgggtcgccctcttgagttcttctgtcgagaatatcctgaacccatgggtgcctccgccggagtgcatctgctgccggaggatcactccaccgttatgctcgaagaacttctgcttcgttctgatgagcttcctcttctggagccccaagtagagccagaagcacatgaacactgacaagaagacaccgacgctaacccctgaacacgacgccattgtatacccaatattactccgttagatttccatttttgagactgaatgtaatttttcatgatggacgacagttataattttttttacctgtaactactttaagagctaaagggaagttgtcctttgggcggcaaccgttcctgtcggtccaatttccactagtcccaggagggcacacgcaagtgtgacttcctaacatgtttgtgcagtctccgtagcatccgtacttttccggacgtaagcactcgttgatatcttccattcacaaagcaattaatttcgtcatatttgatcatcagccaaattaatctatggaaattaattgacagagttaattaagatgactgctacctgtgcatccaccgtc

SEQ ID NO: 51610 - DNA, 1501 bp, Oryza sativa
ccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctcctttcttccccttcctccctttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccacttcgcccacgatgtcacccacgtcgcgggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgccctctgtggtcggtcgggccagccctggctgtgcccgtgccctgccaccactcccctcagctgcccgatcggcttggcccgatctgggccgtccatcccgtggaccggcggtggaccgtccttgtggtcccggtccacggtgcaccgagctccttgacccgctgacgtgtggggcccgcgtgtcggcgccggctgccccttgctgacgtcagcgaggtcctttttcctttgtaaaaataattaataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgcca

SEQ ID NO: 51611 - DNA, 1501 bp, Oryza sativa
gtggaaggacaaatgacataagatataagtggaagagcccctcacctcaaggctagcttttgtgatgggaaagactatttacgatcctacgcaaagaactccacggcaataagaaagagacaatttggaaaggtagatacgatgttgtttctcgttgttcatatatagagtccagcaaatggttaaattcagctctaatgtcagcaaggataaagaagtcatcaaaagctctaatgtcagcacggataaagaagtcatcaaagttaagaggaacataatcccagttgagcacatctctacataaacaccaaacaaccagttcagcacatctctacataaacaccgaacaaaatacgccaaagggcagctaaagattatgtacatctctacagaaacaccaaacaaaatgcgccaaagggcagctaaaaattatgtacatctccacagaaacaccaaacaaaatgcgccaaaggacagctaaagaatatgtggtttgtagtttctagatggacagtggagaaaaaaattctaattttaaaatcagtaacaccaaacaaaatgcgcctaaggtcagctaaagattatgttgtttgtagtttctagatggacagtggagaaaaaaaatctaattttaaaatcagtaactagagggtgagcgtgtacggtacggtgttaacacgggccacggccggcggggagcacaaaagttacagtctctatatttattttagtgctagagaagacacatatagtaaggccctgtttagattctaacttttttacttcaaacttttaacttttttgtcacattcaactttcctacacacataaactttcaacttttccgtcacatcgttctaatttctttaaacttctaattttaacgtggaactaaatacagcctaatatatgctactccctccgtcccaaaatataaatatttttaaacttcgacacggtctttgagatactactttgacaaataatatctatgttttaactaaaaagagttgtatattatgataatttgtttaatgatcagtctagtaacatcaaattgacatgatcaatcttttttcttttgctattaatagtcaaaatttaaaaggtttgacatcacattactctaaaaatatttatattttgggagggagggagtatcaatcatttgaagagttcagtgacattgtaccctaaggacgaaacgaatactggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatctatcgacgctggatcgccgacggcgatggccggcttttcgttgaccacttgtgctaccggcctcgtcatcttcttctccgtctgctacctgcagcccctccgg

SEQ ID NO: 51612 - DNA, 1501 bp, Oryza sativa
ccttctatctatcatgtactagtgatgatgtcttggtcttcctttcttggttgagcaaaagggcaaaaagggagagatcgactagctgatgagatgatgagtgatttcaattggtagcttaattaagacagaaacaacatgtgttatgtgtacttgtcctgggaacagattccatatatatgccaaatgctttaatttgggctatgatctgtgtgcaatgcaatgttcttgatatattcatgatcaagtgctccctttggtcatcatgtgtgtgctggtagctagactttatacaaaaatatgttgcttttgttctttgctttgaacaatgttttgttgtgtagtgccagtttttgaatggtttacagtactggatactaccttctttcacttttacaatatgtgcaaagtggtaacagatgaagaaacaaacaaaccaaacaaaagaagaaagaaagataggagtcttttcaaaaaaggagagaaaagaaggcagccaggcaccaaaaatatataaagggttcaattgggtgtgcactagtacgattgggtgatccctatttttgcccatgctttgatgcttctgattcctttccttgttcaagtttgaattgctggatttgacttgatttaatttgtcttcacttgtttattattcctgatgatgagtatatatagtagaactgacctgcacatatatatatgtttctgtaacaactcaaatgatcaatgatcagaggttttttcaaaaaaagagaaagaagggagaatgcatgttcaggtagctagcagacagcagtaaaactacaattctctttgtggttaaagttagtttaccacctttgttagaacctgatcagatcattctttttgcatgaaaactattcacttctaaagtcttttgtgtccctatcaatgcaacagtgccacacacatgttctttcacttcatctctgctgtccccatgtatatatatgtatactatatgatatggcattgctaccagcttagcaggagggcattcaagttcctgttttcacacagttgatgcatctatcactatcttagattttgcttgtcctttcaatgcatatatatgtgtagttgagaaaactttttctttcatatatatatggaacagacaaattaaagtcgactgttctatgtattgcttctatttaatttattcgacaactttgcgtgcaactcaatctgcttctcttttttgggggattcaaaagaatttttagcacatggccggcttcaatctttatgtgagtgatatgtctgattgatatatatgtactgactgactctctgtagccacagcttgcttgattgtggttgcataccttgcatgcatgcgtgatgagtttttctacctaattgagctagtatatatactgtatattgattaggtatcacagtatcgtcagtgttttatttgacccctaggcctcctttggaatacgacaattactaaatttccttcgttgcattg

SEQ ID NO: 51613 - DNA, 1501 bp, Oryza sativa
atcaatttgcatgtacttaattttcagtgcacaatgcacaattaggcagcatctgatggatgatgagatccctgtgcccttagcttagctaactgccaaaacaagcattcagaaagcgtggtgatggatggacgttgcgagataggggccccggcgccgatggaggacaagacatcagatcatatcacagaaattaacgagaaagagaacaaacgaacctagacgacaatggccggcttgggtcgttgtgtgtgcttcgttcagtactactgttgtgtgacatacaagaggcagcctgcacccacatgcatgcagcagcaagactgatatgattctcctgacttagcagcttgcatactgttgctccttcgatgattgttgtttattttctttatcagcttaagcttttaagttgaattagttagtgtacgtaactcaatatgttagcgagaccgaaaatctgaagttcaaatcatgtcagatgcacaattaaatcaataattgtagctcatttctatttcagtctcgtctcgaggtttgagggaacctcgcgtagaggtgagtgttggcatataagccggttgaagtaatgaataggttgtgtttgttcacatgatattgagaggagaagatttacctcatacattttcttttccgaactaataaatgatgtgttgttcttaaaaactttcaatagaaatgttgctttaaaaatcatattaatccatttttaaaattaaaataattaactatttaattaattatacgctaatatggttcatcttattttgtgtatcttctcaatcttccacttttccctcctctcaactccttcctaacagtgtttaattaccttgctggggttgtcagtcaattgtgggttagatcctatattaatggccactgcatatttacagcagtatgttgggcaaattgttgatgattctacaattacgtgtataaaactagctggctctcttatgtaggatggttaagttcctctgttaatttgtgtggatcagttagttaagtttgaaaattccacacagatacagcaatgaactaaaactagctctcttatgtactaggatatataattaactaaaaccaggtagctaatattaactacctgcagctgttaatttgtatggatcagttagtgaagtttgaagcttccacactgatacagactgaaagatacagcaaaggactagaaaaagggttccaaattaagtactccattaatatatccacccatcaacagaaactgatcattcatacattatatgtacacatgcatgacgacgtctgctactactgcaatctcaatcaaattaaaggctaagatatataatttacctccaaacaatgcaacagcgctatacgacgtaccactataccctatacacaggtgcgcatgtttgcatgcacaatcaacgaaatctgcacaagctgatcgatggaatcgatcaccacgaaacaaatcagatcaaacaatcga

SEQ ID NO: 51614 - DNA, 1501 bp, Oryza sativa
acttcatgcatatattgaaacattcgatgtgacatagcgaaaatttttatcaggagatgtaaacagaccctaagttaacctgagaggtttaaacttgtgccatctgccatggatgcagaagtagcaagaggagacgaggacgcggccgggcggggagcagaggcggtggtgaaggagaggtcggaggaggcgtgcggcgaggccgtgtggcaggcagccgcaatgattgatacgactcgtcgtcagcaaatattccctcctagacagcgacctcgtactatactacactttgcagcaaggcacgcgtcctaatgttaacccgtatgcatgcatacagattagcacgcttaattagagcaaggataatgtgagctactccctccgtctaaaaaaactcaatctcaaataatgtgacccctcctaaaacaacaaatctagataaaagatagttatactaggagcggtcaaatcctctcctagattgagttttttttttggaacggagggagtataaacctactgtaagctacttcctccgtttcatattataagactttctagcattatcaacattcatatatatgttaatgaatctagacatatatgtatgtctagattcattaatatctatatgaatgtgggtaatgctagaaagtcttataacctgaaacggaggtagtagcttacgtggaggagaggtgtaaaaaaattaaggatgttagctctcatacaagagctagcttaatataagcttgaagacaaatatatcaaatgtataagtaagagatagaaagaggagaaaaaaaattatagcaaaccttatagctaatctctattatatatgttagctttaagataaactaatgaactctactattattcttgctcttaatattttctctattataaaataagtgcaccataaataagtgcatccgtatattttaaatttgaactacatttaagtcagagagagtattattactagccaattaccattgtgactacgtttaccgtggtatttattggtagcattttattatccgtatatatattattaggataaataacctttaattgttaatgtatgagttagtatatgatagaaaattaaagttacttctctatggtactgtggcagtataaatagaggagtgaatttaaactctcgacgggggcatttcctctttatttatatgtcatttaaatagttataagataatttgaaaagatgaattaatatgtgatagatcacttcacaaacatgcaagttaaaaatgtaagttgagaaaaaaaatatagctagctaacatatattcacagtcaaattcatttttttattacatgtttgtgaagtgatatattacatattaatctatctagttgatttgttttctaaataaattataagcatttagattacatgcaaataacaagagaaatattctcttgaaagtttagaatagtaaacgtatattgaattaaattaggaaagatgaat

SEQ ID NO: 51615 - DNA, 1501 bp, Oryza sativa; identical to SEQ ID NO: 50674

SEQ ID NO: 51616 - DNA, 1501 bp, Oryza sativa; identical to SEQ ID NO: 50676

SEQ ID NO: 51617 - DNA, 610 bp, Oryza sativa
agctctcctatttcatttctagcatatctttagggggagctccaccaaaatcctaatcttttattacttctaagtgtgttgtcatcaatcaccaaaaagggggagattgaaagtgcatctaggaccccacatttattttggtgttaatgacaacataattagagggtaactaatgctttttgttgagatgtatgcaaggatgaaaaaggagtggatgtcaacacaataagtattgcagcatcttttgtggtaattgtcttctaatccatgtatatcttgtgttcttgagtattaggatgccttactattaagaggaatgccacatgcatataattggtagaacactagtactcaaaatcatttatttgaagtgttcctgttttatgtctgtcggactatccgatgttgatcagactatccgaaatttcacagaactttgctcactgtcttgggtctgagtgttggctaaaatatatcggactatccgatataaggtcggactatccgatacgtcagactatctgaaatttctcagaacttcactctctgttttgaattgctttttattccttttgaaatttttggttcaaaaataacggaatatccgata

SEQ ID NO: 51618 - DNA, 470 bp, Oryza sativa
gaaattaaaaataaaataacatgtttggaattgggccgaatcaatttgggccaagtcgcagcagtccagcccacctcccccctaataccctagggagaggcgactcccaccttcccagccgacgccgccacacctccccctcggcacctatggaacttacatattcctttctcccctgttagccctactccatggatctccaagaaccatagccctaatcaagaatctgattggaaaaacggatcgaggaagaggagaggagcaggaagagtggtgagttggttttcccatcatattctctcaagttctccaaaccctaggtgaggcttaactctcctgtgcagaggttgtaggttattttagggttgtaattcggcgttattcgaaggttagaggatgggattaggtgttgtgttttggattagtgtttctaggccctgtcagctttgttgtgtctctgtatttcgcta

SEQ ID NO: 51619 - DNA, 283 bp, Oryza sativa
ctttgctagctgaggacggcgatgctggtagtttctcagccatgagagaacgctgttgtgattctaacttctaatcggtcccaccgggcgtgccaaaagcgtgttgatgtaaaaacacaaggcctgggagatctgcttaactccagtgcaggtccagaagcttgcctttaggtgtatgagcgtgccagttgatttgatcctgcaatcaacaagaaacaaagataaagaaaccgcggttaaatccataaactaaatgccgatgacgtattatttatcttgaagc

SEQ ID NO: 51620 - DNA, 1501 bp, Oryza sativa
ataagatcaaactcaactgatacagctataagtatgacaagaaggacaatatctagacaatcaagccgttggatgtttcatagagtggtagatgtcctatacaatcaagtcagcgttgatatttaacctaatcggctgccttctagtaacagacgttagccgattagaggttagatagcgatattgccagagattatataagatatatgataactcgacgaattacagaaacaagattagagtatcataaagatggaatcactaatcccgagaacgcaagccgccgtaataagttttacctctagttgaagatcgaaaccgatgcagctcaacctgaaagcaagaacccgtcgaaacaaaacggaagtaaaaagggtagcaatgcgccgagattgtattgaacgagtgttagtttgattacatggggctcaggtctatttatacccaaaaattacaaaatatgtccatatcggacatgtttcttgtctctaacaaactctaagataccataagtctttgcggcagacttttgcccaaacaaatctctatggaaattacataaaatatcctacttaatagatacaattgccttcttacgactctatccatgtgtggcaatcatcatgaagcacgtcatcctaacccgacaacatatgccgtgtcatattgtcggattcgtctcaatcggctaaccctgtccgactcaaactctgccgatcttagtcgtagccgattcggactccagccgatcctcactctgtttccgggacagtctctatctcgaactccgtcttgaatcctccttcacatccgatccttggattaccaaatttggtcgttagcacatatctaccatctcttagagagtagctacttttgtctcatatgcttgattgttatgctaaatatgccctttatattaagatcttattgagttaaagtatattaggctttctgtttaatatatcttgtctgttctaatatcttaatatagagtggtatcggagtattagccgatacatgctagatctatctgatcggctatgctataaacgttcgtataatcattatctgaatgtatcttttcacttaagtgatttatactgtctcgacatactgttcaatctatcccaatcacaaaatttaaatatacattgagagaaggattaaatatgttgatatctacagccaatcgagtagatttagttttatattgctttattcttcattgctggtctaatgccaataacatcggctcaatgattgatcatatgtcatcggctcctagccgatcggctatcgtttatagatttaacctcctttttcttgtcttttcttcttgttgattgtaggatcaaatcaattggcacacctttgaacctaaaaacaagattttggacctgcacaggagttaagcagatcttccaggccagtgtgtgtttttcgcatcaacacgcttttggcacgcccggtaggaccgagttgtaacaattcttcaaca

SEQ ID NO: 51621 - DNA, 550 bp, Oryza sativa
ggcagccgatgggggaaaccatcggagttcacagctaaattcggtaagatcattaacaagtaccaaagaaggcatgataagcaggaggaaaggtatcttgaagatgatggtggttttgatccacattgggattgtgtgtctttcaggttctgctggaatgaagggatgaggctgccatcaatagaagaatgccctagatgcagtgataatgcagggagctcgagccgatcctacaatagaggaaatcggctaaatcagaaaaaattgcctgttcatcagaggttgggtcctgtgcaccaagatcgttttcaggatgaggatgaaggcaggaactcacagtggtgtccttttggtttttttactaagaatcagaagtggagggtccaaaggatgaaaaacagggagcgttttaaggaggtacaacaagagatcaaccatcggttgaagaagacaaagcaagaatggcgtgttaagagtaaagttacaacagccgatgaagttgaagccaacaaggcgaagaggttgctcaaggccaaagctgttgcgtctt

SEQ ID NO: 51622 - DNA, 1313 bp, Oryza sativa
  unsure (1)..(1313): unsure at all n locations
ggttaccagctttacaaaatggagcacagagagcactcggagatgattaagtaccaacagacaaggggtatattaagggggtgtttaggtgagagaaggactaaactttantccggacttattttttttgtgagagggaccctctcacccaaacaccctctaaacctctaaagactagacggcagcaatctaaaacagaccgaacgccaaagcattgcacggggctagcaagatcaaccaactcctattctattttgtcttagagcagctcctccctccttaaacctctttaccagcttctctagatcactcttattcatctccagccgatgcagaggactacactgcaataagaaagagacaatttggaaaggtagtattaggggtgagtaaacaagtttatccctgaacatgatgttgtttctcgttgtccatatatagagtccggcaaatggcagcaagcagggcatttttcacaactatatgtttaattcagctctaatgtcagcaaggataaagtcatcaaggttaagaggaacatgatcccagttcagcacatctctacagaaacaccaaacaaaatgcgccaaagggcagctaaagattatgtggtttgtagtttctagatggatagtggagaaaaaaaactaattttaaaatcagtaactagagggtgagcgtgcatacggtacggggtcgaccacgggccacggccggcggggagcacaacggctacagtttatacttattttagtgctagaggagacacagacagtaatacacgctacttccttcgtttcataatgtaagtcattctaatattttccatattcatattgatgctaatgaatctagatagttatatatgtctagatttattaacataaatatgaatgtggaaaatgctagaatgacctacattgtgaaacggagggagtagtatcaattatttgaagagttcagtgacattgtaccataaggacgaaacgaatactccactttagtggcatgtggtttgacttactcttgtttcgtcgtcacgcgccagcccgagaacgggtccaatggaggatacctcaaatacagactcagactggcagtataggaagttgtgtcgttgctcctccagcaggagaagccgatcagtacacagtactgatatcacagtactgtatcagtatcaccttgcacacgatcgatcgacgctggctcgccggcggcgatggccatcttttcgttgatcacttgtgctgccgacctcgtcatcttcttctccgtctgctacatgcagcctccggctcctgtcgccgcct

SEQ ID NO: 51623 - DNA, 1501 bp, Oryza sativa
ttaaggtggaaatggattagatttgcagcacacaactgacagatatatcaatcaatggtgatattctcttgaatgaaatcaatggacatttcttgaatctatctggaatcaaatttgaatatatagtatacaattcacacagttttcagtctctgcattgtccttcagtccagccacttgtttggcgtcagctttatttgtacctgttcctgtatgtggatgctttttattactcgatacaaacgcgtacaaacacttcgcatgttcccgaattcatttttttttgttgaatcgatgtaacattgacactgggtgctcaagatgtcgaagtttcgatttattccaataacaaaacctggaacaaccagatttaaacaacatgaaatatgattcattgacttcattaaaaaaaaattgatacattgaagattcatagagctggtacatggaagattcaaagctattgatcaaaatgggtcttcaaatccccaaccactcgagagcagctgcatgctggctagacttggtcataatttggggaaaaaaatctctagaattcactcctatatgatcactcagacgacaacatataaatcaaacttcattaaaaaaaacatataaatcaaactggttagaattctgagccctgcttcaaattttcgattagtcaagccttgcatggttataaacaggcatatctacatgaggtaactttatgaaggagaaaattccggataagcatggagtgaatatgctattttcaaatcaaagtggcctgaaaacatatatttgaaatcaatggttaactgatatcgtgcaatccttttgaacatttatgcacaagagtgttaatgatgctcatttagatgatttttcagaacctaaatgctttccattgttatcccaaaatccatttcaaagagggaaattaagctaatatgagatttacatagaacatctcgcaggatatggtagtagctagtatcatgttgtttcaaaatgtcacaaagatatgtacattactagtatcttatacattactagtaacaatggagagaaccatcagtttatataatcattgtgggcaattttgaaaggaggatttgatagaaatctgcatgaaaatcttccaagggaaaacttatttccattcatattagagaagaaagggggaaatggtaactagttattatgacaattaatacctggaggagtacgtataatatatctataaaaaatggagaaaaacaatgcatttcatttaccacgcattagctgcaggatatacaaatactgtacgcaatgaatgcattgcatttatactgttttgcaaatcacattgaataatactgatcaagatcaagatccagtcgtccgtggaatagctgcctgcaggcaattatcccaaaagaatagtccaaatccatatatttctccacaacagaataaaaaggtatacatatataagagataatgagatgacatcaaggacagatattta

SEQ ID NO: 51624 - DNA, 1501 bp, Oryza sativa
gtggcaattcaactgtactacgtgaaggaacacccagagggcatttttgttcagtaataaagctcacataaacttcattggccaatccaaattccttcatgcttgaaatgaagaggtgaacatacagaacattcatccaacctaacccttcttccttgagctgattctcgattctgctcaaaactgctactagatctgtcttcaggcctatagacataaggagatattaaatggacgtttcccacaaatgaagatgcaaaagaaaggagatattcctgtcaggcgggactatggtcaatttaatgttacacagaacaataaggcacaagagcatgcaccttctgaagtaccacagggatcctgaatccaacaaccaatggagaacaactttttgccagtctttgagatgcataggtctatatttgtgcaagcatcaacagttgtaactggactcaaggtctcttgtttcttttcgacatcactgtgtgcaatagctccatctacttcatacaaataactagaattctcttgggcaatagcactatcaccaacggtgccaaaagaatttggcttgtgttcaagatgaaattttaacgggtgaagaattcctactggagcgatggaatcaggcgagtggagtataacttcaaaatcatcaagaacaattcttgcattctgcagtacaagaaactcatcagttccatcttggtaacaaaatgcttctgctgcacatagcacataatagtagtataaattatgaaatgcttcagaaatctgataagcatgctcagaatatagtcaatagccaagttacagcgtttcattgaatgtgattcatgcttaaggactggtccacatgttcagacaagtggcatcagattattcacattcagctcttatctccttaaacttacacggaatagagggcagtcaagagttagtgtttcatattcgccaccttcaccacagacattgattccataactcctagtgggatatagaaaaacaaaaggagaaattacaagctgcacagatgcaagtgactagtattgaccattagtaagaaaatcatgagaacagacataaagagagcgatatgttgtgatatgtttcttggaaaccactccctcattgatcactacgagaagctaaggcctgggtcattaacccacaagttataacaggatacaaggtcttctaatacatgaaacctccaagaggaaaatggctaaatgggatctatgtaggcagtggggaacatactcattcagttggagcagatgacacttaagttcagccagttctttccctaagtgagcagaaggtttgagccccattgcggcaacctataaagtccaaacatcagatattccatgtgataaacagttaaatacatacttgcaaggaagttaaaaaaaattatgtaccaagagaacaaatgcatgagtgtgctgtatataccttgacgattatagctactatgccccttcttatctgcaaa

SEQ ID NO: 51625 - DNA, 1501 bp, Oryza sativa
gtaattttgaataactggtttcaaaagaaatgaaagaaaatgataaaatcaacatgataaatttattttattgcagcaagattaaataaaacagtattataaaacttttgctggtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtcccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaactgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagtta

SEQ ID NO: 51626 - DNA, 153 bp, Oryza sativa
ttgtgtgctgggccgttgttgcccgtgtaataattatatttacgcttccgcttggtaaactttgaattgtatcaacttttggtgtaccttgcctcttgggacaaggaataatacacgcacgtcaggaacgcctgttgggtgatttccggtcgt

SEQ ID NO: 51627 - DNA, 1501 bp, Oryza sativa
acaaacggaacagtcattttgtaaagagagtgagtagtgaagagaacaaaacttattaaagagagtgagtagtgaagagaacaaaacttattttgtaaaatacatgagggaaaccaggattcgatcctagtaccctatggatgacagcccaagcatccaaccaccacgctatcacggtcttggttctatatgttgcttgcgcgattatttaaaccgtctggacctcagtgccaaataccttggcgctaagatctgatgactcagcgaattcatatcaccacggattatagtttagcgccaatgtccatggcgctgagtccatggcctatttttgattaaagttttttgcagagactagtttcaaaataagtttttaaaaatgaccaatttataaaaaaatcggctaaattactgtagtactacttgggtgacgctcgatcccaatacgagtatttataagatgattttaaagctactccacaagtagataggagtaataaataaaaaaacactttgattaacatcactatatgatttatttttcacagtttcggaagacaaattaattatctttgcacagtttcgctgcaccaccacccgattctatgttcagacaaaggatatcaccaaataaaaaaactaaacccataaatgcatagtagaatccaaacaatactatatattcgcatcagaccgacatagtacgttggacaaaaaaaaaagagtaaaatctatacgatgttatcccgtttgaacgaaatgataccttaaaaatatcgtatgatatctggtaagtatcatcttatctgaacaggtatcaactgatacctatcaaaaatcaagtgcctaggtgatatcttagaggtatcattcaatccgaacgagatatcgttctacattacttccaccgtttcaggttataagacgttttaagtatgatcaaagtcaaatcatttcaactttgactaagtttatagacaaatataataatgttgataatactaaataagtttcatcaaatcaataattaaatatagtattttcataataaatttgttactatttttttctacaaagttgatcaaactattttaattttgaccaaagttaaaacatcttaatctgaaatggagggagcatttttcttaagaaggaaacaaagaaaagttaccatataaaattgtttcagaattcaattttgatgcatggtttcccccattttgcatcgaccgaaaatctcgtgatttcgcggcgggcggtacacggcgcggtgcggtctccctctcgtccagcttcaaaacaaacacacttaccgttacgactccaacggctacttccctttcaaatccttccccttcccaagtcccagccctctcctctcctctctctcttcacccgcaactcgatctccaattctctctctctttctctcgcatcgaatccgagttcacatctccaaaccctagcgagctctctctctcgcagatggcgccgccgacgc

SEQ ID NO: 51628 - DNA, 1501 bp, Oryza sativa
agttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatgggacattcctggtttggagatagaactgtgcagccggggtggttgttcagaatggttgggcctatacaacagggtatgttgtatagcgttggattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgggctattaattggataaaggtcttaactcccttctttcacttgtctttaga

SEQ ID NO: 51629 - DNA, 1501 bp, Oryza sativa
gtcgatcgagcgacagttgatccaatccatccatcgagagtttcagatgtcctacagttcacgcacagaagcattcttgttgctggccggcttgctgagatctcatttcagaatgggcaaagcagcaaagatgcatagctaacaggctaccactagcacatataaataagatcggtgacagactgacagtgtgtgtgtgcatccatggagtcatggaccccaatggcatccatggcgattggtcccctgatcaagcaagctgcagcttctctcttctctcttctcctctcaattctcatctcagctcatgtgatcttgccttctcacaaagcgatatctctccctcctccctccatgataagcatgcatgcagcccagcttaattattttcttgcagcggctgcttattagctagagcaaaggattaggacagcaaatagtaactgtgagcgaccaaaagcagatggtttgtttagctagctcgatgggcatgcatctgtactaaacaaataacaatgaggtgtagttgtctgacctaagttaatgataattttagcaagcatcttaatttaaacactgcagcataatgccagcatctctatgtcactctgtgtgtgtctggaaaggttgatgcctgtcagttttgctagtgacctatcgtgtgatgataattaggattgataaagttatgtcgcttttgacgccgaatagcagcttatgtggcgattatgtgcagccctagagcagtattaagggtgtgttcgctactcaccctattcacggaaaacataacaatccattaacatgtgattaattaagcattaattattttttttcaaaaatggattaatttaattttttaaacaactttcatatagaaactttttcaaaaaaaatataccgtttaacagttttaaaagcgtgcgcgcggaaaacgagggagaggggttgggacaacttatattcttttgttttccatatttttcaaaataagtactacctccatcccaaaatatagcaatttttagctaaaaatgcttatattttgagacggagggggtatgtttttataaaaaaaataaaaaagttgctctaagaaaaaaatatttttaaccaaactattaaacggtgtgttttctgttaaaatacatacaaaagttgcttaaattttacattgatttatttttaagttttttactaatacttaattgatcacgcgttaacgaggtttctagtcccaaacaaacacaacattaccgctggcttgctaacaaagtttattttttggacacaactacaccgagagtactagcaggatagtgctaaagagagacactattctttccaaaagaagctaccagtacactcaatatctatgtttttttttctttttagagaagtttctcttaaaatacttatctgatttatgatccgattataccgttgtgttcgttgcaattaaatctttacaacaaaatcttacatgattatattctgataa

SEQ ID NO: 51630 - DNA, 1501 bp, Oryza sativa
ttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgggctattaattggataaaggtcttaactcccttctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcaaagtcactttgaacagtaatagtgaagaggtcccctcagtgatgtttgaagctggaggaagaaactacatccatgcatgtcaggaggtggcaaggatcgccataggagagctccgtgatcgctacagtgatcagttggccgacattgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtattagcagctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaattggcgccaaaggttcgtgtggtggagaaggaagttgccccagctcaagcggatccttcggtcatcatcataagtagtgatgaagaagaagaatctaagcacaacaattccaagattgagtgggtagcaactcaagatgataaaaacgagccttcaatcgacctccgatgcttggaagaactagagtgacttgttaagtcgttgtcttagatcgttgtgttagttggtttgctttaagtttgcttgtgtgtggctcgcatgtgatttacatcagtggtgggatgtaattgcatgtgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacaacaatggagagaatcccactctggcccaagttcttgctcaacagacacagcttatgaacatgatgatgcagcaatttcagaatcagcaaaaccaaggaaataatcaagc

SEQ ID NO: 51631 - DNA, 1501 bp, Oryza sativa
ctcgctctctccggggcagcggccctgatcccgccgctcacgctccgccgcaagcccgcctccgcctccatttccttcccgacagatgccctccccggcatcaccgaggacgccctgagggtggagacgagcttggaggactccacggagctcgggatcctgctggccctcgggatcgacgacgtggaccaccgcaccgcggcggtgggcttggagggcttggacgccgagttctccttcccggcagcggcggcggcgggggtgcggcgagcggacgacgaggcggagaaggccttgggggtgagcgggcgggatcccgcggcggcgggtgcggccttgccgcggtccttgatgcgggaggccatggcgatggtagggttagggtttggggggatctgggggaagacgagagggagagggagatggtttgcgagattttggggaaggaatggtttgatttgggaattttacgaccgggagaagcgtttcaaatttcgaaatgtttcgagcgcgaggccctgtggctgtgggcccaggcggcatgggtacaccgaaaagcgctggggccgcattaggtggggcccgctttgtcagtgaccgaccagttctgttctcttgttgggctaaggcccgtgactcggcccaagtgatgagcttctaagggcccgttcgtttgcctcccattgaaggagaattttaagcacacgcaaaacagtaaatctcataagcatataattaattaattattaatattctcttcgtcccaatataagtgcacataatacaggatatcctagtagaatatactaatataagtgcacctaatacagattattataaacttgaataatagagttattttcagtttttaaaataacttttatatataggaattgtttaagaatgtatattttaacatattgaaaaacatgctaatagaaaatgaggaagtttgaagttgaaaaaaaaaacagggtctaatggtaaggattgtagcgtctctttcagcgtaatccagctggttggacctctaattctggcattcaaccttgttttccccttaactattcgctctaaacaagccctcaagctgatagcgtagcttaccaaccggcaaaatcccaaactgtgtgtggccataataacctcatttgaagagagagactgctaccaaatgatgacatctgatcgacagtaagctgcatgatctttcacaatcatataacatcctttcaatccatcaactatgagttttgtacatttctgcatcgcagggtttcgctctcaacagcagactgtaaatgatctgcttagcctcaatgagagcaccacaattactctgctttgaaacacaataagctacagcaagttatagcagctgtactaattaagtaccaacagaaagcaagataacgtctctggcaagcataagatgtccagtttccttggaaacaaagcgaagagaagagggacagcagcagtcataagcaagcatgtgcat

SEQ ID NO: 51632 - DNA, 1501 bp, Oryza sativa
gctaagcttagctccattgtctccaacttgcgatcgatccatccatccatccattaatttccgcgatccaatcgaaccacgatatgtgtaaagctatagcatatctacagtcactccatgctgcaccgcacaaaacactctaatcagaattaattaattaattaattatataatcatccatcctattttaaatacattagcgggtttccgtgtttgtcgtttgaccgcacatcttatttaacgaatttataaaaaaaataaaaaaaagtcgcgcataaaatattattcatgttttatcatctaatagcaacaaaaatactaatcaaaaagtttaaaacaaaacgaacgatcaaactttagacatagaaatccacatacatacttaaaagtttacgaccttaattagtcctactcccctggacactgccctcttctttaattaactaaataattaattaacacatgagctgattagtgatactaataagaaaattatagtgcatgtcaactagccaattacttgattagttattgtctttttttagaggaggcaactagctaattagcagctgcatgcatggtcacctgagtgtgagtggccgagtaggttaagcaagggtctgtctctgcttgattcctgcagctgctcatgtttccctcactccattgcccctgccttttcgcccaaaagatgggccgctcaaattaacaacccggcctaaagcaaccggctttctttcctttctttctttaatttctttccttctcctctttaattctctgcgctacaaatatgtatacactgccttactctaattagaagtaattacttaatcaatttctcccttaatacagaattagcatccaaccagatcatgcgacgaggcttaattacgtgtacataactagtatataataatataactatatatgatcccactgatcgaattaagcaactaactaagccactaactgaatgaacaggacacaaacagttctacgaatggcatggtcgatccccactatgtaagtgtatatatatatctctgaattcagatacacctttctactttaatttagctaagctagctagctctacctaatattgtaacatacaaggccactatctgtccctgtatgtgcaccagcagtgccaaatttcgctgcatgcttagctaagctaagcttatatagcaggagcactcgaggtgagcagagagagaggattgaagaagaaggagaagagcaccaagctagtagcctgatctctctctctctctctaactgtctatctatataagctaacaaggcaggacggttgttgcttgcgagatcatccctgcctgcctgtccctttcctgcatccatccatccatcttgatcttctcctagctcgattccacacatgtgaacgtacgtacgtttcagttaattgttcgatcgatcgatcgatcagctgctgctgctgctgctgcaacgaggaagaagaagaagaagaaga

SEQ ID NO: 51633 - DNA, 1501 bp, Oryza sativa
atggtgcacggagattggagatggagagtggtcaaaggcgtaagcaggcatgcatcgcttcatttcagttcagggggtagtctcgctgcttttcaggaggaaaggctcgccggtctctgaggccattgctgaatgaatgataggattgagcttttgttacaaaggagtaaagagagagaatatctgcacgtgactcggctcggattctactatagacgtgtcacgtgcttgtgtacgcggacggcccgttgcaggcccatctaaggcctgctcagatgggtatccaaattctcatgaagtgatattcagtcaatgaaaaaaaaactggcgatgcaaacatgccatgattttatcggttgtactatatagtaattatgattagttaatttttgtcgaaataatagtaccacatccgttccgaaatattgtaatttaggatgagatttaggctttgttcgtttctcatggttggaaacgttctcctccggcgcaaaaaaaacggaacagttcattagcgtgtgattaattaagtattagtaaaaaaaattgaaaaataggttaatatggtgtttaaagcaactttcctataaaaaattttttacagaaaatacaccgtttagccgtttaaaaagcgtgtgcgcgaaaaatgagtgaggatagttggaaactcttagtgccgaacacaaccttaatcaatcctaaaacaagattgagatatgtccagattttttgttataagatgcatcaaatcaatgttttgggtaagatatatcaaatcaacgttttgggatgaagaaagtactctctccgtatctaaatataaaggattttagttggatgtgattagcgacggagggagtatgatagtttagcaatacaagcatgtcaagcagaggctggtgtgagtccatcatctgcagcgtcatggattacggataaaagcctgctgactttgctgtggtttagtgcgcgcgtgcatggagatgaccagatgacagcagattagcaggcagagtcccaagccagcagcagagccagagtccactaaatctgttgagcgtacgtgtcttcttcatccacccatgacgtccagtgctccaggctgctgcctgcctgcctgcgtttttcttgatccttggggattctctgctcagctctgggctctggcactgcctgccgacaaaaaaacaaaaaacaaaaagggcctgtccacttggatgggccattattattgaggcccatccaaacaaggtaaatcatgagataggctaatttgcctcctcctcggaataaagtcattcttaggccctgtttctttcagcttgggattattataatctagattattaagtcagattactataagttagattgttataatctgtagtagaataagcggttagttgtttctttcctagattattagagcctagattattgggtttgtaagtctaaaaagggagtggggtggcatggtgggtaatttttcatccaataatct

SEQ ID NO: 51634 - DNA, 474 bp, Oryza sativa
caccttttatatatatatatatatataaaccagcttgatgtatatatataaaaaggattttatcattcttgaaaatgtatttgaagaaaaagggaagataccaacaagaaacggaacttacgcttaacttcgtcatctattagcaaaatagacaaaatatgatacatttcagcaccttccgaggagccagagctgtcagggtcatggtctcatggagcctagtgttgatttgccaaccaccaacttgttaaattagcagagtccttaagatctcgactggtctctctgagtggcgactggcgactggccacctgctgatttgagtactactagtagttttccgtttttggcattggcagtattgtccggccgctgattccgctcaaagaccggccatggccgccggcgtcctcatgacaaaaccgttcatggctgctctagcctgcttgctcgtcatgcctagcgtcgtcgcta

SEQ ID NO: 51635 - DNA, 1501 bp, Oryza sativa
tctggatcttttctttaacagtgcttgggctagtcgaggatggcgacagcggtggcttctcggccatgaggaagaattgcttgctgacttctaatctgtcccaccgggcgtaccaaaagcgtgttgacagaaaacacgaggcctgggagatctgcttaactccagtgtaggtccaaagctcgccttcgaagaaatatataagcgtgccagttgatttgatcgtgtaatcaacaagaaataaagacaaagaattcgtggttaaatctataaatgatagccgatcagctaggtgccgatgacatatcatttatctttgagccgatgtcatttatgaatcgattgacggttataaatagatagtaaggaactaaatctattcgatcggctgtagatattaacgatatatagttcttatattaatatatacttaaatcaagtgattgggatagatcggtcaccatgccgagacagtataaatcacttagatcgaaatatatattaataacaacattatatatgtttatagcatagccaatcagatagatctagcatgtatcggttaatactccgatactactctatataaagatattaaaacaagtataatatagcaaacaaaagcttaatatacttaaatgcaatgagatcttgacataaagggcggatttaacatgtcattgaagcatatagatcgaatatggttaaatcaaataagatcggctgaaactccgatactaccctaatcggcaactagaggacaggctagagattgatattctaagcacgacttaatagatcaaactcaactgatgcagcattaagtatgaaaagaagaacaatatctagacaatcaagccgctggatgtttcataaagtggtagatatcttatataatctaggacaacgtcgctatttaacctaatcggctgccttctattaacagatgttagccgattgtaggttagatgatgatattgccaaagattatgtaagatatatgataactcgacgaattatatagacaagataagagtgtcataaagatggaaacactaatctcgagaacacaagtcgtcataacaagttttacctcttgttgaagatcgaaaccgatgcagctcaacccgaaagcaagaactcgtcgaaacaaaactaaagcaaaaaggtggcaatgtgccgaaattgtattgaatgtgtgtgttaaaaattacatagggctcggggtctatttatacccgagaattacaagatatgtccataccggacacgaccactatctctaacaaactctaagatacaataagtctttgcggcagacttttgcctaaacatatctctaaggaagttacataaaacatcctaattaatagatacaattgccttctcaggactctatccatttgcggcaatcatcttgaagcacctcaattcaacccgatgtcatacaccaaattatactgtcggaatcggctgcatcggcttacctagtctgatgtgacca

SEQ ID NO: 51636 - DNA, 997 bp, Oryza sativa
agggaatcatggggagtgatttccccctctttattgcgcccggggacggcgggaggcggcgggattcgcggcggcggcggcgctagggcacgggcgaggcggcgggagcggcgggaggaaggggatgacgggtgggccccacccgtcagcgagggtggcgtgcgggccgcccgtcagcggcacgcgcgcgcggggagggggccggatgggccgcgggggagaggagagagagggagggaggtgggccgcgccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacagcaggagaggcgttatgaagaagatgatggcggttttggtcctcattggggttgtgagttctttagattttgctggaatgaaggtatgaggctgccatctattgaagactgtcctgggtgtagcaatgttgcagaaagttcaagccaatcgtataatagaggcaatcggctaaggcaaacaagagttcctgttcatcaaagattgagtccagtgaaccaagactgtgaccaagaggacagtgaagacaggaagacccaatggtgtccttctggtatttttacaaataatcagaagagaagggttcaaaggttgaggaatagggaacgtttttaggaggttgagcaagagatcaaccatcggctgaagaaaacgaattcgaagcaggaatggcgcattaagaaacaagttcctacagccgatgaagtaaagagattggctagaggaaaaagtgttgtgactg

SEQ ID NO: 51637 - DNA, 499 bp, Oryza sativa
catatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcacgttcctattaactactagg

SEQ ID NO: 51638 - DNA, 1501 bp, Oryza sativa
gatgtgattgctgatgtaatgagggaacagtttgggcttaaaccaaaagagactgggagcttgtatcggcagccttaccctgagtggtttgagagagttcctccccccaatcggttcaaagttccggacttctccaaattttcgggacaagatggtgtgtcaacttatgagcacattagccgatttttagctcagtgtggtgaagcatcggctgtggatgctttgagggttaggttgttccggttatctttgtctggatcggcttttacttggttttcttctctgccgtatgggtctgtcggtgacatgggatcgggagtatcatgactagaggcttgaggcagacacaatcgcccacgtggcctggcacccccgggggacgtcgggcccgagggtgatgtgttcgccctcctcttagtccccccgagggggtcgggctgcacccccctcggccccgagggtcgaggcgccccgacccctcgtgggttttcgctccgcgcgtatgagttaggtgagcacagtggggctcacctaaccacatttattgcggattggctgagtgtgtcacgacgcatgcaacgcagtgcattgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctaacaccggtcatgtcgccagcagaccgccatgattccgcgtcgcgcctgctcccggcgaaagtggaggtagttgtgggccgtcccatcagaaggcgactcggacggcaacgatgcaaatctccgtccatttatgaaaaggtagagtaagtccccagggagagggagagaatggtgcatgtggtatccccttaagatatgaaaggaggaccttgcccactgaggagaaggagagagattttcgagagctttttcttggactgaacctttccagattaggatcctagaacaaaggagaggctggctcatactttgtagctccttcacacacgaatccacctaaaacacaggagtagggtatgacgcttctaagcgtcccgaacctgtatacatcgccggcgtcttctgtgcttcctgtctggcgaaccttccacatacagattgggagcttagagtctcacctagggtccccggccgaaccggcaaaggggggccagcgcggtctcccggtgaggagccccacgctccatcatctggcgcgccaggtaggggactctgtgagtgatcttctgagctctcgcactccttcgggtgcgccaagcttttcctgttcggcctaa

SEQ ID NO: 51639 - DNA, 1501 bp, Oryza sativa
gcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcacgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagccccgatcgatatatgccaggcttcatcctaaccattacaagcaaaa

SEQ ID NO: 51640 - DNA, 163 bp, Oryza sativa
cacaagatttgcttggattaaaaaacatttaccacaaaagatgccgcaatacttattgtggggacatccactactttttatccttgcatacgtctcaacaaaaagcattagttaccctctaattgtgttgtcattaacaccaaaataaatgaggggtcctaga

SEQ ID NO: 51641 - DNA, 1501 bp, Oryza sativa
tcatttgcaaaagcagcatttagcaaacatttgagaatttaacaaaacagttaagtaataattaaacaatattaatacaacgctatacaacataccctgttgtataggcccaaccattctgaacaaccaccccggctgcacagttctatctccaaaccaggaatgtcccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccagaaacgacggaatctaagcaaaaagaagcaaaatcaccaaaacagcacataaacaagcatgaacagtacatgtggatatttttaatgtgtaaatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcggctagggtttcggtggaccggcgcacgggcggcggttcacgcgaacggacggccgagatctaaccgatccaagatggacggccgagattgatcgagtccacggcggttcacggcggacgaccccgatggcgtcagcga

SEQ ID NO: 51642 - DNA, 1501 bp, Oryza sativa
aactttagaggttgacttttttttggacggagggagtataacccaagttctcgcaaaacttgcatattgatgtcattctcgacacttctgcgctattaattcagctatcttcgtcaaagcaaaacaattacaacaggtgagcatatgaactttgagatagatgtggtcaaagcatggtgcgctttgtgatctttactttaactttttttaaatgttaaatgtatgtacaagagacaataaacgtcatacattaaagagagtagctaacaaccaacaaattaaacatttagatgcgcaattaatcactgtttttgttagctagtctacgcatggatgatcaaccacatttaattaagggcatggcattgttatagatgatagaattaaaccgtacctagaacatcgatcatatacaaacagctcacatggccctcttgctcgtcgtatgtactatagtacagtactgcacactatatactagtacaacatattagtaatatactccctcatttcctaaatgtttgacatcgttgacttttttaaacatgtttgactgttcgttttattcaaaaacttttgtgatatgtgtaaaactatatatatacataaaattatatttaacaataaatcaaatgatagaaaaagaattaacaattacttaaattttttgaataagactaacggtcaaatatttttaaaaaagtcaacggcgtcaaacattttaggatagagataatagttagatatgtacatcattattagtgtccaagtaaatccaaaatgcaattattttgccacgcccatacaacgatgtactaattaaagaacatgcatctctagctaccacgacacgtcgacgcctggacccttgaataatgcaggtatcgaaaagattatgcttctaatcacctgtaactaattaaactagtacagtccctcagttttaaattactcagcgttttaagattttcctaatcagaaatccgtacatatgtccatctaactctaaaataaatcatatagtttaactatctttttaccattacacatgcaacaacatactcacacacttctatacccacgcctcctgacataaaccaacgacatcttactaaattttattcgtgtgtatcagtatttgaatcatgatggatgaagccaacaacattataaggttaatctttttagattcacgctctcgtaataaatatataatattcaaatattattaaaccacacaaaattttaaattattaacgttttaaaaacaactgttttaacttagcataaaattagcgacgagtaatttgaaaattgggaataatttaacaattagacgtgagatttgactttgccacatcacatgcgtgtgcctccctttatatgctcttctctcctcttcctcttgcctcgcgagctcacgtcaactactcgaattcgagctcgtcggcgaagcagcagcagccagctgagtgaggcagctaagcttttgatcgatcga

SEQ ID NO: 51643 - DNA, 1256 bp, Oryza sativa
aagaaaaaaaattgctagagattaagaatatttcacacatgtcatgcgtaagaccccggtgctaagccaatcaaatcatagttgaatacaaatattataggagtataagttatattgtagttacaatgcagttacagtgcagttacaatgtaattacacttcaattatactatagttacatttgaaagttttacattcaaaaatcttacaacaattttttagatactcccttaaattaaatagggttgagaaaacagctttgctattagtcgatcgatatatcattgcctaaacttttcttagtgtcaatcgcctaaacgtatttgcggtctgcggataacctaattaaacttcatgcacatgatatgtaaaaaaaattaaatcaactttgttgtgaccatatatcatcattatgggttctgggcttctatatatggcgatgcacattattattgtcacgagatacttttgccgacgtgtcatccgtgacgagccttatgacgctagaattttgtcacataacttgttctatgacaaagctaggacttcactttgacattttgagatcaccatcaaatgtcaaatttcttgtagtgttataccgtgtaaatttttaactcaaaagaaaaggaaaacaacatgtagataaaacttctcaggccttctcgagttctggttggcacgagggataaggggatccgttgaaaaggctctgtctctcgtcgttgtgaagtaagttgttgggttttctcaaaagtctttcaggttttaaatgtattagatagtctagggttagtctttcgtctatgggttaaatatatttagcatcttgctttttctatctctttatcaatgacttctccctttgttaggatcacggggaagacctaggtcttgtttgctaggttaccgatgatccaaccaatgatgccagatttaggattcttgtgtaacggggttactgatgatccaaccggtgacatcaaattttgggtttgggttgccaacttgttcggtaatgcttgtttgctgactatcaaagaaactaaaatggtggctgatgctcattcatatgctttcacttgcgttggagttggtcaatgttatggctgcacttatctgctcatatcttttgtaaccatccaagatatgcaatgtctttgttatgcttatcaagttttatatttctctttatcgcaagaatatgtttgcgatctcctctcttatttaatatgtttggtcctgttttgcgataa

SEQ ID NO: 51644 - DNA, 1501 bp, Oryza sativa
gataagctccatcgtcttgatcaggtcgtgttggagtagattggatctcgtctgagtggtttgaagcaagctcggttgagatgatcctggagtaggtctcggccgagttcgggataccgaacggggcggaaacctggcctcttcccgactggttcgaatccgagtcgaggagagaaatcttgccgaagtcgttggtgatgaagtcgaggctgccgaaccggaacgcctgcccgagagggaagacaaagtcgtcgatgccagagacgaaacccatcgcactagtcggcgaaaaacttgacgctacccctacctggcgcgccaactgtcgaaacaagatttcggcaatactaaaagggggtggctatcaagctggaaaagtggatgggttgagagacaaggaattttatacaggttcaggccttcttaacaagaagtaataccctactcctgtccggggattgatccgccgagtgtattattgatcgtatgatctaggagcaaaatcgtgccccaagaggcacccggacccctcctaagtacagtccatatctctaatggaataggtagttacatacaaaatacaatcgtaaccaactaggatcccgggtatttccttgacatacaagtttggaatttaacccgagtccctttaaagatattctatctatacatggcaccccatacccagtcggatatacatgtcgtgtaggtatggggtatccacaatctccaccatcagtttggcacacaagacaacctccctgattattgatgtgtttattccctgctagtactcctggagcaggagacaccatgccatgtaaagctcttcaaccaaagattttaactttttttcaggcagattcatcttctagagtctatcccgaacaccagaaatatcagcgttgccttctccattaagtagcatttcctatgcatatctaacagtgaacaaactggtgttggaattctaccagtggtatctctaaaattcgattaactgccgaaaataaactttagaccaggtattcatcccaaactactagattattcaaatcatttacctaagtttgataagagaaatttaccttctggcggtgtaagtattgactttgagattgtggcttgaggggatccagttggcctcccaaatggtgtaccatatcctttctttcaaatacggtttcttttgaaactagctaaatacccctgcgatacatatagtgaaacatcatatccatatgcaacagggtttgttacaattttgtacatgtgtgttgagctacacagtcactcgtagtgagaaacaattgaatataaattacccatgtgtatttgattcatacaatgaagattaacatcatgaacccaagtgacattcgaccaccaccatcactactatatactaccacctttttaatatacgacgctattaacttttcaacaaaatatttgaccattcattctatttaaagtttttatgcaaatataaaatatttaa

SEQ ID NO: 51645 - DNA, 220 bp, Oryza sativa
caaatgataaatgatagtaaaaatgagagaagcaacatgcgtataaaggagtagattggtgatggttgatgggaaatccaaaaactattaagaaaaccccaaatagaatcctaatagcgacaatgaacatgcagttaagcaatacgggcacagcggttggcaggacttctaaaaagtaaaaagtaaaccccaataataattatgtttgattaaatcttaa

SEQ ID NO: 51646 - DNA, 1501 bp, Oryza sativa
catattcaatatattctcaattctattccaaatacccatcttcgtcgaaacctttctagccctgtcacaagtgaaaagaatatgttaaatatcctcgcaatcggtgtcgaaacaagatttcggcaatactaaaaggaggtggctatcaaactagaaaagtggatgggttgagagacaaggaattttatacaggtttaggctttcttaacaagaagtaataccctactcctgtccagggattgatccgccgagtgtattattgatcgtatgatctgggagcaaaatcatgccccaagaggcacccgaacccctccttatataggggaaggggttcgtattacaaagtacagtccatatccctaatggaataggtagttacagataaaatacaatcgtaacagactaggatcccgggtatttccttgacatacaagtttggaatttaacccgagtccctttaaagatattctatctatacatggcaccccatacccagtcggatatacatgccatgtaggtatggggtatccacaatctccacagtagcccctgagacctttacagtcgacgaagatagtcttctctcgtaattcaagcaataatccgagtgctccaacttcttttgtcttggtctccctagtaccaaaatcaaagactgtgaagggctccatccgagtggttttacaacctagtctcccaatgtatcatatagctaagcatatgcgacgtttagtaaaacatccagccgactgctttagctttaatacacaaaaaaggagatataaagaggcccgagtgagaaaacactctaaaggtctataaatcaacacatatgataaaaatccgagtaaaaactctcaaaaagatccatcaaatgtggtataaagcatgacaaacgatgagtctaaatagcctaagctatgactcacgtcatgattaaaataagcatataacatgctgagagaatgactattcaaaaccagtcatctcaacaaaacccgaacagctttgtagcctaagaaggcctacaaaattagtataacacttttctgttgggcacctttttatgtgcattgtagtaattccaaaaaattatctaactgcgtcaaaaaggattttaatcagcattgggctatactgtcgtgagcaagtgttgccaaagcaaaaacaaatgcctaagtccctaaggatcacaactagccacgctgataataaaattgggctgaaatactgtttaggcccaggcccattagcactttcgatatcctagcgaaataaacgccgaaggcaaggcgtcgtttcgtcttccccgccgaaactctcgccactttccccactcactgctacagtgcgaaaccacaccggcaaagctagggttcacaaattccctccaatccattcgctagagctccacaaaaatcttctgcgcaaccaccgcatctgtctcccttccattcccggccatttctcaaaccaaatcgcatcatccaattcgcatcca

SEQ ID NO: 51647 - DNA, 1501 bp, Oryza sativa
cattgaactgagatagtcttgagtttaaaacatatcttgaatgtgttcctgaatttgtgcatgattgtgtgagctaaactattttgtttactgaactaatctttttacaatgagttaatactagaattactgtgattcttgtatgtaattttattacttttttactgtaacatgttaagaaatttgtgagttcatatgaattggctcttttgtttgtgctgtatgagatattgaacttttatgtaatattgagttggatgagacaagtggttgacattgagatttgaatttgtcattagtttaatatggtgattatgctgataaaattgaatgtatgacaattcaggatatgctatatggcctagttgttatatttctgtataactgtataactgtgatatcttcagagtgaaattcagtaaggttggaagactaatcaatctgtcatgttttttttataaagttagtttggtattcatcaatagtacacagtaatacaatcatccagaatgcagttttgtagtactgaatgcagtgtagttttacttttaacattacatagttcagatctacagagcaaacatatgaaattttcagttctgagttgttgtatttatccagcaaagtggattgttaaccttgtttcatttgacatattcagcaatttcatgtattcttttgaattgtatatttgacctaaactctctctttgatctttttcaggaattgtatataggggataagaattggaaccttgaactaaccttgaactggagccttcttgtttctcttgattttgccttcctcttgttttttctttgtgttctccagattctgtgtttcctttgtatggatctcaactttctgttcaaaagttgtctttgatttcttctttcctctagaactactctttgattctgacattgtactctctccttccatctgcgatttggatcctctttttctctcttctttctcttctcctagctccatgtttgattcgtgctagatctgtttgtgaactagtagtgctgttgaaaagtaggggattgaaaagtgtggtcccatacatggttgattcacgtgacatgtttttcatctacttggcttccaagtttggtccctactacttttttggataggctgttggattatgatttgggctttatttccttatgttttgcttctaattttgtatcttgggcctgctttttactaatgggcttttatggatctggatatggacttgggccttcaaataattcgcatgggcgaaaaaatcatgggctttgtttatttgtgtttgattcaaattttgtattttgggccttctttttactaatgggcttttatggatctggatatggatttgggcttttatggatctggatctggatttgggctttaaaaaaatggcgttcaaataatcaaataatatatctgtttttaagtgtaatatctatttgtatcactttttctgagttgctggatgtgcatccta

SEQ ID NO: 51648 - DNA, 1501 bp, Oryza sativa
tgcgcggaggtgcagtttgtcatttgacggatgttttttcttctcaaaatacttgcatacacatatttcaccaatactagtggaaatgattagtaataatccctaccactaagttggataccataatttaattttattttatgtaagtattgacgatcaaatattatgatttaaggaccatcaacaacacccccacacttaacctttgctcgtcccgagtgaaggctatggactctacaatagggttatgacttccttactaataattatgcaaacaaattattcaaagccatacatgtacttgtgggtctttgtagtgtctaccatgcgatcctgagcaattgagaaatggaacaatcttgactcaagtcaccctaacttttcatgaagaacaacttggggttttttttaagtaacacaaaattataactttgctttgctcctcaattgattctctcgatcactcaaagtgtggaatatttattggattcttaggactctattttgttttttctatgaatactctaggtatttcaaccagaagccagaagggtataaaatccccaaaaaaaatccattggtctaaatattccttatttatccattctctatccatcacccttgctcacccttttcctctttcactattcatcatcttgttatactattcattggttgatctcccaaatgtgaaatcattgtcataattaatatttgtgatgaacaattggctttgtaaaataatttaatcaatgaaaagatgtgtggatgttgatgtgagtgtgtgtgattaatgtgggtcaggttgtgatatatgtgcccaggaacagttgttttgtctgattgtgtgcaggtgacttgagatcagcattagtcaatggtgaggaccgggaatatgctcagggaggagaagaggtctagtgcggtcgggataccatgtgacaaggtgactagagtcaggattcttggaggtcaacttcggtcaacggtggggatcgagactagactcagggaagagttgaggtccagatggtcaaggataccgggtgacgaagttggatacagatggcacacggtggatagacattgtatgagagagatcttcacaacgggcttcacgaggtgtgcgtgtaagtgccggtgttcacgaaggagattggagtgagaaattgagaaatgagtgcgttctgtgcaacacgcagcatgcagcggctcggttggatggagactgagtcggccaagttggctgggtgtaacgtactaaaaattagctattttctaattatgcatcatgccggttcttacgttcttattaaccttctaaacatatgaaaatataattagagagacctcctaaaaactgacttgcataaaatctcttgtatttcttttgtggttctcctttaaaatttatcttgggatatttcctgatttggttttaatttaaaaccttcttttggcaaaattcattttattcaaatttagtttgtaaacccttttt

SEQ ID NO: 51649 - DNA, 1501 bp, Oryza sativa
tcactgggtgggttcatataatgcttaatttgttgttgctgtgttgctttgtgctatacttatttttaaaatacaatactctaaaagcatatgcaaatatacatcattagggtgtgtttggcaccctctttcctaacccctctccctcgtttttcgtgcgcacgcttttcaaactgctaaacggtgcgttttttgcaaaaagtttatatatgaaagttgcttttaaaaaaatcaaattaatcctttttttaaaaaaatagctaatacttaattaatcacgcgctaatggaccgctccgttttccgtgtttactattctagttgggaactgaaaatagcgaacacacccttattagtctaccgtatgaatcaaattatctttagatgaaataatttatccaacagtgtttgtgtacatcataattttttcatatttttcgaatgccataatagtgttgtttgtaatttaaattaaagagaaattgatacctaaacaatacaatgtctaattgtaccaagatcatagcaacttcgcaatccgctaagtgccaaatggagcctaagttgatcacttaattaagcctggaagttcattttcgtttctctgcaattctagttagtacctaacattcatatatatgctttccatgataatgcgtactaggcaatataatttttgggaatttcctttgaatcagtttacaattgagtataccttaatttctgtttttctcttagattaagtcgcatggatcttcaattgcaatcattaatttggatgtggggggggggggggggaaataaggcgtgttctgcgttgcaaagattaaagtgaatctttgtttagattgagagatagatagctagctaagctggttatcttgtcgtcttttgtctcatgaaaatattgcatcatgtacttcgaattccaaaaggtagttagcaaaaaggtgcagaaaaaatagaggcacaaatgtaaagaaggaggcatgatactagcaaaggaaaaagttcttttgcctggaaggatatagaaatgacaagtggttcaagaataggtaatctagcaacttttttctagacttctaggctataattaatcagattgcatgctaggattcttatgtttgcaatcatgcaaaatatgaaattctaaagttacatagtcatgttataaaatttaataacaaaactaagttgtctccattctgcccaagactgatatgatagtcttggacaaatgtaacatgggactatcaaattattacaatagaatgacttttaatatcgacataaaggaccgatatgtttagcgaaatatttattataattcgttctattgttttgggagaatatatatatatatatatatatatatatatatatatatatatatatatatatatatatatatatgtgtgtgtgtgtgtgtgtgtgcgcgcgcgcgcgcgcatatacacacacgcacatggtgaatagttgcctttttgcgatagtattag

SEQ ID NO: 51650 - DNA, 291 bp, Oryza sativa
ccgcataggcagagaggacgctggcaccaaggtggtagtaggtatacacaaggatcgctacgccagtttggatcctcaacacctcggcgtctagccattgacgaaagccggtcggatttgtaatgaagcaagtggagaagagagtactgaatgtgactgagttttgaaagattgtgaggcctcactcgttaaggcgacttatataggcgcaaaaaatcgagtgatacccctgacatgtgaacgtggtggggtatggtgggtacgcctgattggcgccgaaagatacatgca

SEQ ID NO: 51651 - DNA, 370 bp, Oryza sativa
tatgacgagaataattaaaaataaattctaaaaaatagaaaaatacttgtaagagttcaagtaggaatataatttataaataaaaaatattggaatgaaaaatatggactttacaaaaaagaagtttatctagaatacaaacgctgacaaataacaataaagagaggagaagcaacatgcctttaaaggagtaaagtggtggtggtagattggacatctaaaatattttaacaaaacccaaaataaaatctcaatgacaattaaaagtagggacgatggacatgtcgttaagcaacactgtcacaacagttggcgggacttctaaaaagtaaaaaaaaatgataatcaagttcagattcttaaaatctca

SEQ ID NO: 51652 - DNA, 1501 bp, Oryza sativa
gctgccggctcgccgcctcgtcgtcgttgcaccaactgccgcggtgccacccgccgcgcccacgcgttggtgcctgcgatgcaagcgctgagaccggagagcgagattgggagctaactagaggaggcggaaaccctagaggaggagaacggaaacccaggaggaggagaggaggggaataaggagaagagcttacccttctcgccggaggaggagtctcggcggtggcgcgtctcgccggagaaggaggcgtggcggcgcccgctgttgttcgcgcgagagagaagcgactccggttgcgcgagcgagaagcagcggcggatcgagagaggaaaaattcccgacctccggaggtcagggacctttccctagggtttccccgcggattgggccgggaaatccctgcctcgtgggcttccaaatggacatggaataaaacccgtgacaatttcccccgtgggcttttctcccagggaatgggctgggatcccggtgggatcccgggctgccaaaggagcctaagaagaggtatgggcagtattgtgattacgaaattcactgaaactttatgaaacatgacaaaggagtctaatcggtaatacagtaacacggagagtacaagagaagttacatacgacttgagcccttatttccaggtctttcggtgctgaaagtgaattgggagccaaaaattctaacgacaaaccgcgtgcaggaggctgctaagaaattattgcctagaattatttggttccaatgttgacagatgccaccaatggccaaataagttaaaacatctgtcgctgcaattccggagatactctgatagataatgacctagcttgactattctgatagatactccgaaaaagttgatgcatactcgcgcttaatttactgtttgtttttgtcgatttatgcaatgtaatatgctaataacgatagcacgatcgacgactagatttttatctaaggtgcatgtactgctaccggcataatctaaaattaatggacgctcttgattgctcgcagaggagaaaaaagaactgcttttttaattaaaagaatagtatattatatatttttactgtgaatatatgataggacgacacgcttaaatttttatctaggcctgccatctatcggtatgatctaaagctctgattccaagaggtatttcttccgcgtgcttttagcggttgcgttgcgttagccttcctgtgctattcatagcctagctactccgttagttcgggcaagcaaaagttgagttcactctactactccgagactcctgagtgtttctgcaaaaacttgaggagaggggagagggtgatatccatggagatggccgacccagctgagagaagacggacgatcctgcgtcgtcgtctcgtcgacgagaaaactccatagcgtttcatctccgcttggcgatcatgttggtgatgatgctgagaaagctattactaaataccttcgtttaccctatgcccgtagg

SEQ ID NO: 51653 - DNA, 1501 bp, Oryza sativa
ttcttcaaggagccaggcatgcatcagggcaaaaaagaattgtgatttagtttgaaaccttgcatgaagaagggtcaatatttcaagctggttggaataagaatactattgaaattatgaagggcaagatgactttgatgatggctagagtgaaggtggagtcggagctttacgaggtgtgagggtacactattgcatatggagttcagactaaagtagtagtttatgagatagctattatttttagtggcggtaagcttactatttttagtggctgtaagcttactacaacctcgtcaggaggctaactatcgcttcttggtggaggtgcaatagaagacaactcaagtctaaaggatcggtggatcaacatgatgattctatgatctatgtggcgtatattagaataagtgtcaaatatacacagtcctagtagttacaattaaactttaagttatataatagtggtaggggatggagttagtatcagaatctgttaccagacaatcctttagatagagaagggcatcacaatataactatggtgataacaatgtacacaggctagtattagcgtgggtatggacccacagcgtgcaggttatatagtagtctcatcggtagaactagtcttagtcattgattcatgtatttcactaccagtaaaaataataaattatactcacttaatttcattaccaatatttatggtggtggtataaatagatatatatgatctatcgaataagaaaataagtacagattatttcttacaaccaaagctactaccaataggatgtctgatttcctcccaaaaattagcggtcaaatgttttaattgatcaccagtcaaacattaaattttacatggtgaaaacaaatttagccattaaaacattttttcttgaaatacttgttgaaacatatgttttcctttcattagaatataatcatgcaatatcttattgtaatgatttaattgcaacgaatacaatgatgtggttggatggtagaccagataagtaatccaagagaagaaatattttaagcttactaataaattaagccttatatgcatgcaagagtaaggctaagggtaagggggagatagcaccagttgcacagggaaaggcataatgcattaaggtgtgttgtttgggaaaaaaaaaaattggatgtcatatcggatgttttaccagatgtcggaaggggttttcggacacgaatgaaaaataaccgcgagacgaatcttttgagcctaattaaaccgtcattagcacatgcgggttactgtagcacttatggctaatcatggactaattaggctcaaaaaattcgtctcacgatttccatacaaactatgtaattagtttttatttttatctatactagaaaaaatagaaaaaaatattcgtgcgttgcatcaggttaagtctattttaatcttattattgttatatggtttagttaagatgaaattcactgtggaagttcacttgga

SEQ ID NO: 51654 - DNA, 1501 bp, Oryza sativa
aaatatttttaggggtggctactggccagtccaatagaagaaggaaacttatcctaaccaatgaatataaagcataagaaggtgacagtttcaagacaaggtttaagattccttcttctgaaacacaagggctataaattctattatgcagttctgatggttgcatcaactccgctaaaaaagtgactatataagctgtatggcatacaacaaactattgcaagggcactaacacctcccaactcaaataattgtagaaacatatattggtattctgagctgctaaaaatgtaaagctgcaaatgccaagtattatatatgatatgatggtattcacatgaatgaacctcaataatctcatgaaaactataatgccaatactcaaatcgccattgcaggacaatcacaactgaatcacacatagcacattggctaccaacatcgatccgcaattcagcactaaccgatccaaactagacattcgaatggataaaacgcaactcaccaacctcacgaccgaatccaaatcgaggcagaagatttgcttaccacatggagccgcggtacttgagggtgtatgggccggactcgagggagcggtcgaagtgggagtggaccttgtgcttgcccttgccgctctggtcgagcagcgtgagctcgaagagggcgcggacgtcggtgccctcggaggcgagggcgatgaagacggagacgtaggcggagttgtcctcggggttcttcccgtcggggtagaagtagaccgcccactggtagccgccgacggagaaggtctcgctggcgatgtgcttcccgacgcccatccccttggcgagcgagtagccctggatcacgaagcggtgggagccgttcaccgtctccgtcacggagcgggagctggtcggcgacgccgccatgtcccgcgactgggcggcggtggcgccaacccccgcggcggccggcggcggcgaggcgtcgccggcgtcgtcgtccatgggaggggaggggaagcggtggtcggatcaaagctagggttagggcttggggaatggggaattttggggtgagcgtttcgggttcgatgcttcgggtggcgaggcgacgtggcgatggcgttgccaaaatggaatatacaactactgaaagaaatacagacaataattcactgtagcgactagcgatggtggttcagggggagttggtggctgatttgagccgttggattgaacgctcttcccgtgaaatttcactgttttggcaccggatatgtataaatgtgcatgtccttcggaatttgctatctaatccatgtcagcagatatacgaatttttagtttatgctattctagtcatctgacaatggtgtttactcatatgtattatataggcagacatatagtgagacgagatggactacgatgatggataacgaacggagtgatatggaacttagtaattcgcatccccatagcaaaatttgaaagatacgtggattggatgccaa

SEQ ID NO: 51655 - DNA, 885 bp, Oryza sativa
ttaaattgcttagtttttgctataaacagctcattgccatattcattaatttcgttagttttactattaagggtacaggggcttagttttactacaagcagtgagatgccgtattaatgggaatcacttcaagggggcttctcagtgtctgacatgttaattacaccatattaacatgtaaggtgcagccagcgctggcatcagtcggctctgttacatatctagtgttgttagagcgagtacaatagagtcagttgtaagcacacatgtaagagaaaagagaaaagagagaaggaaagtgggctacatagttgtagccagctgcaacacagactccaatacattgtgtgtacgaaaagtgggaccatatattaataatgtagtatatacttataggtaactattgtatgaatgagttattatgcttataggtaactattgtacgaatgagttattagattggctgtagataaactgaagctgtagttggctatactattaaacttgctcttaagggcagtagatggttacgattttccttctagattctagtaatgaaatagcatgccgccattaattataaaccaaacatgttattctagtcatgcaaaaacatttaagggcagtaggtggttacgattcttcttctagattctagtaatgaaaaagcgtgccaccattataaaccaaacatgttattctagtcatgcaaaaacagtctcaaatctataattttgtaataaattaatcaaaatacatgtaattttgtgaaattactttcattataaaccaaacacgtctaactttatagcgtgtttgattgaaaaaaataatatgatgtgctaaataatggatttcgtttctgttaatttcatttgttgcagg

SEQ ID NO: 51656 - DNA, 1501 bp, Oryza sativa
accgccggggcgggatcaccgcgccctgacgataagcacgaaaccctgtaaaaattatcaaaattttaaattatattttaactttatttgaatttaaggaggttaccgtggtttttcttttactataccccgtggtaagggcggttaccggcggttttgcaaaccctggttggatccttttgggcggaggtgtcgtattctctaccagtgtcttctccctcctaatcatgagttcacgacatccggcggcaggcagatgaggctaagatttataaaaagaacatctagtttgatcgtcgatttttgagattttggaaagatgagtgctctagcttctgttttctagtttattttctggattctagaattacagtttctcataatctaaacgaaaagtttaactgtttggaggagcttctgattctgcggctgctagaaactccctaaacaaggctacacaatgttggtaactacgacataaggtattattactgactttaattttgttaatttatgtgggaacttcattgaaaaaattgaaacggaactatagtaataaaaatataaactagagagatggaacgtggtctatatcgctccacagtttcactcaagagatggctcttgtagttagttgtaggagttagagtcttatcaaaccaaacatgccctaatcgtgtggttgtgctctagctctaataaaaggtggatataggagctagagctctgaaaaaaccgttagtttcccacgacaccttgttgagtttatctactaacatatgctaacacaggatagggatcgtcgtgtaataacttgtcctccagaaccgcacaacacgacgcatccgacgagcgggtccgcttacacatatcacccgaaaagcgaggtgatatgtgtaagttggcccgcctgttggataggtgaggctacaagattagaaatctaagtgggcctttgtagaaaagtggttccttaataagagaagcttaccaaagtcatcgatgcaaatttctctgcaacaacgagcaccacatgtggctcaccacaaggtcgtcagtactgcaaaggagctcgttggacaagacgagcgcataagctcatcaccatcgtccttgattgcatagtgctcatgccccacggagagagctgacatcgacaatgacgcgaggcatctagtggaataaaagcatatgagagagaacaacgaggagggtggagaaatatccactaaatacgtatgtcttttcaaaatttggcatccaatccacgtatctttcaaattttgctatggggatgcgaattactaagttccatatcactccgttcgttatccatcatcgtagtccatctcgtctcactatatgtctgcctatataatacatatgagtaaacaccattgtcagatgactagaatagcataaactaaaaattcgtatatctgctgacatggattagatagcaaattccgaaggacatgcacatttatacatatccggtgcc

SEQ ID NO: 51657 - DNA, 549 bp, Oryza sativa
caaatccgcgcgtttgaacgtgagagagagaggggaaaatggggggaaagggagagggaatcacggggaataattcccccctattgattgcacgcggggaggacgggggcggcgggattcgcggcggcggcgctagggcgcgggcgaggcggcgggagcggcgggaggaaggggatgacgggtgggccccacccgtcagcgagggtggcgggcgggcccgcccgtcagtggcgcgcgcgcggggagaggccggatgggccgcggggagaggagagggagggggaaggggatgggccgagccggcccaagagggagagggagggaaaggggacttttcagagtttttctttttataaaatcattttaactttgtttatttcttaataattattatttgtgctctgaaaattccactaaaatttatttacgcattttaggcttttaggaaatatacaaaaatcctctaagccttatttgacttttaactttgcacattttaattgttggaggctttcacacggattttaattattctaggcaccatttaga

SEQ ID NO: 51658 - DNA, 1501 bp, Oryza sativa
gaacccaatggcggttggaaagcttgaatcgaagtgggaagggccatacctcatcaagaacaggtccaggacgggctcttttcgcttggcgacgctggaaggcgaagagttcgaccactcctggaacgctgcttctcttaagcgtttctatgtctagaaggggtggcaccccattcgccaacttgtaaaaatgtacatactattatgtaggcccttcggcacaaaaatacaaaaaaagaggaaaataaaaaaaggaaaaaaactggatgtagggctattatccatcctggaggcccgaaccagtatataatccatgtgtctttcacctttttacttgtgtaaatgataattcgtggaaaaaccctaaggcaaacacctgataagcgaaagcgccaggggggcgaaatgaatcgaccgaagcatcgctcgctgaacattgaaaccgcaacatcttgtttcgggaaataaataaccgaacacagtcatattcgatctatgtgaaaaacacgagcatttctttagcgcggaatactacagatcgaaaacggaagtaggaagctgaaaagtcagcagacatatttcgctaatatacgcaagggggccgacatatttcgacctaacaaaatcatgaaaggtgactatgcgtacaatagcgaaaaggaaataaaacacatcttcattaacttcgaaaaaaaatataggccatacaacatggtacaggcgaaagaaggtaacgggctttacagcctaacttacaaaaaaattacatctccacccccaaaacaccctccacgccctaaggtatgatctggcgaacttggttcgtcatcactactaatattatacactaccctaagaggagaagggggcgagacataaactagaccgtaacggcgttgggcgatcgcttcctgacgatcagtcctccgatgatttcaccaaaagcgagccatgtcctcccgatgctccacatggacacggtcgtagtcgtccatggttcgcccggggtgtgcccgcatccagctggaaactttcaaaaccttgtaactattgccatttattatcatctcgcaacatgaatacttaaatttcagcaagccttcaactgtgatgaatttctcattctttttacgccaatctctgaaaggaagccgaacacacaatttctagtgaagaccctgctaaaacaacataaaaaggggcaaatgggaaagcacaaggttaagagagggcgaagctcataaagcgggcaaaaagtgtagcccctattcgtgtacaaaatgatgcaaccatacatatcaaagccctaaaaacgggataattggcgaaacttggttcatctattccatataaaaaaggccattttcggctacagtacaaaagggggaaacatcggccaaatttacatcgttcgccttccgtggccaacgcaaaaaatctaaaaatctaaagagcgggcggagggcctcacacctctgggtgattatggccgatgtctacc

SEQ ID NO: 51659 - DNA, 1501 bp, Oryza sativa
agttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttttggcgctcccgggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtgggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaagttgctgatattgcctcacgactaaccaatacacaaagtctataatacgcgagaaaaaccaatattcaagcaacaatcaaatatacacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctactatgtggtttagtctagcaaatggctattcatgcatctatctaaatagaacggttatacactagagattttgttgccagatggatttggatcggtcaaataattactgtgaatcatttgtattattattttattgatggaggctttattttaattatgtacatattttacttgtcaaaataaattataaaggttaacaattaccct

SEQ ID NO: 51660 - DNA, 1501 bp, Oryza sativa
aactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaatagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccatgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacttaactgcacaagactgacaattcaaggcatagtccattgttcagttgtggtcaggtatagctccttttctaggtgaaagttcaacttaacagtcttcaccgaaacactggtatataaaagctgctatggaatagagagcattctcatgagccttgaaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacatttagttgctctattcctcttcctattccattggtaacttacatcaattactcttaattgattgttggttgatggttgtgtagtgaaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctgttgttgctacggtaatcccatcccga

SEQ ID NO: 51661 - DNA, 1501 bp, Oryza sativa
acaacgtacagataataaaaaaaaaaggtattggagaatcgtttggaacggcacgtcagttcgtcgagagataatgcgagtccgtgaacgtgtagctacatctgaacacacacagcaacggattgccgtgccagaaaaccaattgattaactaatgcaagcaacaaagctatataacctcatgcatctctaatcccattccatcaagcaaatcaaagcacaaactcatcaagaaaactgaagacaacaaggtagcgcaacaactagctaagatggcgagtgccagagcagtggccgccatggcgatgatcttcctcctggccgcgctctccaccacccacctcgcctcctccctccgccccggcgccgtcgccggcggcgcgtgccgtcccagcggctacctcccggggaagtcctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacatttagttgctctattcctcttcctattccattggtaacttacatcaattactcttaattgattgttggttgatggttgtgtagtgaaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcatgtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatccaaaaacctgataggtcattttcggtagttggctttgctgctgcactgaaaccacatgcctttgatggttcaaactataagagatggaaaacacgtgcactattgtggttgacagcga

SEQ ID NO: 51662 - DNA, 1501 bp, Oryza sativa
tttatgcaccttgaacaattcacattgacctagtcttgctgaagcaatattgtcaattgacgaggcaatttgtgctcctgagcatcttgatatcctatccaaaagcggtctcttaacattcagaactaaagaaatatcttttgccaagagttcctgggcataagatgagacacttttctcaactagcagcacatttggtcgccgagactcaatctttgcaacaattgccctcaggtgctccttttcctgcatcaatggtatttcattcagcaaaacaagaaacaacaaatatatgcaacacaaccatgaagaaaacacaaacctgttcaagtatagtatcaatggatgctagtttgttcgtgaccttctgatactcaagtgctccccctaaaatgagcaattttgcattcacatgctcagaggccatgcgtttgtgttttacattcttagagcaaaccactcctctaacaagattgctgcataaaaggaacacccatcagtttcatatgatggaaagtacaaacatgtaaaaaccagtcaaacaacaaagctaagaacatacctatcacttggatcccctgatgctaaacatttaactttcacataatcagtaggatccatgctgccacctttcttggtatctggtctcacatagccagcagctagccaagctagggaggatactatttcaagccagcttttggatccattgtcattttccagatcaatacattctcccttaagcaattgagccacaagagcccggaaatgcccaagtacagcattcctcagaccctctttgtgagctatgtctgtgattgtgtcaacaccaactattttgttagtattaaagttaccaagagcaagaagcttgcccgagtccccagcctcatcatcctcgtagtcgaatccaaataatctcgcttcaacatcgtcaccctcatcttccggtgatggcgggagccagacattggcatcgaaatcagcaggataacgggtcatgtcacctccactcctgtctgcgatgccaccgttcagcctggtatcgcaaccaagagaatccaggctgaggcgctcgttcctcttggacgttggcgaggcgtcgttgtgccccaccatccaagtcgggctctccagagggcttggtgtcaaggacctggcgaccccgttaggagtactgacgctaagagagtctgtatctgaaaagtcatgtaagtagtcattccctggggtgaaaaactgtaccccgggctcatcgtcgtcctctccatcgcctcgcctgcatccacgaaaacaagtaccacaacaaattcagcacaatagtatttgcgaatcgattacaaagcagcgccggattaacaccaacaagcatacatgaacatccatgagtgctacctgcatatgttgcataatccactacacctaaattagtcaataataggtggtatcaccattcaccaacaccatcgaaaaggttagatgccatgtaagtgattactta

SEQ ID NO: 51663 - DNA, 1501 bp, Oryza sativa
ctaaagaggtcattccctttcggcggccaacaaaactgaatattcccttacgactcggcggtttttacttgacggttggtcgacagaataatgaatttgacggtttttatgctatacaacggttttttttatcgaaaaaaaaagacggttttttttatcgcaaaaaaaattacggattcttataggaatgggtacactgatttacggcagctgtagtactgtgtgctcaaataagtcatttcttggtatttctcaatactcacaaaactatactttacaaaaaatgcacacactaaaaaaaataacactcgtgtgcctccttgacagacactaagaacatccacaatatgccataaaaatgagctataagattttatgatatacattgtggtcataaacataagtatgatgggtcctaaattttcaccaagattttaagcattgttgttgccctaaagaggtgaatcttaagcacgattattaccaatcaattgaacatgcgagttagttgaactaaagcttaattaagcacgattattaacaatcaattttatgcatgttagacacgaaattaaagagattcacaacgtacagataataaaaaaaaaaggtattggagaatcgtttggaacggcacgtcagttcgtcgagagataatgcgagtccgtgaacgtgtagctacatctgaacacacacagcaacggattgccgtgccagaaaaccaattgattaactaatgcaagcaacaaagctatataacctcatgcatctctaatcccattccatcaagcaaatcaaagcacaaactcatcaagaaaactgaagacaacaaggtagcgcaacaactagctaagatggcgagtgccagagcagtggccgccatggcgatgatcttcctcctggccgcgctctccaccacccacctcgcctcctccctccgccccggcgccgtcgccggcggcgcgtgccgtcccagcggctacctcccggggaagtcctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacatttagttgctctattcctcttcctattccattggtaacttacatcaattactcttaattgattgttggttgatggttgtgtagtgaaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctgttgttgctacggtaatcccatcccga

SEQ ID NO: 51664 - DNA, 1501 bp, Oryza sativa
taattaagttttgttattataggttagaaatataatattcccttcatccttgtttgataatcacttaagaaaaagcgcagagattagggacaataaaattttcatcactctgtagttaattcttatcaattaacatgctacatcgctttttatcccgtgaattgtatagaattttaaatatttacaccaatataaattaatcttaggtagctgcatgtagcacatttaatgatgttcatttactctttatttactctttgtccaaataaataaagagatacttgatagagaataatcatttggggaatacctcaaaaatcttaggtgataatcaaaatggaatagagggagtacttgttaatttgtgttattcttaatttttttttataaaaatatgattatgaaagatacttataatcatgtgtgcgttaaaggatatcttatacgcaagttataccataatttaattgaaatttggtacaaaattaattcaaatcgaaaggcataaataggtttaatttttattgaaatattactattgattaatttgttaagatcggcactacatatttaataaactctgaagttaatcttgcagtaccatgtaaaaaaaactatctccatcttctagtaacaatgaagcactcaaaccgattatctactttttttttccaaaaaagaaagttaatttacctaggtatatacaggatgtagaaaaatatggtctgttataaagatcagtatccagtcagtaaaaaatgaaaaaaaaattaattagccaggataattatttcaaatgtgtgtggcagcccttgcataactttactctagagtcaagtcatggtactactaatttatctttagttcccacaagtcatggtagcgttgcataacgtaagtaaatcttgcttctttcgattttgaatgtaagttgttttagcacctctttggaaaattagaattttcatggtatttaaactaattcatgtgaaattcctccaaaatttctcaggttcaaacgcgcacttgtgattttcattttttttttcaaaatatgagttgttttgaaacacctaggcacattttccaacttttacttttgagtttgctcttgtcgagttatcaccacttttacaaataaataattaatccatcttttctaatgtagtatgaatggaagacatcaaattaatttgagcttttttaattgattctggtacataattaaatactgagcataaaatggatcattcatgttttctaatctagtaagagcatccctagcagatgctccatccaatcctccatctgagaaatagcgtatgggagtgaaaaatcggcctccagcaaatactccatcggctatgccaaaagtagtggatcgccaaaacaggagagaggaatgccaattttggcgttcctctctccccacgccaaatcgcaaccgccgctctcccgccaacatccagagttcacagcggcggcagacaaagcgggcaga

SEQ ID NO: 51665 - DNA, 308 bp, Oryza sativa
caattacggaaacggcacttggattcagattacgctagctatgttgtcctaacccagcttaattatgtgtaacacgatatatatgatattccatcttcatgtgcaaacaaacttgtgatattttcaccacccaagtttttactggggttacaaaaccaatgaaatttggctgaatttacatggcttgctaggtaaaccaaattaatgccacagttaactgcttctcctcgagcaagtccttctatataatacacttgccacaacactcacaagatcaaaattaagccagcgaagagctcactttgatc

SEQ ID NO: 51666 - DNA, 406 bp, Oryza sativa
caaaccgcaataaatgcggttaggtgagccctgctgtgctcacctaaaccatacacgtggcgtcaaaaccacagggggtcggggcgcccctgccctcggggccgaaacgggagcggcccgacccctcggggagacaaaaggcggggaggtctcgtcaccctcgggcccgacccgggccacgtgggtgactgcggctaccctaacctctagtcatgataccctcggccccatgtcatcgacagtagcccccggcgtcacgccagggcgatcgcccccctcgagggaagcgctcgggcgtgacgccattctttagatctggtgacaggtggggccggtctctacaggcgggtaggaactcagcggtcgcaagtcgcacgcattggcagggaaaactgatcgataataa

SEQ ID NO: 51667 - DNA, 1501 bp, Oryza sativa
tataaaatttaattctttttgatacggtggagtaccaaaaccgatgtaatatactactgcctttgtcctaaaatataggaatttttgaggtgggcacagatattaagaaagttggtagaaatagttgaagaaatattgtgattggttaaaaagagaaaataagtgagataattaaatgtagaatgactgtgattggttaagaggaggtagttgaaaaaataacgttattttgagataagttaccgtgttagaaatagttacaatttttacacagaggaagtagtaagaaaatctacatagccggagtatcttatagtatcaatcaaccttttcctagaacttttgcaaacatttcccttctcctagattagatgttcatgttctctgagaatcccaaggacaatggcagacatgccgtgacctagtcagaccccaagctttacagctcgatctcctccactaaagtgtctcctggcgagcatgaatgcatatgatcttttttcacagtaccgctactccctcgttccaaaataagtgtaattttaatattgtttatgttcaacgtttgaccgttcgtcttatttaaaaaaataattataattagtatttttattgttattagatgataatatatgaatagtactttatgtgtgactaatattttaaatttttttttataaaattttcaaataagacgggcggtcaaaacactggacacggatatctgtggctgcacttattttgaaacagaggtagtacctgccatcaatctcctctcatatcactcaattaatcatacatatcactcaattaatcatgcatgatgcatcaagtgcacactctgacagtccacactgcacaagtgcacggtgcacacacaccagacaccaggcagctggtacaataatcacctctcactcacagagctcacactgtcagaattaatgggaaaaaaaatccagatccttcaggtgggccccacaaagcctcctagtcagatatcagtatatatcacagatcagtaattcagcatcacccccataaaaagcctctttccatgagagggacacatattatgttgatgcagcttgggttaattaattagttacaatttccttccttatctgctctacttgactaatacatgacttagttactatttttactatcagtagtgatcaccataaaactcgtcattatcactatgtgttactccctccgtttcacaatgtaagtcattctagcatttctcacattcatattaatattaatgaatctaaatagatatatatgtctatctagattcatatatatatctagattcattaacatcaatataaatgtgggaaatactagaatgacttacattgtgaaacggaggaagtaccatttatactatcaatagaaaccattgcaaaactcgtcgttatcgctgtatgttaccatttctactatgagtaggaccaatcataaaattctttgttatcgttatctgttacca

SEQ ID NO: 51668 - DNA, 1501 bp, Oryza sativa
accaaccaggaacatgcattgagctaggtaattaccccgatggcaaactgttgaaatcaaaacatgaaggatggcccttcttttacatgcatggttaataagtattttggtgggactagaatgtctatactacttttaaatattattccctccgtttttaagtatatgattttttaagatacgtttgatcatttgtcttatttaaaaaatttatgtgactatcatttattttattgagacttgatttatcatcaaatgttctttaaacctgacttaaatattttatatttgcataaaaactttaaatagaatgaatggtcaaatattttgttgaaaagttaatagcgtcgtatattaaaaaggtggtagtatatagtagtgatggtggtggtcgaatgtcacttgggttcatgatgttaatcttcattgtatgaatcaaatacacatgggtaatttatattcaattgtttctcactacgagtgactgtgtagctcaacacacatgtacaaaattgtaacaaaccctgttgcatatggatatgatgtttcactatatgtatcgcaggggtatttagctagtttcaaaagaaaccgtatttgaaagaaaggatatggtacaccatttgggaggccaactggatcccctcaagccacaatctcaaagtcaatacttacaccgccagaaggtaaatttctcttatcaaacttaggtaaatgatttgaataatctagtagtttgggatgaatacctggtctaaagtttattttcggcagttaatcgaattttagagataccactggtagaattccaacaccagtttgttcactgttagatatgcataggaaatgctacttaatggagaaggcaacgctgatatttctggtgttcgggatagactctagaagatgaatctgcctgaaaaaaagttaaaatctttggttgaagagctttacatggcatggtgtctcctgctccaggagtactagcagggaataaacacatcaataatcagggaggttgtcttgtgtgccaaactgatggtggagattgtggataccccatacctacacgacatgtatatccgactgggtatggggtgccatgtatagatagaatatctttaaagggactcgggttaaattccaaacttgtatgtcaaggaaatacccgggatcctagttggttacgattgtattttgtatgtaactacctattccattagagatatggactgtacttaggaggggtccgggtgcctcttggggcacgattttgctcctagatcatacgatcaataatacactcggcggatcaatccccggacaggagtagggtattacttcttgttaagaaggcctgaacctgtataaaattccttgtctctcaacccatccacttttccagcttgatagccacccccttttagtattgccgaaatcttgtttcgacagttggcgcgccaggtaggggtagcgtcaagtttttcgccgactagtgcga

SEQ ID NO: 51669 - DNA, 1501 bp, Oryza sativa
tatccggcagggcagaggatcatatcatatcgctgactcaatggagtcttgcttggctgccactatagtgtgtgtgtgcgcacatgccgtgcgctcgatattgcactttactgtaccacatgcatgctagcctatcagagagagattaaataaagatgctggggtacatttgcgattgagccaagcccacgtgacgtgagctagctagctaagtaggggtggcaacgggacaaggcggggccaggttgaacatgaacgcccctgccgccccgtgcccagccttgcattgctaaccgggtggaaagcctcacccgtcatcgtccccgcaggggacctcgtgggtgagtgaggccccacaattccgtatagagtcaatacacatcctctaatcaatgcaataaaatgcataacaatattctcaaaccaatacaaacaacaccataaatcaacaaacacatagagtcaactcgttagatctgaactctgaagctgcccgagaacaacctcgtggctccagcgatgaatcgtgttgtggtacaccggtgagatgaccgatggccatgagagacaaggcagagaggcgaggcaacgatcatcggcggtgagaggcgaggcaacaaccatcggtgatgagagacgaggcggcttggtgacgcggcgacaaccgacgagatgataaggtggcacagcgaagacagacggcgatgggagaacaaggaggctcagcgacgatcgccactcggcactgtggcgagaggcgcagcaatgaacagcgctgtggcgagaggaggcgatgagcggcgttgttgcgagaggcacgcgcagtggtgagaggcgccacggcgtggaggtgagggtcacgcggtgagcgacgtgtcgagcggcgactgtgcgttgagtgggagttggggaattatggttttagtttaggggctgtctatataggaatcgaatgatttctgaagctccaatcatgcagattttatctaccataggatgcacatccagcaactcagaaaaagtgatacaaatagatattacacttaaaaacagatatattatttgattatttgaacgccatttttttaaagcccaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacataaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaaca

SEQ ID NO: 51670 - DNA, 1501 bp, Oryza sativa
aatagaagttttcccaaaaatctgaagaatcttttgtttgccagaatcaaattttgaatggattgtactaccaccaacagggaggcctagcacaacatggacagattgcttgttcaatggaataagtttttggcccaaaactatatcagaacagttcacatctacttgttttgcaatccagagagcaaaagaattgggaacaaaacacttgtcaaatagcagcatgctttgaaaacaagaattttcaatgactgttttgtgatgtggacttaaagaatcaagaacttttgagaaatatttgactgagaatctagagaatgcatcagacttcaaatcagtgtcaacatttttgtcctgacaaaaagaaaataaaacaatttaatcaataaataaaaaccaaacatagatataaaagggcattgcaaaaaactaaccttaaaattttgatcacctatgttgtgatgaatattaagcttttttttcaaactgttgataatttgatccctttgtatgatatcacgtagaacctgatttatcattacatcattgtccaattcaatagattcagaccatttcatctaaaaaaaattcaaaattaaaaacaagaatgatggaaaaatataaaatgaaaaataacaaacaaaataattaccttaatgttatcatcttcacttcttttagacttactgagtttccttttcaaagttttcagaagttcatttgtagaaatttcatttacatgtggttgtgaaacatccatatcctaaaaaaacatattaaacaattaaaacattgcaaatgtgctatgaaacatggctacaacagagctacaactgcatactaatgaaaaaaataatgaaagaataatggatactattctgaccttggaacaacatgacaattcaagaacaaataaaacaagaaaatattggtcctactattacattggctaccaagcaatgagaatgtataattgcaaactcttcatgaatttacaaatggaaatgaaaagaacaactatattacaaatcaatgaaattgaaatgtaaaataaacttacatgactggctgagttatcatcagaatcacaattgtaatcatcatctttagcaggcaaagactcagaattaatatcatcagattcacttatgggctggctacaattatccaattttgaacgcttttggtgaaccatctattaaaaatagcaataaaaaatcaataaagtttggcagactataaattataaaataagtgaaggtatgcattaaaaaaaagatatatataattcctcagaaattgaccactttattcaggaaaaaaatgaacattacttaaacatggcaaacgaacaaaattaactcccagtacaatatatacgttggttagtactttcaacttgtaagtcaaatgttatagtatatctccatgtcctcacaaatatatgcaaagaggtccacactatgataaaaagtcaaacaatctcacaaacttaagccct

SEQ ID NO: 51671 - DNA, 1501 bp, Oryza sativa
catgaccctgccaaccctaacaggttcctggtaaccatgaagctcctccatctcttctgaactctggaaagagcaaattcaaccacattcagatgataatttcttcagataacggaacttaaccgagttcgccccaaatattaccggctcgcaggcctcgttgaggtcaatcaccggagatgctcttggagcagcattcagcctccggtgcgccgatgggcctttgctagagcttccgatagcccgaaccgtgtggtactcttcaccatgagaccaaccaggttgccgcaatgtgggcggcaatgccggattctttactctatagacaaacgtctgggatggattttcggacatggatttgtaccttttccgcaaaaacctacagcgcggcacaattatgcgcaggataatgagacaatatcaacatgtttgcattgtcgtagagcataatcatccaggcatgtaaatcacactggagaagatgatgagttcaggcccttacttgacttcagccaaaagcctctgtttcttgagcttctccatctgtaatctcttcttctttgcttcagtttcctgggtaacccaacacagctaatcatcagcaaacatcataatagaagtaactgagatggacactaaacaccatcaaacttgcaagaaccacatttgtggaaatcctcctagattaagagagttgcgatccttggaagaaagtttaactacgaaccagaatgaactgatacacttattagctgacttggaacatatcaaaacatgctaattcattcaatattaggagaagaaggataataaatttcagaaccccacagatctaacccaaaatattgtcacaagtaaaaaaaaatccagatccacaaaatacaccaagaaaacccctcgaataatcagaaaaccaagaacaccgaaaataaaatcgatcaagaaacaaagccgccaagatccaatcggaatcacaaaatccccaaataccgagaggaaaatcaaacatcacaaaacccccttccggagagaaaccgatcgaaaaatcgcaaaacccccaaaaatcaagatcagatcggcgaagccaaccacgacggcatgactccaagaaacgccatgaatccacccacccacccacccacctcgaggagctccttgtagtcctggagaagattcttgtacttggccctcgccctgtacgcctcttccccgccaccaacgccgccgccacggctgtgccccggcgccctcggcagcagcggcgacggcggcgccctcgccgccggctgagccaacaccaccttagccttcttcatgtccgcctcacctcacccgcgaagaaaccaacaaacgccccgcaagagcaggagaccaagaaagccagggagagagagaggtagaaggagataggaacaagcaagggaggaggaagaagaagacaatatagaaataaaggaggaggggaaggtggacgtggggagggaagtttcttgcggccgct

SEQ ID NO: 51672 - DNA, 1501 bp, Oryza sativa
ccgccgccacggctgtgccccggcgccctcggcagcagcggcgacggcggcgccctcgccgccggctgagccaacaccaccttagccttcttcatgtccgcctcacctcacccgcgaagaaaccaacaaacgccccgcaagagcaggagaccaagaaagccagggagagagagaggtagaaggagataggaacaagcaagggaggaggaagaagaagacaatatagaaataaaggaggaggggaaggtggacgtggggagggaagtttcttgcggccgctgcttcttggtgctctcgctgctggctggctgcagctgcggcgccgtggtgaggtgtgaaggagacccatggatgtggtgccaaaaaaacccgaaaaggcccatgcatggtcatggatggtgctagagtagacggactggacggcaagatagagagagagagcaagggaacaccaaccaaaccaaaccaaacaatctctcatgtgtttctctctctagacttgtagtagtagcggtggtagcggagagggagggagggtgggtggtggtaatggcgtggcgcatgtggtaatcaggtaatggagtggtagtggggcgcttgcttgctgctgctgctgctgctgtctgcagcgttggcttcgtcgtcggtccagctccgtctccaagaccaaggagaggagaagagagagggggggcattcttggaatccgttggggttgagaggtcagaggtgtccaccatgagtgaatgctgctgcagctaccccctctctctgtgtacacagatgtcatggtccatagggaaaaaaaagcgagatgacgatacgggacatggacatggacatggatgtgtgtgtgtgtacgtctctctctcctggcgtccatggctgggtggctccatggatccattcttttgattctttcgtttcgctttcttgctgtcctcttgagagagaggccgaacgctcccgggtcttgtgcgagtgggtggtggcagcagcccagcatactacaagcgttgcagtggttgggaggaggatgatatgatggcgtttgcagtttgcacgcatttgatgctttgatagtgtgggcggaggaggaggaggagatgatggatggcgcagaccgtagaggcggatgggccagtgcgtgcggttggtgtacaacggcgtgtgtgcgtcttgcagaggctctgcggcgttgctgtttgcttgctgatgttgttgtggctgtggctgcgagtgaaatggcgagattgccatcccattcccaaacaaacaacaaacctacctgggtttctctccctgccgttgacacggtcgcctccgctcgtttttaagatgggggatttgggaagagaggagaattcttgtgtgagatgaagatggcgatgaaacgatgataggtggggtgggtgactgggacgtgtagagataagatgctgtggactttgtggtcctgtggtttgctcgttgcatctgtctgcccggtgctttcgtatgc

SEQ ID NO: 51673 - DNA, 375 bp, Oryza sativa
tgaatgactatctttctaggttcaaaaaatttttagtgatcttaaatctgttgattcttcttatgatataaattacacacaatctgaggtttctcgtcactttttgaatggtcttgacatgtctatttgggagatgaaagttacatcaattcaggagtctgttgatatgtttactttgactttggattcgctttacacaaaactcaaaacacatgagatgaatattatttcttgtaaagttgactctaagtctagtgatttggtttcttccttgacttctttggatgttggtgcttcttcatcgaattactactattcttgctttaattaatgccatgtcgaatgagcaactcgaatagttcgaggaggaggaca

SEQ ID NO: 51674 - DNA, 1501 bp, Oryza sativa
aaagcaaaatcgaacacgaatcatggggattcaatgaaacaaacaccgaaacaaaaggtgctcagatctacgaaaactagaatgactagtactacagaatcaacgaaacacaacatgtagcatgctaaataggagatggaaatgaacaaaaaagaaaaaaaaaacaaaaaggaaagccactggaataatcttgcgcaatcgacggcgcgacacctccgcaacagcagcagacgccgagtcgactcgccgaagagcagcctcgtcgcctcgctaaatcgccaccgcgtcgccggagacgatgagaacgagacgacgaaatcgtcaacctctccttctataactctctctctctctccatcggcaaaagcacaactagcggagcaaaacaacaacgaatcgagcagcaagctaacaaatgaagctagagaagaatcaaaacatactcaccggagaaaaagaggagaaggagctcgaggacaagatggagaagcccacaccgcaaactccagtggaatcaccgccgcgacgtagcctgcatgaatccacaccgcggcgtagcttacgccgcgtcgtcgcttcccggagtcgccgacgaaatctccgccgaaatcgccggacgagacgacgaggaaaaaggcaaaaagcaaaatgaatctctcactctctctctctagtctgattcagacaatctctctctccggtgcggatttcaaaatttgaatagtgtatgtgggtcccaccattaacactctctcacaaaaaaatctctctctgtcggcaacacaaagtgggtcccacaaaaatgtaaaaaaaaaaagaagcccatttagcccacgtatggaagcccgaacttacaataatcaaaagcccacatacaaaagaaaacaaaagtttagatagcacgaatctcaaacaaaatccaagggaccaaaaaacgaatgatacagcccaacaaaaacatgcgacagccatatagcctttccgtttagtttatatatgggctatttaattgggccaagtaagcctacattgttgaaatgggctacttttacaaggaaattcacattgcagggtcccgccagatcacccatggccaggttggttacaacccgttccttccccggaaaattgccacccctactagctatagctagcgatctgctggctgccgtcactacaacgtttgttccctgtgctctaatatatagctattagttacatttttacggtctcttcgattaatctcttaagaaaatgggtgtgatattatgtctttttttctaagaactttattatgtcccttcaaaccctctctcggagactaatcgaacacggctttaaagagactgtaaagtcactccttaatttaagagaagacagccgtgtttatctagtgaaggagctataaactttgcctttcttaagaaaatgactagtcaagaactctattaattatactacatttcagtggccggtcattctgatccaaatgtgtcgtggt

SEQ ID NO: 51675 - DNA, 1501 bp, Oryza sativa
ttttctgtcagtttttctttttccctgtttgcttgatttgtggtcaggcctttttcctcgtgctgtttgaaatttcatggtgaattatattcctaaattatatctactttactttctaggtggaatttctccaggttttagttgagtgcttgggactaaacagtactgtagcaagcattatcggcctattttgttcgcagagtgaagaccatggatgcagcatgcatgcagagttgcagactgaagacaggccatcattcttcagtctaccacgagatagcggcgcaaatgcttgattcacttgtgagaatcacttctttcaacttccaacctgattttagagcaacagtgcctcaccaattgaaatcaaccgatcaacatatatgtcactggttctcccatctattagatatagttctgaatttttaaacaaaatgactatttgtgtgctgtgagtacaacaaaaatgagctcaagaaaagctatctctatcaacattagcgaaaaaaaagcacacttaaagcctttacaaaaaaaaaatatatgaagtctttacaagtgtaaacatttctgaaattgcctggtgagcgattaaaatgtttttcttgtggtgccttcagagagtttgatatgtttctatatatttttacatgtgtgccattttctgctgccccgaacattgatctgagagtaatcaaattccttgaatagtttaacttctaaatgttcaaaaataaagggagcgccatggaagtcaaattagtgaaaatcttaggtatcctgcagtgtgtatgggggcactgtgcaatatgatgttgcatgcagtatactatcattcttttaaaagtatcttctcggaataatttcttatttccaaatattctcagatacactttcaataatgtagatatgagatattatgtgcgaatggccaccccaagataatatacttcaggatatgcaaaatcagttggagaatgcaaattcggttgttctctttcatccctcatatatgcatatgtttcttaaataatttacaaaattactgttcagtagtggagtaaataaatatgaatgacggtacctgtcattatgcacatgttctctaaacacatttcatgaatgacaaggtaatttttggtaatattgtttggcagcgagtatttgggtacaatgtactaaagttaatcaatatgtgtggcatatgcattgtttttcattgttaaggttcgaacaactgaaggcaagtaagatgaaagaccttgtttgaaaagggaaagctgaactggaagagcatagaagatgcgctcatctaattagccaggaaggttatgcagctgagtttagcattgaagttattgaagtgcaggtaagatattctcctatcttactgacttccattgttcttgaaaattgtcattccaaacatgttcatgttttggccaagatggccgaatgatccactttggttctgaatattttgtttgtcgtttttgcaatg

SEQ ID NO: 51676 - DNA, 1501 bp, Oryza sativa
tcaaataattcccagaaaaatctagaaaatagaggagcaagtatagtatttaataaaattttatgtagctcatttttatattgaaaattttcctagaaaattagggtttagcttgtaggcttttaaaataatttctaaaaatgatttaaaatatgcatttttaatttagttgatttttagggcgtgacaaacctaccccccttaaacggaatctcgtccttgagattcagaagaactggcgaacagatgaggatgagctgacttcaattcatcttctcgttcccaagtggcttcttcttctgaatgattactccactgaaccttgcagaaccgtataacgcgattcctggtattcctctcgcttacttccaaaattctgactggcttctcaacataagttaaatcttcttgaagctctatacgatctggatctgcttcctccgtaggtacacataaacatttcttcaactgtgacacgtggaacacgtcgtgtattcccgccattgacggagacaactctaactgataagctacttcacctcttcgactcacaatcttaaaaggtcccacaaaacgcggtgccaatttccctcacaatcttaaaaggtcccacaaaacgcggtgccaatttccctttggtttggaaacgatgaacacctcgtaacggcgtaacccgaaggtatacataatctccttcttcaaaagccaaatctctacgacgattgtcggcatagctcttctgtcgtgactgagcaacgtgcaacctttattggataatcttcactttttcttctgcctgtcgcaatatgtctgtcccgaagacttgacgttcaccggtttgatcccaaaggagcggcgtacggcactttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgaccatctgtttgagggtgataagcagtactgaaattcaaacgggtacccaattctaattgtaatttctgccagaacttcgaagtaaactggctacctctatctgacactatcttcttaggaacaccatgcaaacataccactctggccatgtataactctgcaagcttattccccgtataggttgttttgaccggtatgaagtgagcgacttttgtcaaccgatcaaccactacccaaatagaatcatgtcctgccgacgttctaggtagaccggttataaaatccattcctatttcttcccacttccactctggaatcttcaacggttgtaacagaccagctggtttctgatgttctgccttgacccgctgacatacatcacatagtgccacatattctgctatctcacgtcgcatactggcccaccagaattgttgctttaagtcttggtacatcttagtgcttctagg

SEQ ID NO: 51677 - DNA, 1501 bp, Oryza sativa
agtttgaaaactaaaaaaagatatactaaatattttttaaaaaataaacacatggtagaaaatagataggaatcaacttctttattgtaatatactacctccgtcccaaaatataacaacttttagctatgaatctggacacacagttgtccagattcataactaaaaatacttgtattttaggatggatggagtaatattttttagtttaaaattttatacgatgtaagggtaattagcataaaatcgtagccaatgcccaaacaaatacatattaaaaaaggaatcaaagaatgtttagaaaaaaaatattacctgcaaataaaccatcgtaataaaaatacaagcaatattaaataaggtgtccgtgtatatgcgcgggctacttttctagttttacataaaaggtgtgttcgatagtgtaggtttggagctagtaagtacttaaaaaacgattttttgtgtttgaggacccatatagattgtagccggaccgtaattaatcgcgtctacaaaaatcgaccttcatttttttatacgggtgtcccaaccgcatagaaaattaggtttcgttcgtatggaaaaatgttattcgtgagtagttggagttaataacgtgcgtcactgtaaatggggtcaatctacgataatatttgtgcgtgcatcttctctatgatcgatgataatctgaaaattgttttgtgcatgtaccgtcatcaccgaagctaatactgtgtgctactaattctcttagcttagctagggatgctgcactatcgtgcatgcaagcacacgtcgtttcatggatgcttgctgcaggcctggattaggagaaacaggatagattagtggtttgattattccgaaagctgtcaatctgcaggtgattgatcgattgaaacacggggcactgctgtctgtatgtaggctatagcttaattaagatcgagtacgtacgtagctcattaactccacgttatttcagcttattcatcataaaaaatatttacaccacatttataaaatatgttcttaaaagctttctttcgattacattactcaaattgattattttatactatttgttatatttattccttaatatatttaatttatcattataaccacgggtagataatccgctcaactatataagcctattgctgctagttattactccctccatcttatcacaaaataaaattacttctttatttactctcttatttcaactacttataacaatctctcatttaatcacaaccattttctatttagttttgaataattttacccatcgggagataccacattttctgatataaaatttgttaactctgagtactagataaattgaggaactaaaatttttatacctctgaatactttttacggatcataaaatttatctttagttttatttctctttaatcttcataaaaattctaatccttacatacattttaagacggaaaaattactactgctaggtagtggaagc

SEQ ID NO: 51678 - DNA, 1411 bp, Oryza sativa
cccgccattttcttgcgctgtgctagtgtgatgttgatgcagcattgacagcttgaagatataaggagatgaacgcgcgcgtacagttgaccattgactagaggaatatcttccccttacggttgtttgagaaggattctagctctttctcatgtataatttatccgctaaaactggttgaaactgactgctaaatgtcttaccccgctatttaaaacattgctaaagctaaggtttgagactgcgctgtgcagaatcccaagcctaatgttggatgctttcctgactaaggttgtgttcttttccccgttttctcaactcatattcatctttttcacgcgtacgtttttcaaactgctaaacggtgcttttttttttacaaaaagttcctatacaaaagttgcttaaaaaatcatattgatctatttttaaaagaaaaatagctaatacttaattaatcacgtgttaatataccgctccatttttcatgcgaagggaatggttcccaaccgagcaagcagcctaatcctccaaaccgtaaaacaactgattttccgttttctttaacgttgttcagaggttaaaaaaattacaacatttttactagtccccctctgcttaatgatataaggccctgtttagatcctccagttttgccattttgaagcactttttgctattttagatctaaacactagtagtaaaacttggcaatttgtcatttggcatttgctagtctatagtagcaaattgtgccaaaaagtgctttggaccactccctctctctttctctctctcactttagtgctagaatggcaaaagtttaggatgcatctaaacaccaactaatacttttgctataccaaaatttttgccatttgtcatttgctattttaaatggatctaaacagaccctaagatgcttggtttctttctctaattaaattttgtttaactttgattaaatttataaaaaaatttaccaacatcaataatactaagttagttttcattaaatcaaacattaaaaatattgctatctcttttctataaaactgtaagttttactttaaaaaattcaaatcgtcttacgtatgaaatttcatatctattggtgtttctaaattaataataaattttccactaaaatttttaatacatcttaatagactatatttatcgtaaattatctactctattgtggaagtagtctgatgaacaagatgaattataagagcatttccaacagcttcttcaaatcggagtctctaaacacccatatagccaactcttcatctaatttgcctagttaaactagatactcactccaacagactctctattaatcctctctaaaataacaaatagacacacatcacagtctctactcctcttcttcccctctctctct

SEQ ID NO: 51679 - DNA, 1501 bp, Oryza sativa
tggaaatactgatccgtgtttgagatggattttaagttcgttcgcttttgaaaatacagatctatgcttaagttggattttaagttcgtttgcttttggaaataaaaaggggtcgtataagaatctttttaaaaaacacgcatgctaacttgagatgagtgtcgaactcttaattgcagctcatgattttctaaaaaaaatatccaaacgaattctcacagtaaatttcaccttagctaaaccgtataacaataataagatttaaatagcattcacccgttgcaacgcacggacatcttttctagtctctactgttataaaaattgaaaatgtttttgccggtggcttggtaagtcatcgtgttcgaatcggcctcgcatataatcactgccaatttaactattttatgtgtccaacatgtacgagctttaaacattagattttccataagaaaatttgcatgttcggatcgtgcctttggccgattgcgttttgtcctgtgcattgtcacaaaccaaccgcctccgcgaggttgtcatcttgccgatacggtctgttgggcaacacggtttgggacctgctgttgcgcacctatatcaacaccaaccagcagcagtcaggtgtgttgccgtgcgccgaggcaagcagcacgacgtaccattgttgattattctctacacgcacacactgtatcgagaagaattcctaccgtgttcatcagaaactcaattcaatacggtctgctgtgtatacgtgttccaaaaaaattaaaaaaaaagttcaggagcgatatcaaagccgagatctattactacccacatattgaatatccacgcgtgcagcaagacgatcagcaacaacagccgatcgatgacggttgccaagagaaatacaaaaacctaatcagagaaatattcaatcaagctactgcgcacatatatctttatctttactattatatctctatctctactattataaaaattaaaaatgtttttgtcagtacgtcatccgcgtatgagtcggttcttaaatccgtttgattttagaaatacaaatccgtatttgagtcagtttttaaattcgttcgcttttaaaaatacagaagaaatcgtacaagaaatctctttaaaaactcacatactactaacttgagacgttcggacacctaattgcagctcatgattttctaacaaaatatatatccaagcgaatttaacacagtgaatttcatcttaactcgatataataataagattaaaataatcttcacccattgcaacacacgtgtattttttctagtaaaattaaaaattttaaaaattctcatctggagcgttgctgggctcgcgcggcccacatacggcgcagatcgatcggggctgtggggcctgcgcgggagagagcgcatctagcgcgcgaggctataaaacacgccggattctgatctcaccgcccggcaagcacgaacacgatgacatcggatcgggtcggtttctct

SEQ ID NO: 51680 - DNA, 725 bp, Oryza sativa
cgcccgagagcgaacggccgtctgccacgtcattttcgccgccctctgggatggcgatttttaaaaatcgccctcccagagggcggtaggcgactacttccgtcaattttcaaaatggaaaattatatttgtaaaacttttaataaaaaaaattaaaaataaaaaaaattcatcctgaaagattcatgaacgagctgacggcctagctagggcccattagttcactcatccatagcactgcatcatagcaaggtgggcctaattttggcccaacccacagaaactgtaactaggcaccgcccgcacatagacataacactttggaatgatctcgtgcatttcattttcacaccataaacatttcgacgggtccacagactcatgtaaaaatgaaattttacaaccacccaaaaaatacttttaattgtttcaagggtacactcttataatcggtagccaaaaggtctcttattttactacgtgtggcgtagtttgaattgctagctaaacaaattatgagtttaacgctattcaataataatgggagttggggatttgtcccatcacattatttatcattttgatttatttttatctttaccttttttattactattaaacttatggctgtgtgtcttatgacagaatccggagatgtaatctattttcattatctaaaaattcttccaagggttgatatcatctgtgtgcactgctttggtaga

SEQ ID NO: 51681 - DNA, 331 bp, Oryza sativa
gtcaagtgccaagttctgccaaatgataagtaaaaacttggcaaagagggtggcgatgcgccgagagtagttgtattgatcgttgagatagtttacaataaccccgtgtgtacatatttatacccatgggtagatacgagtacttcttggacaagaaagaaacttttctaaagataaaaggaaaatataaagtccttatcagacactaaacacacttttctaaagataaaaggaaactactaaatcatgcctaattaatagatagaattacgccgccatgtcgcatcctccttgaactcggtcacttttggataagcttcctttattcaga

SEQ ID NO: 51682 - DNA, 1283 bp, Oryza sativa
  unsure (1)..(1283): unsure at all n locations
ttataacacactaaattttaaagctcaacatgtaaagatgacacatcatcatgcattaacaagatgccacatcatcatccactaacaattttataatttgttaaattttagagtttttcaatataaacatgttaaatcatcatcccacataattcacataatatttcaatatatttcttcatcattttttataatatcatatatacctatatgattcatcctcacttagtgctatttctctcttctcccattaaatcatatcacatcaattactttaaccttagatgattaatctatggtccaaagtatctcactccctttcctttctcataaaaccgcatcatcttacttttacatttgaatcatcattttatatactatttaaatttaaattatcataaaccatattaacttatgtaagttcatgttgtttagctattgtcatcatactgaacttccgtagtaacacgcggggtttcacctagtatatagattgttagtccctccatggtgttactagttttagtgtaagaattttatatattaatgagcggagtaactacatatgtgtgtatcctatatattaatttccagtcaaataaaaaagtgataattgcatatttacaaggatgtctttccattaaggcatagtagtaatcctattgatcgatcaggtagtttgccggatactactagctagtagtgatatatctgcaggtttgctagctagcttgtgaatgagtgatgggaatgaagacggataacattggggataagaattgctacgtggtgttcaactcccaaagccatcacagcctatatatatcatgcatatatctcaacaaccaggtaagcaggcatgcatatgcaactttatgtgtgtgtatacatgtggcaatatactcctatatactccctccttccctaaatgtttgacgccgttgacttttttaaacatgtttgatcgtttgtcttaattcaaaaactttagtgaaatgtgtaaaactatatgtatacataaaagtatatttaacaataaatcaaatgattgaaaaaaaattaataattacttaaattttnngaataanangaacagtcaaacatgtgctaaaaagtcaacggcgtcaaacatttcgaaacggagggagtatcatctatagcaattgaccgtggggtggcagaaacctagaaggatctggttaggtgccccacacttgtagagtggctcttgtgtctattccagtccctaaacttctagctttttacatatgaattttttgctg

SEQ ID NO: 51683 - DNA, 1501 bp, Oryza sativa; identical to SEQ ID NO: 17924

SEQ ID NO: 51684 - DNA, 1501 bp, Oryza sativa; identical to SEQ ID NO: 51437

SEQ ID NO: 51685 - DNA, 741 bp, Oryza sativa
atttccacccgacgttcgtactccatccaagcatgaatgaactgtatggtcgattcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacattcatgctcatccttccgccttaggtagtccgatcttgtttcactacgtgggtaagcacgggttccgtcattttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgaga

SEQ ID NO: 51686 - DNA, 1287 bp, Oryza sativa
aatttgtttacaatagtatcgactcatgccatgttgagaaggtgatcagatgttcagaatttctaccaggaggattgttgtgataactggtaattgactttctactatgaacttggaaaccatgtctttactaacaattgtgctggtttatcagtaccgctgaggaattgtataccctggaatcctgttgtattagcacaataatagtatagaattttaatctgataggctaggagcactggtaccttgtggtactgatggcttggcccttccattcctcaatgtttctttgatccttaacaatctgcaaatcttggttttggagccacttcttcccttgtcctatctaaagaagcaatgatcattaaatataatttgatggagaacagaggactctattgcattgatacaaggaagcagccaaaactacaccagtcttatctgattgaatgatgtagctgaggaccatgtaacatagtgaatgatgtagcctgtgacctgggtattgtatattctcataatgcaaaggcaatttgcaaattcaatccaagctgtttgacagataaatatgtgcagatgtcaaatctttgtaaaaagggcaggtgcaaggcaacttaacaacttcaccctgaactatgttactgtactcagtcaattcttcaagttgaaaggactcaacacataatgtctgtagactgcagtttgtagaggcaaaatccaggcaagtgcagaatagaaccataatatgcagcaacactattccagtattattcatttttctaatttgcattttcttgtggtgctcttggtaaggccgaagaagacggaaaaggatggaggcatcaattccttcaacccattcatacccaacaattttcctggtgattgatagcatggtggtgttttaattttgctgagtacagggtttgatgttttccatgcttggcttggatacatcacccaccttctcctcctttttggcatattatacagctgatggctcttacaaggaaaaataaacaggccatgttgcaactggagcaatcaaagtactagaagtacgcgtaagtattactctaggtgtccatgctctacatgttgacaatactaacacgtttataattaaagaaacttgcctggctgttaaaatgcaaatcactgtagcattctgtgcacacaagaagagtgatgcacttttcatgtccaaagataagtctactaacttgcattttttatgcagaaaaagaagaaaagaaagaaaccaaacagtcatccggaggaagtgtc

SEQ ID NO: 51687 - DNA, 1501 bp, Oryza sativa
caacagaggcccgagcttaatccttatagtacccgaggtacgactaacaaaacccaaccatgcacctcgagcccagcctaaaaccattttgggggttttgaatagagggggaggtgtgtgtccaattccaacataagccaaccattccatagtgtctaaatgatatgagaattcccaaagtctaaagttataaaaccacctaatgttgcctaattaatcggcgaagcatctacctaaattcctactagtggaaccatgaatagagtacccactagttggggttttattttcctagggtgaacaaggtaataataacaataacaacaacgataaggtcataacaaagataaataggcatggctaaataaaacagtgataacgcgggaatttaaataaagcgataatgcattaatttaaatcaaaataattttataaactgggattcaatatgatcaaggatgatgtgacttgccttgctcagagagaacggccttccgaaccttcggcgacgaccgcaaaccacgcttcgggaacctccagaacgacagaagctacgcgaagcacacaagcaaagctacaagcctataaagaagcaataacaatacataaaaagaaaggcacaaggttctttaggttataacaaatattaggagacttgaacgggtcgattcagattttgtatgaccaagacatggtgatccaaagtttaatgttgttatatggagatttgcggattattataattaggttttgcaactataaaacatgtgtaagcgctagcctggaaaagataggaaggctgcaccgttgacatgcgcactccacatgtcaacctaagaccatagaaattcaaaaccaggagaagaaattcggaaggtggagggagaaaaccggagagaacataatcttcgatcgcaatcatgcgacccaagatgggctgaggattagtacctcctgcttccctctccatggttccacgaccaggaagagcgccatcctcctggagtttcttcaacgttgcactggtggaagccgatttgccgaggtccattgctgatcgaaggtcgccgaaaaacgagcctaggttgatgaactagggtttcttgcggcggcggagaaggcaaagagtgcttggaggtggtgtgtgtttaacaggtttggcggacttcaaaatggactcccaaaattcctttaaataggcgcactatcgacggtgcgaattccagggaacagagagagatgcccgtcggaaatttctgggtccgttacgcgcggcggttttctggactttagtttaaaattcgctcgtgaccgttgggcttcaaatggcgtgctcgactacggtctatctccgcggtcctcgcaccgggaataacaacaatctcgacacccgaagttgcaaatggttgcacgagtttattttaagcagaagttgggggctactgtcagggttacgggttacgcataccctttacccttcgatatacgttacatatcgata

SEQ ID NO: 51688 - DNA, 1501 bp, Oryza sativa
atttgacaaaatttcatgtgaagtttacacatggtttctgaaactgacaagatcatgtcatcagggtcaatattcaagagatggcctgcttatttcacccaatagataaagtgctcagctagattatagatcaaaactatgaatgctgaggtttcacagatctgagttacggattactacttcatgcttttggtgctgatgactgtccagaagaaagtctctccgacctcgccttgttagctttttccatgtaatcttggtgagattgatgctttgtccctgcaggatatgcattgcataatcaattaatcaactggtattcatgtaccaaaaatagtattcagaaacttcggtaatttaagggctacttcaacaaaaatcaacatgcattctgaaacaaaaatcagcactaatcatatctgatttttaatgagaaacactttgatcactctgacaatgcagaaatgtgtgttacaaatagctaacagtttagtggcataacaccacttcgaaaaagggacaaaatcaattcgatgtccttatcattaaaaaaacacttcaaaaaggaacaaaggccccacaaattttcaattggtcattagaatttagcagtaaacaaaagtaaaaccagaaagacgataagaagtggagattccaatgatacactaataacaacaccatcatatgcacacattgtcatgggaccagctccagctatatgggtcaaagtagattgtgcaagggaaggctgaaaaagcagtagcatatcaataaatctggattcagtttagtttaaacagcttctttaatttagtcaagtctgatgagattcttatcatcaatatcttttcaattgtttgttatggccatgtctcttaagatcctcgcaagcagtaactgccaacagagtgttttttttctcttggggttgcatgattgtcaacgaaagcaagccaatttggcttgctgcattggtcaagctttatgaacagttaaaacaagcaaacttgcgcacagagttattttagataccaagtagctctctttgctaagttaggttagtatctctcttgcccacgatccaaacacaccctatgacctatgcgtatagcttactgataaagctatacattgtgtcctataagttaacagaagccataactaaatgctgaatggtttgagactttgagtagaacacctgtaaccatatattaagttggggtatcaatttcaatagaaggatatagaaagtgtataacaaattgaaatccaatactacatggtttggaattaatgtgtgctctgtttggttcataagaatatcaaggtaatgacacaacaaatgctaaactgcaaaatgttgctaattcagggttgcaagaagccttaagctataattctcctcacccagtgcacatgcatatgcttctttcattctaaagctgtcaaatgaagctgtcaagcaaaagaaatttacaaaattcagagcatcatatagtgt

SEQ ID NO: 51689 - DNA, 486 bp, Oryza sativa
ggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctctcatacatcttttgcatttgtactaatatgttatgtttgagtatatatgttgcgttttagttttagttctatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 51690 - DNA, 1501 bp, Oryza sativa
catggactaacaaaaacaagccttttgtttgctccaacctaatgccgactcctcgcaaagattggcaaagtgaggttaaatatagttttgatgtggccaagtgcgataagatttttgattatcttttacaagaaaaacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttccggtgaacacaattaatttcaatgataaggagttgattcggccggagcaagccaaatctgctaaggaaaaaggagtggtcattggcgaaccaaggcctaagatgatagtgccaaagaagccggaggttgacgtttggaaggagaataagagtggagctaagcaaggtggtgagagggctcgcaacaaagggaaaagaccaagatcacctcctagggagcgatttggtcattcaccaagacggtcacattccccttcatatcatcatccacaagacatgtcatggggttcttatccaatgccaccgctgggttatccttatccttacttcatgccatggggggcgacgccaccaatgttcaatcatatgcctccaatgcaattcaatcaagggtggggaggaccgaggaggccaattcatgagcgtttgtcttcaccaaacaatagccggttttatggtaagaatcgggctaatgaagaaaaaagggaaggaaagcgcgtcaaggtggaggtgaggacttcggaggtgattactatcaaagtggggtctcatgatgtgccaataccttctggagatggagttggagtgtccccaaacaaaaaatccgaagccgataccagctcatcgcagtcggccggtctgaccgggtcctctggccggtctgaccgcagccatgtggttggtctgaccgggccatcaggccggtccgaccgcccaaccgacaccggtctgaccgacgcttcaggccggtctgacccgcaccaaatgtcggtctgacaggcgcatctggccggtctgaccggtggtctacgtccggtctgaccgggctccagcgccggtttgataggaggattgcaaagggtgatgtgagggcttcatcgtctctaagcaaaatcaatagaggacattatttacctcctggaacagagccgaatcctaggtggatgcctaaggatttgacggctactcaaaagagaaggttgcaacgtcttcgggctcaagagataagagagaaaaaagccgaagaacaaagagataaaaggtttaatgagttacgaccaccacggtatggaggcataaatccatagagaaggaaaagccggttgttgtagaggagaaggaggagcaatcggttgataaaggtgaatcatctccagaagaagaca

SEQ ID NO: 51691 - DNA, 1501 bp, Oryza sativa
agcagaaaaactccggagtgatagcattcgactatgtctagacggcaaaaaatctggcagatcagtttaccaaggggctaccacgtaatgtgatagactgtgcatcgagggagatgggcttgagacccacttagagttggacaatagtggaaacctgtccattgtgatcggagatcccgtgaatttggatggcaaaacaaactatagtgtagctgagagaagagaccctaaaatgagcctatcttcatgatgcacttctcttctaatctgtatggtaggatggtatacactttaatgtgatccgagtggcttttcataaagcagagatgttggcctacagaacatcttagaaggaacatacctatatgagtccgactgctagtcacagtctatgagatcttggtgatctctagatactcatgaaaaggccaggagtatgacttatatgctccaaacagaggggatgcaaacgatagtccagtaccatttaagggtttgagtgaaacctgaatcgcacaagactgataattcaaggcatagtccactgttcagttgtgatctggtgtagctcttttcctaggtggatgtccaacttaaaagtctccaccgaaacactggtataacaaacaggatcagaatcgagagcatttcttgtgagccatgaaatttggtggggattgttagattaatgggttaggcccaattaaatcctaataaattccattggcccacattaagtgctatgggtaataataccaccttggaaatctatgtgaagaggtctcaacttaaatacggaactagtgaaaagtctctgttgaccggttgagatggtgtgcggacagccaggtggggtgggacgaggcgaggcaggcagctacagctgttttctctctctcactttgtaacggacggtaataaacatggagaattgatttcgtattaatgagcgcgtcggttacggaattaaacgccgtgaattgattccgaactaacgagcgcgtcggttacgaaattaaacacggcggttgatgactccgaacgttactctcgcgctcgcatacacacacacacacacacacacacatatatatatatatatatatatatatataggtaatttaactggtgctacatggagtatgggctcgaagattaaaattgagtatatacccaatttgaatgagtatgaattttttttaaatatttaggtatgaactttaacttctttactaacaagttcaaacaagtttgaactgagtttgaacttttctttttgttagattttggttctagttatataacatcaaagcatataattcgctaggtatgtaataatgaattgtgaaataaagttgagtttgagttattttgttgttaggtattggtatgaatcaaattcatatacctaagtatatactcacaatttatttttttaaaaaaatttcaagagattttgtgtgttttataccttggagcccgggcaccatggagtcccata

SEQ ID NO: 51692 - DNA, 1501 bp, Oryza sativa
aactagcaaatgtgcgtgctaattaattagtatgctcaattaattttgtttatcactatgcctgtatcactactagcatggctcgaagccatgaagcatgaccgaagcaagtgcttgtttaatttatggtgaattatgcaaaatttatgtttgtatccgtgatttgtatccgctcgtagaggaccgaacctgagagcgagaatctcgcctaggcttgtatccactaacgggaccaaatcagagggtatggtaggatgacatgaaaagagtatgcatggaagtcactgctaggcctgtactcatctggacgaaccataggaaaaagtgtgaaatcatgttaaaagccatcaaatgaagcgaactttcttgtctcatatgtcccaatttaattcaactaaaatctcaagagcccacaagtaatgttagagagaataatactgccttgaaaatttaggtggaagaacctcaacttaaatagggtgatattagagattccctgttgaccggttgaggtgatggttggactgccacacgcatgcgcgcatgccgagtcggcctcggccgtgggcgtagcgaggcgaggcggccgaccgagccgagcctgcctgctgctctttcgttttgtaacagatgagaataaagtcaccattaacaaatgaaattcattgtgttgtaacctccacaacaaatgagagattcattgtgttgtaacctccacaacaaatgagagattcattgtgttgtaacatccacaacaaatgagagatttatttgttgtaaccttcataacaaatggaagattcattatgtggtaaccttcacaacaaatgagattaattttgtggtaaccttcacaacaaatgagatttatttgtgtggtaatggagatctctctctctacatataacgcaaggcaaaggctgtcaaagtgtgtgtcttcctcctactattgttccttggcgatactctccttctgttcctgcgctgtctctttgtttccccggttctgttcatcccgcgtgcacgggtgatcggaacgagcaggtacctccgaaactccgtccgcttgagaacctgcacgggtaggcgggtgatcaagtttttaggtagcgcttcaagcgcgactgctctacatcatcttcaccaacatgtcgacaaccggtgacaacaacaacactggagacaaggagaaggagcctctcgtcaacaccaacggaggcaatactgcctcaaactccaacggagggccattctcggggtacaacgtttcactattacacatctagcactgtcgctagatctactcaaatttcaaatgtcatgtttattgtcttaatattttggattaaaatatgccgaattatgaccaaatttccaacaatccaaaaacttgataggtctttttcggtagttgactttgttgcatcactaaaaccatatgctttcgatggttcaaattataaaagatggaaagcacgtgcacttttgtggttgacggcga

SEQ ID NO: 51693 - DNA, 1501 bp, Oryza sativa
aatgaatcgcgtgtttacaaggaataactagtagaatatttaaatggataataaatagaattacttattcttaggtcattgtgaagatgaaatatgactatagtaatgaatccatatatggattatcaatcctattagtatattattcataaaaaagttatattgtcatcaaataagacatgtaatggaaaaacatgaacgatcgagatacacgttactccctccattccaaattgatctacatataggtttttttaaggttattcctaaatgatctatatatatttatgtttattcattaagtctattcgttatttgtgcattggagtaaatggacattgatgcatgcatccatgcacataagggggtgtttgggagagaggggccaccccctaagtatatataacccacatgcaatatcttgatttgttattgactaggaaatagtggggatggtgcatacattgagtttgttgctcgagtaaatatagtatgagagagttattatttttttttgttttggtgcacctataaaataatcaatttggaatggagggagtatacaatattattatttgatctctatagcttttgtaaaatgtctaagggtatggtcttcattacacggtctatattaatttaacggaacatttagtggtacgctattagtccaagcggctagtcggagcagtaggagaaggtaagctagaatctagaaacaaatattcaatatcgatcaaaattaaaacaacccaaaatcgaggtagacgaaaaaagacatgatgatcgaacctgcaggagcgccgccgccgccgccggcgtcggcggccgtgcattcccagatctcctcagcaacgggaagatgtgctccatgatctcccggcggacctccgactcgagctcccattcctccgcctcctcccgcaggatccgctccattatcttctgcttcttcgcctgccgcagctcgtcgcgaccagccgccgacggtgaagacgactgccccagcgacacggccgaatcacccccgttgtagtctcccgtgcccccgccgtctgcgccacgatgcccatcgtctgatcaagaaaggaaacgataccaaaaaaaaagacgcagatagcgagatcgatcgatcgatcgagaataattaattaagtaaccttcgttggccgggagcacacgggcggatccagagctcgccgtgggcggcggcggcgggggaggggaggaccggctgcggtcgtcgccgtcgcggtaccggaactccatggcggtgcgggtgcgggtgcgggtgcgggttctaccggggttttgcgggatgcgaagcgcgtgagcgctcggggtgcgtacttatcgtacgaggaggaggtagggggatcgaaacggctcgcacgcggacgatctgatcccgttcaattccatcttactttttgggccttccctaatttcttttggaaaaaaaagtacaccgaagtttcccaactcatgtctgatgtgacca

SEQ ID NO: 51694 - DNA, 1501 bp, Oryza sativa; identical to SEQ ID NO: 51438

SEQ ID NO: 51695 - DNA, 1501 bp, Oryza sativa
gacgggctcgtagaggccgatgcggaggccgccgtagatgcactggcggtggagtcccgggacgatgcccttccagagagcggcggcgccttcctcgcgcgcgatggtggcggcggtgccgaggaggccgcggtacttgggggcggcatcggcggccacgttcttctgcagctgaagcctcaccttggccgtatccagggggatcgtgcacacctgcggatcggaaccaaatcatcgatccgtcagctggttccttctcgatctacctataataatgctctctctaggaggaggagaggagaaatcggagaaatcgaaggggattgattggatacctcagcgaagcatgcagcgatggcgcttgcggtgaagcggccggcgaaggagatgtcgggcttcgacccgtgctccggcataccggcggcggcgtttgcgtttgcgcctgcgcttgcgcttgctagtgggaaaccacgattcgcggacccaactcaacaactccctacacccttatttattggtttttttgcttttggtcggtgttttgatttttctgcacatacaaaaatgagcaggttaattatcttctgctagtttggacatctttttttgctttgttccatgactcggatgcacatcactagactagtggtaatgcaaatgactcggattcgactcatataccttccctctactagtgtatatataacatgttagcctgattttcatttcgtaagggatacgatgctctagtcttgatgtacaataggaatatcaattaggaatacgatgcgatacctaactactattaatatcaaatgcctaactagtagcaacaagtaagtagtaccaaatgggtatgcctaactagaaccaaatgatgggtgctcgcatcttttattagagtaaatttcgctatattttaataaaatttaatacagattattgtaaaactacaaatatattagccataaatttatcacaaaattacatgtttaataccaatttaatcacaaagcctaaataattataaccccataatatgtaatcagtgataactttattattaaatctataattttgtgatacttaagttttaaacctcatttcttaataaacttagtgttaaatcttgaatctataattttccaataataatttgataaaagtatttcttttgtcaaatttactatttccccccttagttttggtgccgagcctccgctacgcttgggccgttgggcctatacatggagacgggcccatatgcctggatgaggcccaacacacaaggcctgaccaggcctggccgtcatcttcttcttctccgatctcctcctcctcctcctgcgtggctgcgtctcgcctgggacaagaagaagaagaagaagaagaatcggaggaagaagggggcaagctaggatgctgcggaagggagaggcgccggggcaccaaaccccaccccacctgcacaaggacgacggcgacgacgacgacgacgcac

SEQ ID NO: 51696 - DNA, 1501 bp, Oryza sativa
gcgcgtgggtatgccatatcgatatgtaacgtatatcgaagggtaaagggtatgcgtaacccgtaaccctgacagtagcccccaacttctgcttaaaataaactcgtgcaaccatttgcaacttcgggtgtcgagattgttgttattcccggtgcgaggaccgcggagatagaccgtagtcgagcacgccatttgaagcccaacggtcacgagcgaattttaaactaaagtccagaaaaccgccgcgcgtaacggacccagaaatttccgacgggcatctctctctgttccctggaattcgcaccgtcgatagtgcgcctatttaaaggaattttgggagtccattttgaagtccgccaaacctgttaaacacacaccacctccaagcactctttgccttctccgccgccgcaagaaaccctagttcatcaacctaggctcgtttttcggcgaccttcgatcagcaatggacctcggcaaatcggcttccaccagtgcaacgttgaagaaactccaggaggatggcgctcttcctggtcgtggaaccatggagagggaagcaggaggtactaatcctcagcccatcttgggtcgcatgattgcgatcgaagattatgttctctccggttttctccctccaccttccgaatttcttctcctggttttgaatttctatggtcttaggttgacatgtggagtgcgcatgtcaacggtgcagccttcctatcttttccaggctagcgcttacacatgttttatagttgcaaaacctaattataataatccgcaaatctccatataacaacattaaactttggatcaccatgtcttggtcatacaaaatctgaatcgacccgttcaagtctcctaatatttgttataacctaaagaaccttgtgcctttctttttatgtattgttattgcttctttataggcttgtagctttgcttgtgtgcttcgcgtagcttctgtcgttctggaggttcccgaagcgtggtttgcggtcgtcgccgaaggttcggaaggccgttctctctgagcaaggcaagtcacatcatccttgatcatattgaatcccagtttataaaattattttgatttaaattaatgcattatcgctttatttaaattcccgcgttatcactgttttatttagccatgcctatttatctttgttatgaccttatcgttgttgttattgttattattaccttgttcaccctaggaaaataaaaccccaactagtgggtactctattcatggttccactagtaggaatttaggtagatgcttcgccgattaattaggcaacattaggtggttttataactttagactttgggaattctcatatcatttagacactatggaatggttggcttatgttggaattggacacacacctccccctctattcaaaacccccaaaatggttttaggctgggctcgaggtgcatggttgggttttgttagtcgtacctcgggtactataaggattaa

SEQ ID NO: 51697 - DNA, 573 bp, Oryza sativa
cctgcagccctattattattattattattattattattattattattattattattattattattattattattattattattattattattattattattatatagtatattatagttgctgctacgctatactatctctttctcatatcaactaatcgctttattatcagctttgcttgctaggaatataaataaaaatctgcccctcacattcaacagtctgtattagtccccacgctctctccgtattactctaatctcctctgccactgcacgctgccgcctccaccatctcgcccaaccatagaaaaaaaaaacataccaagccggcccccaacttgaatgtccattcctgtaatgtaacaaacccgtttgtgcacacaaaaggcctttgccatccaaagtctcagggatacctccataagcacccacataatcatattacaacacaacacaacagttacaatcctctaatgtttacatcactcaaatggggatgcacaccaagggattgcttccttatcaacaacaaaaaaaacctgctaaaacacttccacctcatctcatcagg

SEQ ID NO: 51698 - DNA, 1501 bp, Oryza sativa
aagggtaggattaatccaaactagatccaactgcataagagttaggactagtatgggattaggggtggtgtgaggactgaatgaggatgtcatgtggaaaaggtggaaagatttacctggagtagtggagcgaccagtagaagtactggcagatcttctcgaggatgggggtgctgatctcggggaacctaacctcgccctcgcgcgtctcggagaagccgcctgtgttggatttggatttggtggataattcaaggcaatctagggtttgagaaagcaaagcgaatcggatcgatagatggggaaggagacgaaccgggggaggtgagcatgttgcggagcgtgttggagaccatggcggccttcttgtcgacgacgaactcgaagccctcggcgctgatgagcttgacgaagccggacggtgcgtcgtcgtcgtcgtcgccgtcgtccttgtgcaggtggggtggggtttggtgccccggcgcctctcccttccgcagcatcctagcttgcccccttcttcctccgattcttcttcttcttcttcttcttgtcccaggcgagacgcagccacgcaggaggaggaggaggagatcggagaagaagaagatgacggccaggcctggtcaggccttgtgtgttgggcctcatccaggcatatgggcccgtctccatgtataggcccaacggcccaagcgtagcggaggctcggcaccaaaactaaggggggaaatagtaaatttgacaaaagaaatacttttatcaaattattattggaaaattatagattcaagatttaacactaagtttattaagaaatgaggtttaaaacttaagtatcacaaaattatagatttaataataaagttatcactgattacatattatggggttataattatttaggctttgtgattaaattggtattaaacatgtaattttgtgataaatttatggctaatatatttgtagttttacaataatctgtattaaattttattaaaatatagcgaaatttactctaataaaagatgcgagcacccatcatttggttctagttaggcatacccatttggtactacttacttgttgctactagttaggcatttgatattaatagtagttaggtatcgcatcgtattcctaattgatattcctattgtacatcaagactagagcatcgtatcccttacgaaatgaaaatcaggctaacatgttatatatacactagtagagggaaggtatatgagtcgaatccgagtcatttgcattaccactagtctagtgatgtgcatccgagtcatggaacaaagcaaaaaaagatgtccaaactagcagaagataattaacctgctcatttttgtatgtgcagaaaaatcaaaacaccgaccaaaagcaaaaaaaccaataaataagggtgtagggagttgttgagttgggtccgcgaatcgtggtttcccactagcaagcgcaagcgcaggcgcaaacgcaaacgccgccg

SEQ ID NO: 51699 - DNA, 1501 bp, Oryza sativa
atttcaaaaaaatcataactaatttattttaaatcttttttgagtgaacaaaattttgtcagaaccagtgaaaaatgctctttgtataagtattgttggaaaactatatgttttgtgcttatattgaaaatttatttgtgatggtgatggctaaaattgcatgtgatgaaaaaaaaatcaattttcatatgttgtatccagtagctatattagtactaaaatacctaccattggttgtataccaactctcaagggcaaatgcgtctttttactatgaagttagcggtcaactggcggtggagtgacggcaatggcataaaagggaggacaaacttgaaccggtggcatagaagggagaagccaatttgaagtggcatataagggaaccagttaatttggagtggcatataaggaattctatagttcataaggtaaaaaatcgaggaatattaattaataaaataagaggacttaaatagaagaggtagagagctgacatacaaaatctaccatcggtacattaagattatcgtgtgtcctgaaacatatgtgcttccattgtgaatatctcaaaagtacacgatcttcacaagaattcaatgaaaaattgagctaattcctataaactctaccaaaatattagcattaattacccttagcaattatacaagccatacaaagagcacgccaaccagcacgtttatttttccgaagagctggctcttgccttctccaaaaactgttcattacccttattatattgaagacttgctaaatagtacggcatgtgaaacatttacataattgaccgaataaaacattctgcattttagcacattaatatgtttttacttgttggcccattatgcggcaaagccacgtctcttttcatatgttattttgagctcagatttttttttgcaagttttcatttatctaagttatcacaaatgctaccgatcattgtcacttagttaatttatactccatctcatatatatctaagaaatcaaactaattccaaataattatttatgtattctaacgaaaaatataaatattcacaggatatttttagttggtgcgccaaaggcgcaccctttttctagtctactaatctaaagccagcacttttgccgacattccattggtccacgtgacattccattgcacatatatgtagtaattgcttattttatgatatatggagcatcaagatgcagacgttgttgctatctaaaggattgtggtatattgttgagaatggctacaaggagtattctggtagagacactcttacggcggaacagaagaagtctttggtagagtatcggataacggacgccaaggccttgttcttagatcccacaaggagttgcggaaagtctatttccgcgtattatcggggccaagaactccaaggcagcatatgacaagtttgtggtgtgacatttgtcaaaaatctagtcatactgcagatatgtgctggaagaaaatgacc

SEQ ID NO: 51700 - DNA, 1501 bp, Oryza sativa
agtacatacccatctggttgatccatatagatctcctcctccaactctccattgaggaaagctgtcttaacatccatctgatggccgagtagaccatgagaggctgccagagcgagtagtactcgaatcatggtcaagcgagcaaccggtgaataagtgtcgaaaaagtcctcgccttctttttgggtacaacccttggccacaagccttgccttgtacttttcaattgtatcatcaggcctaagctttttcttgaaaaaccattcgcattctacaggcttgcacccatatggacgctcgacaactttccaagtaccattagacataattgagtccatctcattgcttaccgcttccttccaatagtcagcgtcaggagatgaatatgcctcttcaatggttcttgcagtatcatccacaagatatacaatgtagtcatctccaaaagactttgcagtcctttgtctcttactctttcgagttgctacaatgttatcctcctcaggattttcctcaagcgtttgatcaatatgttcttcggcacaaagtgctcaggggataaaataggttcttgactagaagtgctaggtgcatttttcataggaaattcattctaaaaaaatgtggcatctctggactcagtaattgtaccaacacgcatgtcgggtaatccagaatttactattaagaacctatatcccacactgtggatagcataaccaaggaacacacaatctacggtctttggtccaagtttacgctttttggctataggtacatttagcttggccaaacagccccatgtgcgctggtgagagagatttaatttcttcctttcccattcctcgaatggtgttacttccttatgcttagaaggaattctatttaggacatgacacgcagtcaatattgcctcaccccaccattccttggaaagtcctgtagtgtctaacatggcattcaccatctcagttagagtgcggttctttctttcggctaccccgtttgactggggtgaatagggaggcgtcttatcatgaataattccatactcttcgcagaaagaaataaattcattggaaaaatactctccacccctatcagacctcaaccgtttgattttcctttccagttggttttctacctcagccttatagatcttgaagtaatgtaatgcttcatcctttgatttcaataggtacacatagcagaatctagtgcaatcatctatcagtgtcatgaaatatttctttccccctttagtcaacacgtcgttcatttcgtacagatcggaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagcgtgtcatacaaccaaaattcacatgacagagtcgtgaatgccacacattagactcatcatcatcatt

SEQ ID NO: 51701 - DNA, 1501 bp, Oryza sativa; identical to SEQ ID NO: 51440

SEQ ID NO: 51702 - DNA, 1501 bp, Oryza sativa
ctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcaaagtcactttgaacagtaatagtgaagaggtcccctcagtgatgtttgaagctggaggaagaaactacatccatgcatgtcaggaggtggcaaggatcgccataggagagctccgtgatcgctacagtgatcagttggccgacattgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtattagcagctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaattggcgccaaaggttcgtgtggtggagaaggaagttgccccagctcaagcggatccttcggtcatcatcataagtagtgatgaagaagaagaatctaagcacaacaattccaagattgagtgggtagcaactcaagatgataaaaacgagccttcaatcgacctccgatgcttggaagaactagagtgacttgttaagtcgttgtcttagatcgttgtgttagttggtttgctttaagtttgcttgtgtgtggctcgcatgtgatttacatcagtggtgggatgtaattgcatgtgtttgtttgcttttgagtgttaggaagttggtgagtttagtggtgtgagagtctttagtttgtaataatgaaactcagttaagatcaataaaagttaaagtaattctctgtcc

SEQ ID NO: 51703 - DNA, 1501 bp, Oryza sativa
agttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatgggacattcctggtttggagatagaactgtgcagccggggtggttgttcagaatggttgggcctatacaacagggtatgttgtatagcgttggattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgtgctattaattggataaaggtcttaactccctcctttcacttgtctttaga

SEQ ID NO: 51704 - DNA, 1501 bp, Oryza sativa
aagacgcgcagttgtgaagataaaagcaccagtcggcggcggcataatcagtcggcgacggaagatgatgatgtccatcagtagtggtagctgtataaaccagacgtagaggtaagggcactagtcagcaacagacgagacgaccggcgattaagatgtagatgcccaacaacggcggcataataggccagccgtgcaggcggaaacatcagtcggtgacggacgaggcggccggccgatgaagacgtagacgcccaacaacggcggcataataggccagccgtgcagacggaaacaccagtcggcggcgatggaggcaggccggtggtggagtcgtagacgcccaacaacgacagcataataggccagccgtgcagacggagacaccagtcggcggcggcgaaggcaagccggtcggtgaagacgtagacgcccatcaacgatggcataataggccagcgtgcaggcggaaacaccagtcggcgacgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcggcggcgaaggcaagccggtcggtgaagacgtagacgcccaacaacggcggcataataggctagccgtgcaggcggaagcaccagtcggcggcggacgaggcggccggtcggtgaagacgtagacgcccaacaacggcggcataaaggccagccgtgcaggcggaaacaccagtcggcggcgtcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaat

SEQ ID NO: 51705 - DNA, 1501 bp, Oryza sativa
  unsure (1)..(1501): unsure at all n locations
cgtctccaccacactgctctctatcctcttcgattggaaggagtttttcgcgtgcgcgtcccacaaaatctgggaattttgcgggggttgttgctgctgctgctggcgaaccgcgcggacaatcatggagagtattaaagccctgacggctagagataatgatagattagttcgtgtaatcgccgatttgctgggtgtgaatagggactcccggacaatcttatcctaataatgacgaactgaggacgccatctcaagtggagacttgggagagttgggacgcatgtgcattgacaggcaatttgggtgtcctgattggcacaggcacttgcccatcaacaatgacatcacatggacgccttactagtctccatggatcgcgacaacaggtacaagtagtaacttgctcacgagtaattgtggtgttgtgctccaagccagagagccggcacacgcaacgtgtcgttcgtattatccgttgtacaattcctcttagactacttatccctatacgcatgacgcatctctttttttcccctgttcacatgttacagtcaaattggtcagtgtttcataaacacgagatagtaggagataatcataagtagcatacttgacagcgggaaattgcctaattagtggatcggtcactgtcagtcaaagtcaagggtcagcatgcggcacgggttctccgttcacgatccgaaacttgggagatcgtttggattttggttgaaattagagataatgtgactgaaaaattatgtgtgtatgacaggttaatttgatgaaaaaagactgaagtttgggtccaaactttggatctaaacacagcctcagttgcagattttctcctctttttttgcaagttcagaggagcgcatggctaccggggttgtgtttggatccaaacttcagtcctttttcatcacatcaacttgtcatacacacacaacttntcagtcacatcatctttaatttcaaccaaaattcaaactttgcctcaatctaaacatagcctggataacaaatcaacagataggaatcctgcctgattattgacaggtaagttctcgcctgatatttcgaggtgcagagttggctctagttgaggtgatgtgccactccaaagtccaaactggttgagaccgaatttagggtgtgtttaggtccaaactttggatccaaactttcaattttttccatcacatcaacatgtcatacacatacaatttttcagtcacattgtaccaatttcaacccaaacttttaattttagaaggaactaaacacagccttagttttaaacttccaacttttccatcacatcaaaactttcctacacacacataaacttccaacttttccgtcacatcgttctaatttcaaccaaacttccagttttgacgtgaactaaacacaccaagcaccctccctgcagtagcttgtttaataagtctaagatacagcatcaagaaaaacaattgctcacactagaaaa

SEQ ID NO: 51706 - DNA, 1501 bp, Oryza sativa
  unsure (1)..(1501): unsure at all n locations
tgtgatggaaaaaattgaaagtttggatccaaagtttggacctaaacacaccctaaattcggtctcaaccagtttggactttggagtggcacatcacctcaactagagccaactctgcacctcgaaatatcaggcgagaacttacctgtcaataatcaggcaggattcctatctgttgatttgttatccaggctatgtttagattgaggcaaagtttgaattttggttgaaattaaagatgatgtgactganaagttgtgtgtgtatgacaagttgatgtgatgaaaaaggactgaagtttggatccaaacacaaccccggtagccatgcgctcctctgaacttgcaaaaaaagaggagaaaatctgcaactgaggctgtgtttagatccaaagtttggacccaaacttcagtcttttttcatcaaattaacctgtcatacacacataatttttcagtcacattatctctaatttcaaccaaaatccaaacgatctcccaagtttcggatcgtgaacggagaacccgtgccgcatgctgacccttgactttgactgacagtgaccgatccactaattaggcaatttcccgctgtcaagtatgctacttatgattatctcctactatctcgtgtttatgaaacactgaccaatttgactgtaacatgtgaacaggggaaaaaaagagatgcgtcatgcgtatagggataagtagtctaagaggaattgtacaacggataatacgaacgacacgttgcgtgtgccggctctctggcttggagcacaacaccacaattactcgtgagcaagttactacttgtacctgttgtcgcgatccatggagactagtaaggcgtccatgtgatgtcattgttgatgggcaagtgcctgtgccaatcaggacacccaaattgcctgtcaatgcacatgcgtcccaactctcccaagtctccacttgagatggcgtcctcagttcgtcattattaggataagattgtccgggagtccctattcacacccagcaaatcggcgattacacgaactaatctatcattatctctagccgtcagggctttaatactctccatgattgtccgcgcggttcgccagcagcagcagcaacaacccccgcaaaattcccagattttgtgggacgcgcacgcgaaaaactccttccaatcgaagaggatagagagcagtgtggtggagacgtggagtggacaaggaaatgggcattgacttccacgcccaccttgttgcctccgctgcggcgtcgttgcctcgcctcccccaccaatcggatcggcgcgtcgcctataaaatttcctcccaactcctaactgcccactccgatttgacgccatctgctcgtctgcctcctccccgatttcctctcctctctctctctccctctctccatccctcccggcgtccaatctgttctgcttctcgctgcgcccccggaattgtggtgaggttttgtgagggtgtgggggaggagga

SEQ ID NO: 51707 - DNA, 1501 bp, Oryza sativa
actttttgcctggcggcttccctgacttcttctctctgcagatttgtgaattttgggctttttgggtcttctgaaattgatattttcagcccatcttcctttaagtctgattctcggcatcgtctgattgatcgatcgagtgttttgatgccgattcttctccatttattgcttattctctgcaagaggttagtaaaccaagtactagtggattttattttattctaacactatatgcattgcaagcatgactagctctccttttattccggtaatattgacgggcgaaactgatcgataacgaccatcaacaaaacaccccaagcttgaacctttgctcgtcccgagtaaaggacgaaaggaaacaaaacttggttattgatcaggagttgctactatgctgtatattctcaaatgtacaagtgcaaggtatatgtactctctctcaaatcaaataattttatcacgtggcttacccttacacctgattcccgcgagacattgctttaccttgccctgagcggttgaaagacagaacagcaatgatgagcactagtcacccaatctttattcaactttttattccgaaagttttcaaatgatttttcaaaagaaatctaagttcctcaaatgatcctctcgatcactcaaagtgtataaatatgaattcctcaccaaagtaaccttgttgattcctactctaaggtttagtatgtggagcttggtagggatcaaacatggcatacctgtattcacatttattattaagtcaaaaacttagactagagcatatgactagacatactcaagatcaagatcgtacataaagtgtgtgatatatggtggaaatggaatgtgaaaaaataaagaaaatacttctactttgtgctttctttcttctctaaaaaatccttcatttctttttaggagggggcatggctatattttttttatcatgctcaatattttgaggagcaagaatttattttcataaccatgtctttccctcttttctttctttttggaaaggatattattttgggaggagaaagcatataattagagagctttatttgggtggtaacatgatagatataaatggaatggatggatgctaacttctagtgcaaaagttcgcatgtgcatatatgtgggtgtatgatcttgatcatagagcatgaaaagtatctacacaagtctcaaaaatttgacaaagttcaatggaagtacaagtgccaaaaatatatatggtttgtcaatatgaatatttttggctctggtaggaatttatatcaaatgatgaacttctaagtttatcattttagaaaataaaacatccaaaatttaagtcaaacttagaacaggatcatagcagctcttatcactatctcatatctcacaacaacctagacttagttcagcaagtgcagcccacttacctcaggttcccggataatatgtggccacttttatttaatctttgagatattacttaaccgtg

SEQ ID NO: 51708 - DNA, 1501 bp, Oryza sativa
tcttattcatctccagccgatgcaaagtgttgaatagtctttatattgattgtggaaggacaaatgacataagatataagtggaagagcccctcacctcaaggctagcttttgtgatgggaaagactatttacgatcctacgcaaagaactccacggcaataagaaagagacaatttggaaaggtagatacgatgttgtttctcgttgttcatatatagagtccagcaaatggttaaattcagctctaatgtcagcaaggataaagaagtcatcaaaagctctaatgtcagcacggataaagaagtcatcaaagttaagaggaacataatcccagttgagcacatctctacataaacaccaaacaaccagttcagcacatctctacataaacaccgaacaaaatacgccaaagggcagctaaagattatgtacatctctacagaaacaccaaacaaaatgcgccaaagggcagctaaaaattatgtacatctccacagaaacaccaaacaaaatgcgccaaaggacagctaaagaatatgtggtttgtagtttctagatggacagtggagaaaaaaattctaattttaaaatcagtaacaccaaacaaaatgcgcctaaggtcagctaaagattatgttgtttgtagtttctagatggacagtggagaaaaaaaatctaattttaaaatcagtaactagagggtgagcgtgtacggtacggtgttaacacgggccacggccggcggggagcacaaaagttacagtctctatatttattttagtgctagagaagacacatatagtaaggccctgtttagattctaacttttttacttcaaacttttaacttttttgtcacattcaactttcctacacacataaactttcaacttttccgtcacatcgttctaatttctttaaacttctaattttaacgtggaactaaatacagcctaatatatgctactccctccgtcccaaaatataaatatttttaaacttcgacacggtcttcgagatactactttgacaaataatatctatgttttaactaaaaagagttgtatattatgataatttgtttaatgatcagtctagtaacatcaaattgacatgatcaatcttttttcttttgctattaatagtcaaaatttaaaaggtttgacatcacattactctaaaaatatttatattttgggagggagggagtatcaatcatttgaagagttcagtgacattgtaccctaaggacgaaacgaatactggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatcgatcgacgctggctcgccggcgggatggccgtcttttcgttgatcacttgtg

SEQ ID NO: 51709 - DNA, 1501 bp, Oryza sativa
tttagtcccggttctttttggaaccgggactattgtggttttgggtcgacccagcaaagattatttttccagtagtgttattgtgaagaatatactatcaaattgtgattgggaggattctgacttcaccgttcagtccgaggttgatttaacatctcagatatatcttgtacgacaacaaaaagtcgatatatgggtgatttataacttgttgctaggaataatgtactctttataaatgttttagaagttttgcaaagaaataaaaagaaaaacttatgtgatactccctccgtttctatatatatatgatttaaatgtggccaacgaggttactgaaaatgaatatttcctcttactaatcttcgataaataatctagaaatatttatatatttagaaacgagaggagtacaaaatatacttcttggtttatagatgtaacaattcgacaaaaagaattcatatatgtgtccttaatttcactatttcacatagttggggagagagcgatgtcgcaatgaatagtagatgctgactcaattcacctgtacgcgagccaatcaatcagaatcagacacagttttacatcgatgactctcgctatcagatattcagataccgactaaaaccaacaagatccaaagtctaacacaccgttggatagattacaagttaccgtctttgtacgtccttctccaaagtcgacaggcgagaaaactagaaccaagtactaccgtccaggtaccaacattatattagagtttggattaataaagccagatatgatatgcagggcacagacgtgcacttggttgacccgtgtagtagctgtaattttcttgtttaatttccacaggttaattaagcgatcgtatataaataagcccaaacaatttttgccgataggagatggctgctagtgttagctaagaggcattccttgatcgctgactgctcaccttccaagttgtctcgtcgttctttcggaagcttttggaattatgggtgatgcctttgatggttcatgccataggctatggtgtttgtagatgcaagcagctgtgactgctggtgctaggatcatagcactaataactcattcttaaaatatgtataggagtagcaatcttatattgaataggatatatcttactattgcgaatctgtaaagtacgtgttatatttcctccgtctcatattaagttttttttagttcattttatttgtcctaaaataattttatttttagagtaattattgcattggagtttataaaaagcagtgaataattgtattggagtagataaaaaaatgaatagttgtattaggatttaatagagtatggatattctattttttttcttttgtattggcatgtgtgggatgtgtgaaaaatgctgaatttattttgggatgtaggtagtatatttggagacagaaggagcatgtaaggatcataatttctcgtgtagagcaaaaggacgttcggattgttgtga

SEQ ID NO: 51710 - DNA, 1501 bp, Oryza sativa; identical to SEQ ID NO: 20474

SEQ ID NO: 51711 - DNA, 1501 bp, Oryza sativa
tcgatcgagattggcatatgcatatactccgctgtgcacgccgtaccaagaacgatatgttcagtacgaatattctcccctatccaagtttaaaaggcctgctacaacgcagctgtgtgcgtttcaggagttcagacgtttaaaagacgagattttacatatgcagcacagggctgaacaacagtgtccatcacctttctgttgttgaccaggagtacgtgctactagtatctatctatctatatagggccagaaagaaaaaggatggagtgatctgcattctgatcagtacaagtatactacattatcgtttgattgtacttcacttcgttgatcactttgcgaagtacttgtcttccacatggtcattctgagatcactttgacgcagaaacacgtctcaatgaacaaacaagttccgtacagccactaacatgcaatgcaaacttgttaactatttactccctgcacgttcacgttgttcgacgtgacccagctgggagagataaacagtgcttgtgcacatttgcatgcagtgtttacttgggagaagggaacgagaacaacaacagtaagacagtgtagttgtaaagtaaagtagtcgtcctagtgagagtagaagtacacgcgaataaggaaaccatagtttatgcctgcatgtcgagttggtccattggaccttagtagagcacggggtagagtagtctcacgctacagtgacgtctccccgactacaactacgagtccgtggctggctggctactgcctccatcgtgtataggttcgccccagattgggatcggtttccaagcccaaccgatgcttttacatgcatgcatgtggcacagccgcccctaccctagggacgtagtatcactgtagcacaagtagcaggacagctgggttagatcctatagcaagggttaaaaaaaattgtgtggttactctactgctcggctataagtaaaaaactcataaaattcaaacaagttttgtcgtaagtttttattgggtagtttctcgatttgtacgtaccagcttgaaaaactcgataaccaaatgtatattgttatatttattaacctttgatctcagcatatatattgatgtgttatttatgtacatgaaaaaaaatcaaacagctaagactattgtaaccaccaccgagtctacctcctctccttccttgatcacctaccaccgccactgatggaatacttctttttttatcttcctgatatgttgtctctctcctttcatgcatcgcacgcatccctcccgcctcatcgacgccagaagccatcaatggtgtcaaggagacccacccaaatcggtcccttccccacctcatgtctgaaccaagcagcggcgggtgttaatgccccgttgtcttcctcgtctccggtggctcacaccgtcggagacgcctccatcttcctcccaaatcagatgtgatcccaccaactatccttctctagcctcgcgtccactgcctccccgac

SEQ ID NO: 51712 - DNA, 1501 bp, Oryza sativa
caatccctaccagggaccctgagcgaaagataagcttggggggagacatctccccccactgaggtaacttgtatcacattgcatattttccttttccattgcatatttacatttccacattgcatcctataaaccaaaaaaaatgacataaaaatttgcaaaatagaaaataccaaaaatataggttagattttattatgctaggtaagacaagtagttctcttgattgaaatgatgaatagttgcactgttttatatctcttatatatggattcacggttaagtaatatctcaaagattaaataaaagtggccacatattatccgggaacctgaggtaagtgggctgcacttgctgaactaagtctaggttgttgtgagatatgagatagtgataagagctgctatgatcctgttctaagtttgacttaaattttggatgttttattttctaaaatgataaacttagaagttcatcatttgatataaattcctaccagagccaaaaatattcatattgacaaaccatatatatttttggcacttgtacttccattgaactttgtcaaatttttgagacttgtgtagatacttttcatgctctatgatcaagatcatacacccacatatatgcacatgcgaacttttgcactagaagttagcatccatccattccatttatatctatcatgttaccacccaaataaagctctctaattatatgctttctcctcccaaaataatatcctttccaaaaagaaagaaaagagggaaagacatggttatgaaaataaattcttgctcctcaaaatattgagcatgataaaaaaaatatagccatgccccctcctaaaaagaaatgaaggattttttagagaagaaagaaagcacaaagtagaagtattttctttattttttcacattccatttccaccatatatcacacactttatgtacgatcttgatcttgagtatgtctagtcatatgctctagtctaagtttttgacttaataataaatgtgaatacaggtatgccatgtttgatccctaccaagctccacatactaaaccttagagtaggaatcaacaaggttactttggtgaggaattcatatttatacactttgagtgatcgagaggatcatttgaggaacttagatttcttttgaaaaatcatttgaaaactttcggaataaaaagttgaataaagattgggtgactagtgctcatcattgctgttctgtctttcaaccgctcagggcaaggtaaagcaatgtctcgcgggaatcaggtgtaagggtaagccacgtgataaaattatttgatttgagagagagtacatataccttgcacttgtacatttgagaatatacagcatagtagcaactcctgatcaataaccaagttttgtttcctttcgtcctttactcgggacgagcaaaggttcaagcttggggtgttttgttgatggtcgttatcgatcagtttcgcccgtcaatat

SEQ ID NO: 51713 - DNA, 1501 bp, Oryza sativa
aggcaaatctaacccataaactggcttcatccaagtgacatgcaaacatagtatgtaacacatatatgactactaaacatcagctcttaattaatacctatgaacatgcgagataatcattccggtcaaaatgatatataatttcagatcctactaaacatttggagttaacagccaactaaggtaagctacctgcctacttggttcggaaacaaattttggctttaccattcctccagagaccactaaccattatccagaaactaaacatatatcttacgttgatctacacatttttttgagctttcaacagttcaacttgcagtagccttgtctcaacatttaactctacgcaccattaacaactacggcccgtttggttggagggagttttaaagagggattgagagtttagagggatgaggctattaagtgttttgtttggttgggagacatgggaattttggtgggattgggatggagaattgaggaagaaactccctccttttcaatacctgggtaggggcaggtaattgggagggaattcctcgtttacttggtctaagcaaatctcagccatccgtttttattaatgagctaatctccaactaaactccctatcaatttccatcacatctaccaaacaagacattgggattaaaaatcaaattcccatcttaatctcatcgtaaattctctcgtgtaaactcccaatccccttccctcgagttaccaaacaagccgagggaaaacaaaatcacatgcacgatgaacagaattaagcatcaaagtgcaaaaccccaaaatataactacaattggggtaaatggacacacacacacacacacacacaaaagatttccggtgacgcaagaacagaggcgcaaacctgctcttgcgcgccgaggccggtgccctccttccagcccgatttcttcagcagctgcagcagcaacaagatcacttaagattagctccggattcaggacacgacacgagacgcacgcaccgagatgcagaggaccaaatcgaacaaagcatcaaaccctagccccacccacccacccactcccatggccatgggattcgaacggacggaagcccaggtgggatggagagcttcgcgcacctggaacccgacgttggaggagccgatcgccgccatcgccgcctcctctcctctcccctcctcgccgccgcgccggctcccctcctctcccctcctcgcctcgtgttcgcaaccgcgacgcgtgcggcctcgaaggctcgaaccaaattgggccgggccttgtggtctccgggtcggtttcgaaccggactctactcgatcaccaccgtccgattattcagatcggacggaccaccccttcccacgtcgacgagcctcgcctatacttgtcgttcccaacgagtccgccacgcagctgagaccaacacaacctagggcacacgccacacgatctcgcggaaccccggcggccggcgatgtcgacggtgatga

SEQ ID NO: 51714 - DNA, 1501 bp, Oryza sativa
ccacttgccggctgggcgctccctgctgggagcgccggcctttttctttttgtcgctcgcaggcctccccttttgggtggcccgcgaagcgccctcgacggcgaggacatgaccctcgtcgtcggaatggactgacctcttcttcctcctcctgtcacgccgccctatctgagcggcggatccgggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgcccccccctgaacgcgtagattaccgcatgtgcagggatgcatggtatggtgttgcggacttgacagaaccgctgaatgtacgagcgaagtgactcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccgatcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcggtcattacgccgccgctcgatgctggtgcgggcgtccggccccccacgcagatcttcccgggtcgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgtcgtgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcgagagctcagaagatcactcgcagagccccctacctgg

SEQ ID NO: 51715 - DNA, 1501 bp, Oryza sativa
gctctctgctctctactaatctttgtttggcccttgttaaaggagatgttaattctctgtgtgaattggggagcatttaaaggctgggttttagtgggggaggaagaaagggatccttccaaccaagacccacaggaagagagagagagggagagatgagatggagaaataaataaatccaaattcagccaaacttctctctcttcctcctcttacatcctctcatcaccaccaccaccccacctccttctctccctgtctttctccttctcctcctccttcctctcgctctctcctccttgacaaaatttcctccacccattcccttctccacccaccctgccgatctctctgaattcggtcgcctcctccgcaccatctttctctcctcctctcttctagcaatcggtcgtttcctccggttgttgtgctgattcttcgttctttctctccctctctctctctttctttcttcctctctctgccttggagaggatcaagaaacgaagggagggaggagaggagaggagaagggaaatcgagaaaagtctgttctttggtttggctcgtgtggttcttgagagctgctgtttggaaaatctctgcacctgttgctggtacggtttgctgcatctctctgtgtctatgtttttgtttaatttctcttgttcttttgattctgcatggtggcctgccatactctttggttggaaatctatggttcctttgcaatacatgtcctttcttgtgttgattctttcgtggttcatcccacgagatgttttctacagtccggaatgtgtcaaatgctattaaaccgtgaaaaattcgtgtttttctttttcataaacacatttcttcaaactttgtaaacggtacgtttctctttgcttggtgttacggtgagaaacagagatgacttggtgttcttggttggttaaattcctccctgtgttggttgcctttcaatttcgtcacgagaaaatcaacctgtcccttgaaaccgtggatcgccgcttctaccttttctttccgtttgtcttttttacttaaaacttcttttttttttgcaaaccgaaaaggaagggaattaaatgcaaataaaatgagagtagtagtagtatattttttggattgtccacagaggcaatggggcccatcttgcatgcagtccatctgtttaggtcgcatgcaatgtacaatcaccgtgtctcacactcattaaattgcatgcatcagcacaacctttgcttacaacagcccaaaccatcaagtttggtgcatccatatacctcaccaaatgcggttcatgccaagattgctacagtaaaattagttaatgctctcatcaatgacagaatgaattgctattctgtaaaacccaaactagtcttcctgcttctggatagtaacccttttatcaaaaagaataactttctgatagccgagtcatgaacaaaagatttgtctgttcacatttctatagatgttaattagttaa

SEQ ID NO: 51716 - DNA, 1501 bp, Oryza sativa
atatgtgtattcgcatttacgattggttatattttaagtggtaaataaatgaaatatacgttgagagtgagatgcttgtgattatctaattaatcttaaaatatactacttaatttttcggagatgcttgtgtgtgttttataaggataagtgtggacaagctgtattgctgttctaataattttgctgagaatgtaggatagaattactatgctcattcatacataagttctacgtgatgagtagttaaccaacgtaagtgtggggcatgtgggctccttcttctatatttttcttttacggggaggacataagactggagctcacccacgcccagccgctcgtctagttttttttatctttaagatgcttttgctatttaattacaccatcaagatatggtatatcctaatactatgaatttaaacagagcattatattttaagacggatagagtatctatcaagtgaatggtgacactggaccaacgataagccaacaagccggtgtttttttttcttactaaatgcttttactatttattatgtattagtataagtgaatgttgacacttggaccagtgatcagccaacgaacctgccggcttgagaaggatgaatcggatgtagtgaaatcggtcaagcctccaggatggaccaatggaaatacccacaattcgtgcaggtcccatcctggctccaacttggcatgtacagcaacaagcaataaatatagctaggctttttagattgtcaattagacagctgatttgctaaaatagaggaaagaaaaaaatcaaatgtaaagcttcacaacgccttaaaattaactatttgcatttacaaaaggaatattttctatacataagggtaaggaaaatgaaaaaaaaaaggtaataaatattattttgaagtattaatagctagaaccttcgttgtctcaattgttatgcgaggttagtctctacatagctggcaagtcgactagggtgtgctctttccctagtttttccaactctcccatgtcgttttttgtgcacacgtttttcaaactgctaaatggtatgtttttttttaaaaaaaataattatatactaaagttgttttttaaaaaaatcatattaatctatttttttaaaaaatatttaatacttaattaatcatgcaataataagtgtttcgttttacgtgccgagaactaacccctcctcgcgaacgcagcctaagaggctctaccatgcaacatatcatgtgtttgttttttgacgcatgtttcccaaactaataaacatggtatctcacacacacacacacacacacacacacacacacacacacacacacacacacacacacacacacacacacatatatatatatatatatatatatatatatatatatatatatattgtgtgtgtgtgtgtatatatatataattttactatacacacacatatatatatacatatatatatatatttatatatatacatatatat

SEQ ID NO: 51717 - DNA, 1501 bp, Oryza sativa
gacctaaacagatggactgcatgcaagatgggccccattgcctctgtggacaatccaaaaaatatactactactactctcattttatttgcatttaattcccttccttttcggtttgcaaaaaaaaaagaagttttaagtaaaaaagacaaacggaaagaaaaggtagaagcggcgatccacggtttcaagggacaggttgattttctcgtgacgaaattgaaaggcaaccaacacagggaggaatttaaccaaccaagaacaccaagtcatctctgtttctcaccgtaacaccaagcaaagagaaacgtaccgtttacaaagtttgaagaaatgtgtttatgaaaaagaaaaacacgaatttttcacggtttaatagcatttgacacattccggactgtagaaaacatctcgtgggatgaaccacgaaagaatcaacacaagaaaggacatgtattgcaaaggaaccatagatttccaaccaaagagtatggcaggccaccatgcagaatcaaaagaacaagagaaattaaacaaaaacatagacacagagagatgcagcaaaccgtaccagcaacaggtgcagagattttccaaacagcagctctcaagaaccacacgagccaaaccaaagaacagacttttctcgatttcccttctcctctcctctcctccctcccttcgtttcttgatcctctccaaggcagagagaggaagaaagaaagagagagagagggagagaaagaacgaagaatcagcacaacaaccggaggaaacgaccgattgctagaagagaggaggagagaaagatggtgcggaggaggcgaccgaattcagagagatcggcagggtgggtggagaagggaatgggtggaggaaattttgtcaaggaggagagagcgagaggaaggaggaggagaaggagaaagacagggagagaaggaggtggggtggtggtggtgatgagaggatgtaagaggaggaagagagagaagtttggctgaatttggatttatttatttctccatctcatctctccctctctctctcttcctgtgggtcttggttggaaggatccctttcttcctcccccactaaaacccagcctttaaatgctccccaattcacacagagaattaacatctcctttaacaagggccaaacaaagattagtagagagcagagagccactgttgtgttgtctttcacatgacctccctccccccatccacttttggatttttgcagcactctttctctgcatgctcatcctctccattgaatagtgtattatcctgctctcttttttttttcttccttggttgagcatccttgcattgattatttctaggtgtaatccaagtgtcatgcctgcttattgaaatggctgcgttgtttgtcacttcatgagtaattgtgaaagggagctgttcactgtccagataagttaccagaggtacaactgtaggagtactattaaattgtgagctggttcttttagg

SEQ ID NO: 51718 - DNA, 1501 bp, Oryza sativa
gttttgtttttcataaatttcaataaaatgattcgaactattagtatactaaaagacaggtatttcacaaagctacaattttaataaacgattttatcaataagatgcaacctgtaagttatcatgtgtgtgcgatatatgggtctgacgcataactatgtaaattttgtacgtgtacctactagcgaacccaaaattcggtttgcttttatatttatttttattgcaatgtacgagcattatgctactaaaataaagctcttcattatctaaaagatttatatggtaaaccgatagtaaaatgttttccatgctatgaattcaaccatggcacatcctaattcttacttgcactgcagcagcacaacaacggtacgcaccttctgtacagtagacttggatatatgcatataattaactagatgatacctcgcactttgttgtgagatttatagatgagtatatattaaatattatcgaaatgatgaaagttaaaatgttaaaaaaataatatgaggaagatggtttgacacatacttgttgatgatgtgtcatgcttgtatggggatttaaaataggctataatagtaattactcgtgagtgaagatgtgacatgcttttatgggattttaaatgagctagaatagtaattgttagtgggtgatgatgtggtatgtttgcatgttgagctttggcttctaataattaataattgttagtggataccaactatatagaaagtatagatttattgtggtagtatttttatttcatatatatactcctcgtatgcgtcttaatctacgtatgtatactgttgtgtaaaatcttgtgttgaggatagtgctctctatccatttgcaggctgaaaacgtgtcctaggtaaactaggaataactggaatatctggaaacttgattagcgtaactaattaataagtatagtagtaagcacaccttaaagacggtaaaaagaataaaatgtcaatagtcagatattttcaaccaaaataattatatgtatagaagtatagaaattcaaatagccataacactaattcatgggagaattttccagtgcagtgctaagaccaacacagttcaagacaagcaaagatcaagacgcgaccaaattaaaatatcagcaactaattaaccaattcaaacgataaaagaaaacgttaaataatatccgtctctcacacgatcttttgaagtactaattttatttcatatcctctggctaaaattcaattaaattaaaattgaggatttatcatttctaggtatcaacttttaaaacatctcctctccacttttcagttcatcaggtaagtccacacttgccgcaggtgagtcagtcgtggtgcttcgccataagtgcgccaacgtctttgcactctgggttaggacacatcagtcgtagcctctccaccttccccatcacgtcatcgacacgatagtgacggagcaccgcaagctcttccttgcggtgctcatg

SEQ ID NO: 51719 - DNA, 1501 bp, Oryza sativa
ttatcatcttatatccctagttttaccaagagttttgcaccaagacatgtcggttcagttatgtgaacttgttatggagccgtatttgctgctaatgtttacctaccgttgagtaattgctttgttggctctgtggtaacatctattgattgctgctttatctgttagcattggtgtgttgatctctgcgttattgcttgcttgatggtttcagtgtaggaatttccctggagacgctgatgctcagcctggacaggccttactttttctttagaagcttaacattgttttgcatgtctgcagttcttcggctggttcttgcttcctgtggtagcttgtttgttgttctacttagggcctgttttgcagggtttaacttccaaatttaactcaagagttggctttggagagcagcctgaaccctgctctctagtctatggctgtgtttagtttcatgctaaaattggaagcttgactaaaaattggaagtttgaagaaaaaagttggaagtttattagccctatcgtttggcctaaacagctaaagaataaaccaaaatttgattttgaaatgcttttaacataatttttttttaatgttggcttttaagttttgaaatgcttatgtgtgcatgtgatggaaaagtaaagttaggaactaaacaaagcatatgatttgagagcataccagtctgttctgatcccttttaaggcgaagctgaaacatcttggttctctagtttattttctgagaggtgcagctcaaaacagtttgatttaaataagccctaggagtatgtagtttggagatattttgcaaattttgaatttgctgttcattgcggttaagtaattttgcgtttatttcatatcgtgagcaatggtgtgacattggataggttgtttaaatctgttttagatgtagcgtggaaagattagatggaagccgtctaaatcatgttcatgaacgtatatttttcgtttatttcgctgctttcacggtgtttcgacctctgtgttctggtagcttttcttggtacgctgcgttggaaggatcagttctagctactcattgcatactgttcaatgttaacgatgcatattattgtggttgattgatgaattttaaactcagcgataatttgagggatataaagtgaacttattcatagactgaattaggcccaaatataaccgcacagcccatttcacatccaaatgtgggcccattacatggaggcccatcaccgtctcgcactttctcgcttctagtccccaatctgaagcccccctcgatggcatcgccgctccaatggacggctccgatccacccgccgccgcctccccatccgccgcagctgccgccggcgacgacgacgacgagcgagccgccgcgcccgcggcccagccggagcggtgcgaggctctggccggggccatcgcgggggtgctgggcggcgcgctgcaggaacacgaggcgtgcgcggcggccaccgctcgga

SEQ ID NO: 51720 - DNA, 1501 bp, Oryza sativa
tgaaccaaccctaagcttcaattcatcttgcttggaagtagcttatacatataatagttacctataaacatatattacaccattaatatatggctttatctctcgtacgcacaaatttatagcccgcttcccttctctcttcttttctcttgtctatatgtgtttacagtttacttatagcatagtattatactcgctctaatcattttcttatctaatctaatccaccgtttgtctcgtcacgttttccgaggcaggttagtacttccaaaagctagtgggctagtgcaattagccgggggcagattatggtggagccgtgactgttgtctgcttaaacccaagcgtactcacgctttggccaaccattttcactgtcgagtgggtcccagccatgtggggcagggttgtcagtggtgattagggggatgatgtcaagtgtaactgtgtagcaaaagggagcaaaagcattgctctgttgctgatcattggaggcagggaaaggactatggaggagacgatgtgtgttttttggcgggaagtcgacgatctgcttacgagtgcgaatccaaagattcgggggtttctgatctaaccgcacgaccggttgcttgttcatcattttgaggtgatcagtcagagtcaggcgatgatgtttgagtagtttgacgaatctcctccgtgcagtgtagtagagcacttatctccgatgaccctacggcatgattggcgtttggcgaagtcgtagctccactttcacgggaacggtatcgggcttcatgattggcatttggatctaaggctaactttgccatgaacttaatttgcgatgagtatgaaaagacaacgactatgaaaaattttggctagaaaataaaagtataacatgtaatcaattcctaataaagtgggattcagtttaaatgtggctctcaatcaaacactagcttaagaaattataacgtgtccaagatttagtgtggtaatatttggtcatcaaccaaatagcctcaatatttattccaacattcatatgttgttcaacattttcatgtaactagttaaggaccacacatgttgcaatggaaatccaaaatttacacatagctatgagtagggcatgtccagttaacttatacttcttccgtttcataatgtaagtcattctagcatttcccacatttatattgatgtatatatatatctagattcattaacattaatataaatgtggaaaatgctagaatgatttatattgtgaaacggagggagtacatagaaatcgtttttgcttatgttgcaagcaagtcactctaaccaggttggttaagtaagattgtgatggtccgttttcacttttttagtcatctacaatttgatgtttcatggagcgttttttatacggtgataggtcgtcgttgcaagtagtgatggttttcatgtgggagaaaggttggctttttacaggatgtctttttatccttagtgagttgtttttagg

SEQ ID NO: 51721 - DNA, 1501 bp, Oryza sativa
aaaccatatcattttttagcagagttgtcaaatatgtgcatcaatttagtttcttgtcaaactttgataaatacataagaaatcctattaaaattttagcaatattaccaaattgctaaaaatttggtaaggtttatttttgctacaatttaagcaacccctactggatcaggcttggatgcatgcttcctcgctatacatttgaaggaaagcttgaccacctgcccgctgattcggtcgactgctgagcccattcgtcaagtccgcaagtcctgcacattgatgggtttaccgtgtgtctcaagtcatgacgtcctgaactggtaaacaggccgacagattcatcgtctccgctaggaataagtccacttgtcatctctcaactttacatcgaatttgatagctgtccgtaaaccacaataccaaaaatcttctcccccatctttacaaaaccatatacatcgggtctggtagtataggctcatatttctgcttacataacaagttgaccgggcccacctggccacctcgctaagtcaccaatgaccggacccattgttaacgccaaaatttagtaagcttcaaagttgtcatcggtctagagacaatatcagcttcagagtcccggaatggaccaatagaaattgtcagtcgacaacagttagattcttgatggattgggcaaggaaattcatatttaaatgaagtctatccagaagagatcgacttcaagtaggatatgacaatgtcaatttatttattaattatatagaattagttagtttctttttttatttttaggaaaatgtttttagtgtacgatcaagacttgcatatatttttttctctttaggaaagtttgagtagtgtccaattagaactctgatcggcctatgggtataaatatgtacactcgggatccctataatctatcttcacagaacaatatacatatattttcggcgcatctcatgaggttttatttcgacgagttcttgttttcgcgcatgggctgcatcgattgagttcgaccttcggcaagaagtgagttccatcatcttcgcttgcgctggcgtagctaggactttctcggttgggtccgatatactaattgggtcgacgcaagggttgcctatccggtatatcatttctatctttatttccattactgtttataatcacatcggcttagttaggacttcctcggtcatgtttgattatcataatactatctcgtgctgcatcggttacggttaggtccgacctactagattgttattaataatctaaatcttgttaagccgataggttcatactaatattttatcggagggttagccgatcttatctgttgtgttaattttctctttgatggttttattgtcttggttaatttaatgcatgaccagtttgatcggtgtcatatcagtttgcttaaggaaaaagtacgaattaccccccgaactatcgcggtcgtccgaattacccccctaaaccacaa

SEQ ID NO: 51722 - DNA, 1501 bp, Oryza sativa
cacttaccatataccttttgcttgtctgatgcaccctgcagccatttttatgatcatatatagacataaaaggctaatgaattatcttcagtcacttattgattgtactctgagataccggccgatcaatgtagtaaacatttacccaatcaagttaattaacatgaaaagcaatgcagaatgggtatctacatccaagtggtgtatgcgtatttgcaggaaaaggtagtaattagcaaatagacatactcacatacatatgtgatcctttcgtttgtgcttccaagcaggcctgcacatcaaaaaaaaagttctgaatcaacggaatatggccttctaacagtgaaatttcagaagcataatgcaggtaaggcatttgtaacctcatatgttcagacctgattgaccatgcaccacagaaaaatcaagtagaggtttccaccagttatgtaaggttgataagaagagagcatgagatgtaggactgtaaagagaactgagaaatcaatttgaggagtcatatcagcaggaggagatttggctgctgccacccatgtggagtttcacctgttggttaccgcgtgcttgtaggcgctcgatgcggcacagatcttgcagaaccaagctcgcgtgggatggagaaggagacgaaatgacggcgacagtggacatcgaactcgcaagaaggtggcggcagctgccgctggctcgctgggaagacagcgacggtaaccactggctccacacgacgtcagcgacggctggttcagcgagcttgagaggaaggcagcggctccggcttctcaagctcgaggggaaggcggcggctgaccacaggctccatgagaccatgagcaggcggcggaggatttttgggaggggaaaacggcgagtagccaaggtggcggcggctcgtgggaagatgagagggattagggtgccagagtagcaacgggggaggtgatgggggaacgaatggctctgataggatgagagcaccgaatcggacgacgcacatgcagccagctactgttaccctgtagcagggcaaagctgcgctgtggttgatcgagagcttggttacaaaaactaaggatttaatatgattagattacaattacaacagattagagctctatctgataccggcccatttaaaacaagcaagggtgcatgggccctcatgaatacggtccaaaatttgtgtccaactaaccatatctccagtgtaacctattcactgccgagttagatagacgcgtttatttagtttaattaaggcaaattatggatattttgaaattcaatcccgatcaattcagtcagaaaatcgtactatttgagtggcttgggtagtctatggcggtgcagcccactaaacgagtccgagtcggactggcccgttcaaccgatataagcggacggcccatctggccatctcttgtgagatcaatcgccgatccgccactctcccaagtcccaaccacgacgatggcggcgg

SEQ ID NO: 51723 - DNA, 1501 bp, Oryza sativa
atgatcgtaccatttgttaatgcagttctatacagattgggcagcctgaaagcaatcctctgcctgcctcgaatttcaccttctcatcgcgtttgatcgtctacctgacgcatctcagtatgaccgaccggatcaaataaaatgagaagaagagatgaagaggcgtgtattcaggttcgagttggtgccgatgcttggtaaacaagtgctgcgagttgcagggtagggtgtcttgcagttgcaggtaaccatcagctagctagctcgatggtgcagttcatgggatgtggagcaattttcttgtgttctttgcgatgtattggaagtgcgtcatgtgccatggttttctttaatcttgtaaggccgacctgcaatttgcaactaaaaagaccatggaatggatgtgtcgttttccattgaactgtatatagtaatgttgttactctcaccaccacacggtctgcactggtttttttttaatccttgttgtgttgtctcactgtttctgtatcatgatattatcaaacgaagcagtggctcatttttaatctttgctttaatcttgacgaagcaagatatagtgacacgatcgtaaaattgttattttttagcatttatatttttatattttctataccaagttcctcctttggttttgaggcactcccttcgtaccataaaaaaacaacctagtataagatgtgacatattctagtcctacaaatctgtacgtagattcgttttttacggcacagagggagtactttttttaatatgtcatatgattttatgtaaaatttatatggctattatatttacgagggaggggaggccgggagggtttggagattgggggtaggggatggatgttttgcagaaaaaccctatacttttcatgtttagagcgctacccctagaatcggaattttctcttcttcacattgtatttcattagaagacaagggggtttccggataaaatatgatgggctgtcagtcgattcaaggatctgtgtaatattttgtacaaaaacgatgagctttttgcaaaaatagtcaaccacgcttatccttccccgaggagctgaaaaaaaattccaaaaaaggagaaaatttgtacggttaggggagttattgactttagatgttgcattcaaacatatcttataaaaatttctccatatttttctacagttttgataaccgttttctttatttttaaggtttgtgtttattgtgttcaaataaaaagcaactaaaaaagttgtgtttaaatgattactattgtgaaaaatgttgctaataattgagcctagctgtcaccgagaaaaaccatacgatctgaacgtccattttccatccaacgtttcgagatactacaagtagttcagccgccagctaggttttcccccacttgctcaaccccgccgtcactatcttcatccgccgtcccgacgccgcgagcccaaacccctaaccccggagagcctcctcgccgcaga

SEQ ID NO: 51724 - DNA, 1501 bp, Oryza sativa
gatcggcaattgatctcacaagagatggccagatgggccgtccgcttatatcggtcgaacgggccagtccgactcggactcgtttagcgggctgcaccgccatagactacccaagccactcaaatacgattttctgactgaattgatcgggattgaatttcaaaatatccataatatgacacattgcacatctaaatacccagatggataaggttcatggcatgcttcatacagcacagatactgtagcatcgtgtatcatcaaccctgataattaacgaactatgacatttttccaatgtacaagttctatcgcaggaaaaaaaaagaagaaaatatcgacagatacggcatggatgaggatttgaggatggtacagtgactaccttcctgacatggcaggatacacataccaatcaatgctcccaggtcgtcatggatctatcaactattgatgaaatgattcttcacaaatcttgctagacatcaagcaagcccaaacatacgaaatagaaagatagaggcagatggcaacaagccaatacaaaacaaaagggtggtgatggatggtttgccgatgtttcccgcataccactacacagttccaatgactacagatattcagcctgacagtaactcattttaccaatttcaactaaggattgccatacgtcaattaattgctagtatgtgtgctggcctcaacttgctcttgaattaacagtttccggacttcagtgccttcatcagccatctcagcagggacctggccataagtattctccttcttggcacatgccccagctttaagcaagagatccacaatacccagatgttcccctctggcagcatgatggagtggctgcacggagtaattgcagaaattatacatcatgctgatagcatttagctgaaaaaatggttcatgtaatacttaaagctcaagaaactttacagtgtcgccttcagaatcaacagtgttgagcattcttgttacgcagccatcaatgttcgcagcaaaattcaaaatgtactggactatatcactaaagcctacatgaaaagtgtttattagattacacatacaaactgccaacaaaagggataaaaatagccagagcgcaatgcataataaacatccatacctccagcacaagcatcatgaagaggaattgctccttcttcatctttgcattccaagctagcttgacgttccaacagtagctgataagataaccacagttaggatacaactaatagcagagcaaaaataattcaagataacaacattaacctgaacacaaggtagatggccatataagcatgctatgtgaagcagagtatcaccatcttctattggatcatcaatgttgccagaataattatctgcatacacatatcaataggattttaacgaaagatctgcatctacaacaatcatctgtgtacaaatgcttttgctgatagcagcttccacttgcaagtaattgtccaatgagcca

SEQ ID NO: 51725 - DNA, 162 bp, Oryza sativa
tgtgcctcggctgattcctggacgagggttcacacacatgtaagcgtttggaattttggatagaaattgcgtgacactagatccgcccaccaaaaagaacgccgccgccacttctgctggatctgcccacgggagcaccgatgtcaccgccgctgccgcagg

SEQ ID NO: 51726 - DNA, 1501 bp, Oryza sativa
gcaaggatgccactcgactgacagatctagtggcatttttgtaattttctagtagcagtcttacaataacgattcaaattagtagtaaatttgcaattgcccctttttttcctattacccgacaataatcaggccatgcaatccggttcatagagcacttggagtcatgttgatgtaaaaagaaaatacacactggcctaggagatctgtttagctctagtgcaggtccaagatgttgatgagatgcgggtgtgtcagtcagtttgatcctgcaactgacaagatatgtaaacaatatatcagatagccgatcgcctgacaagccgatggagtaattccagccgatagccgatactaaccgatgccgattccagccgatgtcaatagggttttgagcaatcggctatatgttcaatgtagataataatgcaaagataatcggctgatgataataaaatatagttataatataaaccaacaaaaaccaatgggctaataataatatgataggataaatactgatccgatggttaaagcatacatcggctggaggtctgatgctataaaatccacaagagtagattaaacaatgaaacctttgttgtcatcagctaaatccaatttatatatgcaaaccttataagttgatgcaacgtctagataactcatcgattgaaaccccgataaaacccttattggtagtcaataagcaggctagagattatggttctaagcacgacttaatagattaaacttaactgatgcatacactaagtatgaaaagaaacataatatctagacgatcaagcccttgactgattttcagggtgataaatgccttagctaatctaatctagtaaaacaacttagccgatacaggcagaaacactaaagcgagaggcaaccgatagagctaaattgagatactaagactagattaactaaaacatatgataaattggcaaacaaattgttgatgcgaaaaacacacactggcctgggagatctgcttaactccagtgtaggtcgtaaatcttgctcttgggttcaaaggcatgccagttgatttgatcctacaatcaataagaaagaaaaacaagaaaaccaaggttaaatccataaacgatagccgatcggctaggggccgatgacatatcgtcgaacattgagccgatgttattggtattagatcggcaatgaagaataaggcaatatagagttaaatctactcgatcggctgtagacatcaacgatatataatcattttctcaaaatatatttaaaccgagtgattgggatagatcgaacagcaagtcaagacagtataaatcacttatgtttaaagatactttaagataacgattatatatatgtttatagcatagccgatcaaatagatctaacatatatcggctaatactccgataccactccatattaagatattaaatcagacaaaatatatcaaataacaagcctaatatactttaatgcaacaata

SEQ ID NO: 51727 - DNA, 1501 bp, Oryza sativa
tgcccgcggttatgggcgggtctaacaatgtctttcgtgattagtctcacacttctcaccataataaaagatgctataactggtaataatttgtttagctcctggtttggaatggtatattcctggtttggagatagatctgtacagccgggtatggttgttcaggatggttgggcctgagcagcatgggtgtgctgtttagtgttgattaaaattgatgattaattactctactgttttataattctcaaatatttgctaaatgctgcttttgcaaatgagccctatattatgccattctttggtatccttgtgcacttccatatttgttgcgtggcttgctgagtatgttatatactcaccttgcaatcattcatcagaggaagagttctacagtgatgctgatggtgtggaggattaggtgtagccctggtcaagctgcctgtggagtggagtcgtctgtgccgtttatcttatttttccgctgcttagatctttattgattgagacgaactatctacctctgtaatgacattttattcgcttattaattagagtaataattgtactctattatcaatttgttattgtgtccctcggctgattcctggacgagggttcacacacatgtaagcgtttggaattttggatagaaattccgggcgtgacaggttccttctgcagtatgtcctacacaagaaaattgagtactagaaagggtaagcaagaaagcatgattataacttgtgatattgaaaacaaggattatagcttgtgatagaactaaccatcgtaaagttctcccaaggcctcaaatagagggaaagatttggtgcgaaacttcttggctttaggaaatgacaacacaataaaaggaaaacactaaaaagatgcataatgtaattaactacaaaattaagtaatggtcagaaataatcttacgatgattatattgttctatatagcaggctcagcctcaatgatgcatctctggttattccatgaagctccactttgttttctagcctctttcagcatcctatattctctttttagctctttctccttttcttggatttgggactttgttaagcagacatatctgtccttctcatggaattccttcacgattttgttccaagcttctgaagtccatccattctgacccctatactcaggagtgttgtgctcatgcaataactcaacaagaatcttctctagggctgtgttccaagaggctcttcttttttctacgcaagataagaattgatgtataatctacatttaataatttcaaacatgaatttcacatgttctataattgcatacctatcggagaacctccatgcttttttgtaggatgacctttcggagagttcttcttttgtgcagctttcgctaaaagcatggtcaaccttggagaacctcttagaagcatattaactgagaaaggatgcataacacaatattcataacaaaagcattgtagcaaatgtatgtc

SEQ ID NO: 51728 - DNA, 1501 bp, Oryza sativa
atactacgagtagagagtaccgagcatcgctctttattttttgggaatgctatgaatctggaatcgcatattaggtttcatttatacatctatagtcaaattcatgtacacacaaaaaaagccgaccctaaaaaatatgattgaattcccagttagatttgtatttatctatctgtatagattttattttagtggaaaggtcgcaaggacccggcctatattgaaagccaaccacgagcagagtttttgctgcggttaccagctttacaaaatggagcacagaaagcactcggagatgattaagtaccaacagacaaggggtatattaagggggtgtttaggtgagagaaggactaaactttagtccggacttattttttttgtgagagggaccctctcacccaaacaccccctaaacctctaaagactagacggcagcaatctaaaacagaccgaacgccaaagcattgcacggggctagcaagatcaaccaactcctattctattttgtcttagagcagctcctccctccttaaacctctttaccagcttctctagatcactcttattcatctccagccgatgcagaggactacactgcaataagaaaagacaatttggaaaggtagtattaggggtgagtaaacaagtttatccctgaacatgatgttgtttctcgttgtccatatatagagtccggcaaatggcagcaagcagggcatttttcacaactatatgtttaattcagctctaatgtcagcaaggataaagtcatcaaggttaagaggaacatgatcccagttcagcacatctctacagaaacaccaaacaaaatgcgccaaagggcagctaaagattatgtggtttgtagtttctagatggatagtggagaaaaaaaactaattttaaaatcagtaactagagggtgagcgtgcatacggtacggggtcgaccacgggccacggccggcggggagcacaacggctacagtttatacttattttagtgctagaggagacacagacagtaatacacgctacttccttcgtttcataatgtaagtcattctaatattttccatattcatattgatgctaatgaatctagatagttatatatgtctagatttattaacataaatatgaatgtggaaaatgctagaatgacctacattgtgaaacggagggagtagtatcaattatttgaagagttcagtgacattgtaccataaggacgaaacgaatactccactttagtggcatgtggtttgacttactcttgtttgtcgtcacgcgccagcccgagaacgggtccaatggaggatacctcaaatacagactcagactggcagtataggaagttgtgtcgttgctcctccagcaggagaagccgatcagtacacagtactgatatcacagtactgtatcagtatcaccttgcacacgatcgatcgacgctggctcgccggcggcgatggccgtcttttcgttgatcacttgtg

SEQ ID NO: 51729 - DNA, 1501 bp, Oryza sativa
tgtggttgttggttatatttctgtttggaaattacaagggttggggtgtcctgattttgaggattgtagagctatggaggtactctgtaattagtttaacatttctgaattgtaaactaattctatcgtcattgtttcacaaacaaactagcaacaaattgcagtagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgaactgattgggtgattaattctgtacccatgttataatgtatttgatgatgagatccttctatttgattgaaaaacagcagctcctactttgatgctagctagctctagttctgggttttatgtaactctagttctagttctgaatttgagttgtcagtgatgtgtataagttgtgcttgttttgtagattgcacttgcacccatgagagttggagaagaccaacctcctccttcctgggaccttgtaccctctccttcctgggaccttgtaccctctccaagaggtactagatctatttattccctttgctttaagttgtttatctatattttgtgatgtaaatataaaaaataaaagaagtggtgtaatgtagaccaaaatttcttttcctttcaacatacggttaaatttgtataaaaaagcatagagaatatacaagttctcagatttttcagatttctgaattctgaacatgctcggtgctaactaataaaagatcatctgtaactaaatttgacaactaaatttggtaagtgctactgccatgtaatctgctttttcatacatcctgtaagtgctactgccatcaattattgttgcactgtgcactctttaagaaaaaaagatccttattgttcttttcatttttcccatcaatttttaaatatgcttcataacttggatcttcttaagattaattcccatagtttagtgattcttgtgtgattatctttctagatcttttgttgctgtgctaagtgcaaaattgtaaataatttgtgtgctatctatagtactactatggatatgagagcaagagaccacgctagaaagaggagggaagaggaggacgatgatatgatgttgtttattttccctgcactacatttgttgagttctagtggagcaagggaaaagaagcgacgccatacatcaaagataacaggcgaggagcgtgttcgggagttgcttgaagggcatgtaaaaaattgccgggtagcattcaggatggagccggaaatatttatatctttggccaattaccttagaactgaaaagttggtcgatgatactaggattaaagttaaagagaagttggcgttcttcttatacatgcttagtcacaatgcttcatttgaggatttgcaagagaaatttgggcacagtggggatagc

SEQ ID NO: 51730 - DNA, 1501 bp, Oryza sativa
ggcataatatagggctcatttgcaaaagcagcatttagcaaatatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaggagctaaacaaattattaccagttatagcatcttttattatggtgagaagtgtgagactaatcacgaaagacattgttagacccgcccataaccgcgggcacggctattcgaatagttttactctggccagaggtgtaccactgtacccacaagacacagcaccacaacatgtcaccatgtgcctcaataccaccacggtacctcggaaaggagctgtgacagtaaccctcgtacaacacaatccaccacagcgcacctttcctggatcataatcacccccttataaacaaggcatggactccccagcgacccccgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgtcatgagcacggctctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaactaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaaggattgtttgggatctgtgtgacttgccttgctggccttggaactcttcaaaatcttctcctgcaaactcagactctccgaaaacgtcggaacctaaacagaaaagagcaaaatcaccaaaacagcacacaaaccagcatgaacagtacatgtagatatttttaacatgtagatctctattttagaaaaatttagagacttgaaccaactaaatccgagctaagatgaattagttatgtgttttcaaagattaaatcggattaaatcattcatttagattttaattgaattatgacgcaataatgaattatttttgaaaaagaaaagggaattattgcgtcagcggctagggttcgcggtggaccgggtgcacggcggcggctcacggaaatgaacggccgagatcgatcctatccaaaacggacggccaagatccatcggtccacgaccgggccacggggaacgacgacga

SEQ ID NO: 51731 - DNA, 461 bp, Oryza sativa
tattatgccatcctttggtatcctgggcacttgcatatttgctgcgtggcttgctgagtatgtcatatactcaccttcaatcattcatcaaaagaagagttctacaatgaggctgatgggggggaggattaggtgtagccctggtcaagctgcctgtggagtggaaccgtctgcgccgtttatttattttccgctgcttaaaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattgcgtgacactagatccgcccaccaaaaagaacgccgccgccacttctgctggatctgcccacgggagcaccgatgtcaccgccgctgccgcagg

SEQ ID NO: 51732 - DNA, 418 bp, Oryza sativa
agaggctggcgccgtccagttggacaatggcgctagccactctggcgccccaaaaaggaccatttctgggataagtttttttaggggtctatttgcgaaataagtttttcaaaaggaccaaaatgtgaaaaatccagcttcattattactatgttgtcaaggctgaattgttagctttttttgttagcttcctagttcctgaacttttaggtctcttttcatctttggttctatcagactgatagcattccatgtagtgcatcagccttagtttggatattagtgtggctctttgctttacttgtttgctcttatgtaatctgtactctgcatttgttcaatttgatatttggttgacaggaaagaacatatatggtgtatttctttttggaattgatccaatgttgctccatttttt

SEQ ID NO: 51733 - DNA, 337 bp, Oryza sativa
ggcgccgtccccctgccgacgtggcggggcgatgctgaggtggctagggggagcgcgccagagtggctggcgcccttccccccggaaattttttatttttttttatttgtttgatatttttttcacgcttagagacacacaagaaccaaccatagaaaaaatgaactcaaatggacgtaatatgtgacctgtagaatttttcctctcctctcctctctctccgaactagtgcagaggagagaaatgtgcaactttttttttttttttgatatttttttcacacttaggaactcacaagaactaaccatataaaaaataaactcaaacggacgaaata

SEQ ID NO: 51734 - DNA, 1501 bp, Oryza sativa
cctcaaacgcgttgcctatacatgtaagcgttagccagccaaggcatggagggcatacggtgctgtttttcttccagagtcctcccattcctgctgcaattcctaccttaatttacaagtgtgaattcatcgtgttttgtcatgtactcatgtgtgccttcagaatttgagatggtgagcgcttgaggggtgtagaagtggtgctaggatatatatataatgttataagtattgttaccagatgatgatgtgacatatttacatgtgatttaaaatactctagataataattgctagtgggtaatgatgtggcacatttgcatgttgagtttagtagtttgtggccatcaacttttatagtaagataagataaaattggtcatttaaaaaaaaagattggatttgttgttagaggaggaaacacacttacggtagtggtaagatgggctttaaaacaggcccatgaggttaattaaactttatagtgtatgaccacggtaatacgatctaattaatcaatggtcatatctttctaattaacatgagagcttatacaaaatacccaattaatattgttagatagatagacaaatcgatcaatcacactagccacttagtcgtgtgttgcacgattttgggtgcatatataaaagcctagtatatacaatagtgagattgtgcattaattttttttttacaaaatcaaagaacttgataaaaaatagttagaaaaataaaacatagaaaattatgtttcaactaaaggttcaaatatcatgtccgagatatactgtatgcgatcaagagatgagaacatgtttactcagcaatctgattcataagtctcagaatggtcaaatagaatgcaataaacatcatgtccttatcatttgaaaccaacacgaggtcatttgacctctgagtatcacaagatgataacataataaacattccgaaatgattcttccccctgaaatgcaaaaatatgcaagtgcacttgaagttactgttttggaacagaaaaaatgaatgattaattcttatgagatatgaaagattccatttaatgttcttattatctgaaaatgtatgtagttcaaataaattgtagtctcacatcaagtatgctcattgagttatcatgacaatagaatcacagttgcaagcctacaatcctttatgacatatcccttctttctataaagttaagtcccaaagctgaaaccacagcattccacgtcatcactaattctcagccattcgatcggtggatcagatcgcatatgaaccgttggatgagaaggtcccaggtgagatgttgagtcattggacagctcgcctcctcaacgtgcgcaccagcgcaacatcaggaaactgctggcggcatctcaaacgctcggcatgaatggcatgaatagctttaaacatcttcctccatcatggatactatttatctttttcactacacaatgttaacagtgttaacaatgttagaacaaat

SEQ ID NO: 51735 - DNA, 1501 bp, Oryza sativa
caaatatctcctccggctcggctcgatgtaatagataccggtttttaaaaaaagccgacacttatattattggtgtcggtttttctgtaaaacgacacccatcttcgtttaaaggtgtcagttttttctatcctttgaaggtgggaaaagaactattagtaccgacttgtatgtgcattttttatagtgtacacaacacaagccggaaaatatgttgactgccaaagacatggtatatcttgtctggcgacggcagcttcacggtcaccatatattcccgctgtatttgtataaactagtgaggggtgttgttagaatggtttgcgtaaaccatcatcaagcaccgctattaaaattaatgacatcgatgcatttcgttcaagtttatgcatcacacattaatgcttaatgcggtgcgaggggctaaagcctagcaagtgtcggatgtgaacacatggtggcatttgcatacttgaccacatctttgaataggcgtataaatatatgtgttcactttcttattagtgacactgcattttctaatcatatcagctttgatgttggatttatatttcatcattttcatgaacaccttttcttttcatgcttagctagagacttcctaggtcctttttgtttaggcttaattataggacaacttataaaccgaaaagtcaaagcctaaacgaacaagcggcattttcgttttgcttttttgaaaccatatataagccactctaacactattatataagccaaaaactaggttagagaatcttttttggcttatatgaggtagatgtatgactccacccattaaacttaggatattaaattcagcggcttataaatcatataagccaataagctaagtctaagacaataaatctaagcatagataaagaaggtatccataatcattgtgccccacggcaacgtgttggtaccacactagtttgttctccactgctcttatggcccaggatctgcttccacgaggaagaggtctattccacgattaaatattatgtttcttgtggtatggacatgatttcatcatttgaaactccagtttaacttccaatactgtatatctgtcgaaaagaatagaacttgttttatgaagactaaataagacattgcagccgagaaagctgaggtagcggatgccattgcagcacgccagcacccacacagggacattacgagatctacatatccccaaagatcaagcaaatggaagagcatctcgcactaaagaaatcaattctttgcgttgaagtcagtcggttgaggttctggtgtggcaagctttgacaatcggaaagttcgccgttttgtcaatcggacgcggcatgtaagaatgttcatggtctcgttttgccggtggtgaagacgttgactttggagagccaatcacccaatccatgcatccaatcaggtcgatcatatcagtggttgggaactgaacttgcttccaaagcaaacttaacacgtggat

SEQ ID NO: 51736 - DNA, 1501 bp, Oryza sativa
aagggcaccaatagtctatatgtcggtttttctttagaaccgacacctatcgttgttcaaaggattcggttctctattttttatcccacaatagataggaaaaggttaataggtgccagttgtaaataaactgacacctctgagccagtcgctatgagggttttttaagtagtgatggtttatttttacaggaacttgggaatgcgagtgaccgttgatggcccctcactgtttccgcgcactggatacatatgcatgttgagaataagaattttttttttgctaaaatgcagctaaaacaacaagcatgaagtaaatgaaaaagtgctcaacatcatacgatctacttaacatccttcccccactgcttgagatcccagttccatcgtcgccgtcgtcggcactcccacctcccgcaaagctcctccctcctcctacaggggtgcttccgcttccaccgccggggctaccaccagctcccgcggggctcccccgcactcctgcaggggtgcttccggctcttgcagagcttgtagatgctgctgagctccttgtaccactaccaccagggctcccaccggaggtgggagtcctcgccccactgctggagggagggccatcgctggtagccccagaggcgccttgaaaggaggcgaccacgtagagctgcgccagcatcgctgccccgaccaggctcatcctgctgcccctcatggtcgatcttcctcctgggctaggtgcttaatattgcttatgacacatcggtccctttcagtctgtttaaagtatccttgcacttttaggccaagtataagcctttatattcggtttgtagagtttggtctatatgggtgtgagggatgtagcctttggtgatttatttttaatagtccaataaattaatgggaagttttagtgttttgatggattgttaaacagtcatttggaccaatgtttaggtttagttaaattgctagaaactttaaggcatgttaattatttggaacaacagacatctggttattaggttaataggtgaaaggttatgataatacagaagccgatgctgtcaaatggtgatttggagtacttctagtctgtaggggatcaattcggcgccgtctatcgtttgtgtttgtgccgaactgcatggtagtagtaatgtattgacatggtgcatgcgtgtgttttggtagtactgtgtaaacatcattgtttggatccacacgtgacagggctgaccactagtatatatgcatgtctccggtagcaatggcgtatagcgagagggtggtctcataggttgtctcatgaataaaactgtgcacaaagttggagcaacgtgatggttcggccatggtaggtacaaaagaggcagaggattgctttgctgatgaggccgatccaatatatagtgatggcggcgtatttgtggtccaggagttgtcaataggtttaggagattcggtacagagatctatcaatctatctatctatctat

SEQ ID NO: 51737 - DNA, 1501 bp, Oryza sativa; identical to SEQ ID NO: 41445

SEQ ID NO: 51738 - DNA, 1501 bp, Oryza sativa
tcacaaataaaataaataataattttaaaaaaaattaaataagacgaggggtcaaatgttgtaagcaaaaacccttatattatgagacggagggagtagttgtacagccaagtagccgacagccacccactcggcatgagcgtctaggcgcgctgacaacttaatccacattaagaggagattaagagaaaatgaggtatagtgcaaaccgttctacgagtatggcctcgatcacaactaatgaagatgaaaatcaagttttaattattataaacttaacaaatactctctccgttttttaatagatgacgccgttaactttttctcatatgtttgatcattcgtcttattcaaaaattttatgcaaatgtataagatataaatcacacttaaagtagtattagtgataaaacaactcataacaaaataaattataattacgtaaattttttgaataagacgaacggtcaaacatgtgagaaaaagtcaacggtgtcatctattaaaaaatggaggtagtatatttttaaatatggcatcaggttttgaactgatagcaggctcatctattgactattacagtgggtgaaagctgttggttatgatgtgggactgcccagcatttgctcctcaagctttaaacaaggaagacttggttgcattctgaaagaaaaagaggtcaactgcagcaggtcacgcggcaggcagagattctacgacaaagcatcgctttactactggagtatacaggttttcaggagcacttgagttttttcttttgagaacggagcaaagttgtatgtgctgccatttctcggttacaggcaaggaaatgcatagaagttgcattgctctgtccttgtctctgctctgccccgcgcaattaactctgcaccctttttttttcctcgcttaattctcgactgtttgtgtaattacataagacaaaattgctagtagatccaagcttaatggcagcacgtgagatactattgtaccccaatcaaacctaacacatcttaacaaatcccatttgaaggaaggcacataataacagcgtgtttggagggttttgatcaagtggccaatgcagaagtagttggcagatggtgcctactggctagaattcggcgatctaacctgaaaacgaactgaaatgcgcatgtgaagggagtagtttgagcgagtgtgattgttcttgcaacaaagaaagcaaaggtaattaaggtcgatggaatttctcagattaaatggcgctttaaaatggagatgggtatggtaggcaatcaatttcccgggggaaaaagaagaagaaaagaaactgacatgtcgctaaaaaaactgctccgcctccgcgtcccccggccgcacgcgtcgcgctctgtgctgctataaacgacgagagcctcgccgcgcactcgacgcgcatcttccgaaatagagaaattgccacggatcgagggcgaccgataatggaaggcgagcagcagcagcagcagca

SEQ ID NO: 51739 - DNA, 1501 bp, Oryza sativa
aaggcacatttactatgcacattattgtttttgcactgatgaactaaacatagtagtagtactgcaacccatgagacaaacaaatggataaaaggtacctgaaatagtgtcagttgtgctgacagtgtggtagcctcagtttgaagagtttgaactttccgctctaactctgttatatatcgagccttcctttcctttgatcgggctgcagactgtctgtttgctagaattctgcaccaaagcaagctcagaaattttacatttactcatgagctgcagaaagctgatacaatgcacttgctaaaaatgatttagttaacattataaagttcaaatggttaattaaatcgaggagagctgtctttgaatataatgattattactacataagttgtagagctatgcacaaaagtttgctcttatagtaccagttgcatatatgaccgtacaccatgaacctgtgcgttaacagtcttgattgtagtacagcattttgattaaaagaccactacatggtgattctctaatggaaaaaaatatctctgttattttcaaatagaaaaacatatttaagaaagtggaccatgctaagttcactgcatatatggcccttaggtatgaaataaagaaggccttgagaaaagggggaaagagtatcagaagagtgcatgcttaagaaacacaaaagcaaagtgcttcccactactgccccgttcgccttgcgctcacagcttatttaaagactaaacaaagtgatgcagttttttgttctaagacaaaccacaaaatagaacagtgttgacattgcaaccatgttatcattgaataagtaaaattattatatgcagtttcatcacatacagaagcatattttgttataaaatactgttgaagagagaagagaatgtggggccaaatgaggaaaggttttactaagtgacatgaattaaaccctatataatgaatatacgcagttaaatactgtataacttccccgcaaaaaaaaatattgtataacttggttgcagcacaatagtttgataaaagaaacagttttgggtagagaatttatagctaataagtgttgcatagtaaatataaaattattgcacataacgaacatatgtcgttcgctccaaggccttcttattttggaacaaaacaacatggattggctttttggtccaagaaagcaacttgccaaacaagaaattggcatttcaaccacctctatgagtgcttacgttccaaaaagaagcccgcgtaagcgaggaaggcgagaccttcaggacatccaattcagttggtcaggttgctgcagtcctatcgtacaagctgcctttcactatccatagagattccagaccactagcaccatatattgggcctcaatagactatgaaatgatttgtttctgttaacatttatttttctaccacctttctttgcttgcaaaatctaatgctatatctagacaataaagtctcactaattcaagagt

SEQ ID NO: 51740 - DNA, 1501 bp, Oryza sativa
acgagcatatctaagtctctacatgatcagccacacgatgatcaacaaacaaacaatgtaactaaaattgaaagaattgaattgaaaaaaaaaaactagtgggagagagggaagcagttcaggaaggcatgtcagactatgaacaaagaaaactaaacggacggagcaatttgttgacatgtaggtctataattagaatgtgctgttgctttcacctgcagatattgaactaccctcagacttcaccactacctctgcctcatttttcacagccactggtcctttgccaatgtccagcccttggagccgcccaagcgagtcttgctgcatcatatcagagagggaatttgggtgggatagcatctggtggctagggacacttggatgaggttgttggaattgatgtggcagctgctgaacgcctgcatggtgctgaactgcgtgttggtcagatagctggaagaaggaagggctgtacgggacctgctgcattcctgtattatacgcatcatttgactttgccatctcacccgtagcaatcttaagcctctccacttcctgcttcagtgcatcgttgagagctgcgaaacaatatggtatttctattagcaggaaaaacaacacgtatcctaatctatgctgtgtttcagatgttcacaagttgttcaaaatgtcaatactaatagcttgagaaatctcaatattccttacatgacagagctttatcctctaaaatgatgaatcagttttcagtataagtttatgttcagcaatagagcatggcacttaccagcagtgcaaaattttagctagttccattgtgaagtaatgcagaaagatttctattgaagctaaacggtaactaagtgttggagctctcacaaatgattagatttaccaaagtaaacaatggaaaggattgagatcgcatgataaaacttgcattaaaaaacgacgataacacaatgtcttacatacaagaaatagcaaatgttgataagatatcttctaaaagtatgcagccagcctacagcaacgagctacctttcaacacaagtttattggaaataacgaaaatcaagagttgagatgtacgggcagagtgctcaccatcacgcagctgagcctgttgctccatggcttgcaatctaatcttgagctcagcattttctgcagaaagtccggttgtgtctctctgcccagaaaaacaaaacgtcttaaaaggatattcacagcttttaatacaaaaatatgggcatgatcacaaactttgaatactggtcaacagtgaacagagtaaaaaaaaaatacagtgttactagaacctaatagtcctggtcaatagagagcatacattttcattgttaggtaccaccattcagctcaacaaattattggccaaccatatagaatatatttggatgagaattcgacctttccacaacatgtgctatagccaatatgagcataaagctagtcacataatcctatcatgtgttat

SEQ ID NO: 51741 - DNA, 1501 bp, Oryza sativa; identical to SEQ ID NO: 50990

SEQ ID NO: 51742 - DNA, 1501 bp, Oryza sativa
ctctttcacgcgatttccatctaacacatcaagcctctttgaccccttccctatctctctctatatttttcgtcggcctgacatagggggcccaaggtcgtttgttgccatccccacaatctccggtgagcgaccaaagattgaaagatcttacaataagggagacagatccatttgtcagagtggaggaaggatgcaggaggtaggccatatcttattttttctttttggagctttttgtgaggatgttgcaagctattattttcccatgcatgttacgccttggtgtaattgaatgttttactatattttaattgtatgttgcgcactttaattcttaggtgttgcgactagcttatttaaatattgcatttggttgaacatttttctctaaccgctgaaacatttttaccgaatattgaaacatcttaaatatttttattgtaacatttcggtgaaacatctaaaacatttttgtacggacgtctgggccttgctcctctccggactttcaaggttagtgctgtagaactctggaactaacatgcggctgattaaatgagttgatgggcagcttaattacggcccgcctgtttagccaattgatactcagctcacatacggcctaattaagttagattaactagataaaagaacatccaacacaggggcccagctcccagctagtagtactcagtactcgtctcgatgctacgaaaccccaccttacagaagcgtaaaactgcgtaagcccatcaggactgggcccacatggcagataagcatggcccgagttcgtagtaaatcccccaagtcctgcacggggtgatcacatcaacagtgtgttcctcaaggagcgttgtcacgctacaacgtgatggtggcgcgccacggcggagaaatggcactcactgtttcctcgtgacgtgcgccaaaacaggctcgccacggcacgccccttgccgccggggaaatgaatgatccagggcggcagcagagtaccagaccctaagcttcagacgcggccccatctacagccactgtttcgcaatgcttagaaagatggcagcctgaaataattgaactcgttcggccgggccaacccggcagagaaaaaaagggattattgaactccaaaagtgatcaaatgcggtggagcagagctctcgtgagtctaatcccgcaacgagaacgcatatgaataatggttttgcggcgggtgcgttctgcaatgacaggccaacggtcaaagcatcccaactcccgcctcctcctcgtctaaaaccactcgcttccaaacaatccaaaccttccatgccatttggcatttttggctttgcttctcttctcttcctttgctttggctcttccccaaaatcacaagacccaagaaagaaagagagagagacaaaacaacagatcatctttgcagcactgtattggcactgtaccgctcgacatgaacggcgaggaggctccggccgggagcggcggcggcggc

SEQ ID NO: 51743 - DNA, 1501 bp, Oryza sativa
tcttttctttatttgattgtagaaagaaagaaacagctcaaacttgtgtggccggcacggctgtattaatgttctccgttgcatcagagtcatattttgtcgattcttcaagtcctcttctggtcgtcgtcctaaaagattagtagtagctcgtttggcatttgagatgcagacatgggttgggtgcagaactaggggaatgcttttctgtcttctgctgcttctttgatttcttcagaagtttcttgcacaccaatgtgtatagtagagaagccaaaaatgggaatacgatctcttgggttttgtgctgttactagctccttgttcttgccctttcagcaagcaaatatgagatctttgcagctataattaatcaagaactgttctctgtaaaaataaataggagtccacttttggaccagtcactgcattagaatgtaaacaattctttcgctttcacaagtttacataaggttcggcatgagtaagatcacatttttctcgagacataagaagtggtaggagtccatctttcaaaaagaattggtgatccgttatcatctattcttttcgatttggacctatcctctcctccctgccaaactctgaactgaccaaaaaggtttggatctttttgcattggtttgaggcaagaagaagaagaggttggagtgcgaattccaccattaacgcaatagtgatgatctaggggaggcttccctggtctgcattacattctgaaagcaaaagctcattgagtcggcacttcctgtgctgtgatgcgagaatgtgagttcacatgcttttgtccttggacccacatggcctgccttggctgttccattcggtcatatgcccaaaaagctctcgttaaatcccctacctgctgcactttgccatccatcgatttgattttatatgatgcaacttggtgttatcccaactttgtaagtttagtgtgattatctctttgaagcttaggtagaggagtgagcactagtagttgattaataggatttgtattgtaagtgtgatactgctccaccacacgtgtctatatcgcttccttccattccatcacctcgcattcattccaattagtgatcttgaggggctccatctgcaacttttcaccttggatatatttgcatccttgcttttcccagctctcctcgccctttccccttcttagagctgattctctcgattgattacctagtactactgcaattcacattgtcagctcttgcttgttcccaggtgcgtcctctatctgtgttcaatcttgttcttggcctgcagaatctatacaagttatgacagtgtgttgtatctaattcatcttttcttggagcaggaggatcagtttcttgctgagcaatggatcctgagttcgggagaggcatggcgcctcgaaaggtgagagagctttttccagcttaagccgtggtaggtgatatcaatccggcagctaagctcgaaccaatgcagaagtgactga

SEQ ID NO: 51744 - DNA, 1501 bp, Oryza sativa
attgtgccttattaaaaaaatccacacaatatataattcttgtgcaaatgtttacattccacttttagaaccctagtagagttattagcagtcctatacaatgtttagcctagtgatcacaatgccttactagcattccaatgttaagagtttgactacttcttgtgggatagatattttcggggctagattaaaagaaagaccccttaccaccatgttgctttcagtgttacacacctgcaggcgccttcgagtttttttctcgattctgcagcgagaagtttcctctactgcaaatacctcctaggaggtcctcccctaggactgagtttttttcccagtgtcatgcttaacaactatagcttctcgacaatgtgtgagactctgagattgacctaggggcctatggtctccactattgctaacattgaatctagataacaactaggagtataccctttctttggcattgctttcacccactctactttcacaacctttgttacaccaatatgatttagaaaattgtttcatgacttcactctttttccatcataatcacataggtagcaacacctatcattagtagcatggtccatattatcatggcatgaaatcatatgaataatccatgttaaataaaaaacatataattagaaatactttggactcagttagctttagttgctttaaaaattaaataattaatatatttagaattaaatataaatctatactaatcttggactctcaatttagtatacgctatttcattaatccaactctaaatttcaaaattaataattagctcgttataattgacatggactcttcttttagtttagaatgacataatccgagatataaccaacatttatagtgttaaaattttaatatctttaacatcattattactagcatgtgcaacatacatcgagtttcaactcgtaaaaactaacttgtttcaatgatagtttgccatttgtcatcgtcactctcgcaaggcggaaacccctagtaatgctagtacgaattaattaacaaacaccatgctttgttaggtgattcttaaccctagtaaggcacggctttgggcggaatggtgaaggaaagagaagatagagaagggaaggaggaggaagcctaaattgtattgattgcgcaccgacgcgccaatagggctaatgtggcgcgcatgcgtaatcttatccaaaccttttgacgtagtacaccagtagagctgatgtagcagggtatgtcataaccttacttaaactttttggatacaaccacatacatagtgtttccatgttgttggcatactagtagggctgatgtggcagattgagcatgcgacaaactcatccaaacttattggagccattgcatacacatggtggtgccatgttgttggcgcgcaatttgagctgatgttgcatgcatattgtaaccttacacatactttttagcgttgtcgcacatggaatagtaatccattttg

SEQ ID NO: 51745 - DNA, 483 bp, Oryza sativa
gatgggcttgcccaccacctctgcctctctcatatggaggccgggcgagcttgagcttggacaggctcgctggtcgccttcctcttcctcttcctgactctcccgccttcgcttcccttgcatagaggcgccgtgagctcgagcacggataggctcacccattgcctccctcaccgccacccctaaacagcttacgcggttgcagaaaaagataaaagaaagaagtgggacactgacatgtggccctatatgtttttctatttatttttgctggttaggatatcatgttagtgaaaaccagccattcgtaatgtcatgggacctatcttaaacagttttgccaagatgtgatgtgaagatttatagttttacgttttaaagagatgttaattaaactcaatgtaaagataagctacggcaagtggtgttattcctttcatctttctgaaactcctgggacataaatcgatggaccaaacaaaa

SEQ ID NO: 51746 - DNA, 1501 bp, Oryza sativa
tcgaggcgccatgcctctcccgaactcaggatccattgctcagcaagaaactgatcctcctgctccaagaaaagatgaattagatacaacacactgtcataacttgtatagattctgcaggccaagaacaagattgaacacagatagaggacgcacctgggaacaagcaagagctgacaatgtgaattgcagtagtactaggtaatcaatcgagagaatcagctctaagaaggggaaagggcgaggagagctgggaaaagcaaggatgcaaatatatccaaggtgaaaagttgcagatggagcccctcaagatcactaattggaatgaatgcgaggtgatggaatggaaggaagcgatatagacacgtgtggtggagcagtatcacacttacaatacaaatcctattaatcaactactagtgctcactcctctacctaagcttcaaagagataatcacactaaacttacaaagttgggataacaccaagttgcatcatataaaatcaaatcgatggatggcaaagtgcagcaggtaggggatttaacgagagctttttgggcatatgaccgaatggaacagccaaggcaggccatgtgggtccaaggacaaaagcatgtgaactcacattctcgcatcacagcacaggaagtgccgactcaatgagcttttgctttcagaatgtaatgcagaccagggaagcctcccctagatcatcactattgcgttaatggtggaattcgcactccaacctcttcttcttcttgcctcaaaccaatgcaaaaagatccaaacctttttggtcagttcagagtttggcagggaggagaggataggtccaaatcgaaaagaatagatgataacggatcaccaattctttttgaaagatggactcctaccacttcttatgtctcgagaaaaatgtgatcttactcatgccgaaccttatgtaaacttgtgaaagcgaaagaattgtttacattctaatgcagtgactggtccaaaagtggactcctatttatttttacagagaacagttcttgattaattatagctgcaaagatctcatatttgcttgctgaaagggcaagaacaaggagctagtaacagcacaaaacccaagagatcgtattcccatttttggcttctctactatacacattggtgtgcaagaaacttctgaagaaatcaaagaagcagcagaagacagaaaagcattcccctagttctgcacccaacccatgtctgcatctcaaatgccaaacgagctactactaatcttttaggacgacgaccagaagaggacttgaagaatcgacaaaatatgactctgatgcaacggagaacattaatacagccgtgccggccacacaagtttgagctgtttctttctttctacaatcaaataaagaaaagatggaaagaatcaagcaagtaccaagaacacatggccatctcctcgagcatcccgcgatgtgccatcgatgatccgttccacgcca

SEQ ID NO: 51747 - DNA, 1501 bp, Oryza sativa
caattgtgcattcgcaatgtgcgtttgttggttgctggttttgagatcgatttggttgttgatttgattgaatcggttgagttttatgatgaggcgaatgcatagtggatttgcgggtggaggtggagttcacgtagaggcagagcaggcgagcgacagagtgggaggacacgatgaaatgagttcatagctagcacagacggccaaagcaaagcaaattaaaatgcaaaattagacagatcgagtacgtgcatatgcagtatataccaatttaaaacatttaaccagcaggagccatgctgtatatgtgacaaatctaaatgcaaaattttgcgttgaatgttatttgtcgttaggggagtttaaaacgacctgatgatcgatcaataattgatcaacttacatatctatgttagctagcaagctgaacggattgaacggattgtaagaggcttccatgtagcgtgaaagctgtctcgtttatatttgcctattttttttctctagctagctaactacagcttgagaatttgtatatctgtactttgttcgaagcatcatagtttttgcagactatttaaaaaactattagctcgttattaccatcctaaacgtcctctcttctgtgtactctaaaagttaaaaaaaatgccaaagtgaaccccacatttaaatgtgtggcagacagttttcggcatttgaaatgttccgtcataggaaatgttcaccgtaggcccaatggcccataagtgcggctcgtcattcggaactgatgaattggactggtctgaataaagcagacctggtccagggctaagtaggccttggagatgtcttatgcaggaaaaagtctactgtggctccctcaaattaggtaggatttgactggtatacctccataaaaaaaaaccgagtgtatcgctcatctcaactattaaaatcaatataaaataattggggcctagctatccatcgcgccacagatttttgggtccaaatcacacagattttagatagttggattaggctcatttgatcacttgattagaagagtttatatatgtatcaacatatattaattatatatattgcatatattttatttattagatctttacttcgcaaaaaaaatatcaccaactcatctactaaaagttactgtgtaattacactatagttacagtgtaactacactatagttacactgtaactatagtatacttacagtgtaactatactgtaactatagtgtagttacagtgtaaatatagtgtaattacagtgcacttacatatcatatcaactgaacttacaaatgtaattttagttatataggactgtaattttatattttagtttcaaatgtgaatacagtataattatatgtaattacattgtaatttgcacgtaactgtacgcttctcgtgctcagtggaggtcacgggatttctctcatccgtatctaagtagagttaacatttaatcgcttttgttgtatagt

SEQ ID NO: 51748 - DNA, 1501 bp, Oryza sativa
tcaacctcagtatagctgattgtttatgtggatttttcggggatcaccccgtgccaaggtataaaaaacagacggaaatcactcggttttcgtatagaaattgaggtttcgggccagctcaagatcacaaactgttcagtaaaccgatcaagttccaaaataaattagagttttttaagtcggtagtcgatgggtttcaaacgattttcgtaaaacccataaaaatcctcctagctagggcatttttttacgacagtttggttttgtgaacctttcccgtactaatttagagtaccaatttataattgtacagccgtacaggtgacatatccgttcaggggtgggggcaggcctagggcaaggcatacatccaaaaacttgcttaaattttattgattcactatgtaattttttttcagaaaactaatactccattagtcgagctttatcttagctctagtcttatgtaatttttggcttcgcccctgtacccgttggatagcgagacattcacgatgtcttcattaattttaagatatgacggtatattttttttggaggtgtttataaagatagagtgtatgtgtatacgtctatagagttaagcatacacgtgttgtgagcgctttgtgtttgtattatattttttttaaaagaaagggtggtatactgtttttgagagttcaaatacgttctgaaaaaccgaatgatagtacatttgtagttggatttttctcctgcgtacatgcatgttgtcttctgtaagatggaagcaagctacaaatcaaatgcaactgtagagtccatttgggctgcacctgcactacgtggtctctaatacaaccgtaagccaattgcattaattaagttgcccccacatgaggatcaaagcaaatcacttttgatttcaatacagtgattcgtggtagaccaaattttgaccttttgaaatgttcatgtccccttccaaaccctccatggaccatatcatagctctacctagcagctgcctctggaaatgacttggttcacactccataagcaccagcatgcagttgggctctcctgctgcagctcatgtgccaaatcgtcctggactcgaggtttagctgcagcgatggccattagagacaatgagaaacgcctgttacggcaggcttgtctcacaatgccactagcgaaaagctgaatcaccatcttggtctgcaactctgcatcctttcccttgccgtcagagagtcccccacagcttttacgcacacttcctccatttcaaacattttgactttgtgccatgcgtgttgcatgcaatctactaataaggatgaatctctgtcaaagtaaaattggtgtttcatcggtggacaaagcgtcgacaaacacttgaatttctacatttcttattttgctctggagagcagtctgaactctgaactctctgtatcatgcaccaacatatctttttcgttccaacaatttacaagcgtattgattatgattc

SEQ ID NO: 51749 - DNA, 1501 bp, Oryza sativa
tggatgcgagaactgcagttgggaagagaccaacagcaacgaacaaaggtttcgccatctgatttttcagagccccgtcagattcctcgcagtcctgcgcagccactcgtgatgatcgtgaagacgtgaaaccaacataggcatgggcgaactggggatgaacaaaggtcaagtactctgcaactctttcgtcagaaattcagaatacacaagcgtttgagatgttccattgaggtgctgttcacctttaagaaatgtattattaaaatttccattgaatgagttagaccggtgaactatgcagaacaaaacactgatataattatatatgtcccttttaaatatttattttaaaaatctgagtagatttttgtatcaggagaggcaagtaggtaagtggtaacgaggtagagtgggctgtacagcgaatcgttcatgtcgtaaacaatatgggcctttgtttcgttctcatataataaggctgcgttcgtttgtatgatataggatgagaaaacacctcgttttccgcgcgcacacttcccaaactactaaacggtgtgttttttgcaaaaaaattctataggaaagttgctttaaaaagtcatattaatctatttttgaaatttaaaatagttaatactcaattaatcatgcgcaaatggctcacctcgttttgcgtatctttctaatctccccaatctactcctcaaacacaccctaagtccactttgagagcgtttggcagggccagctgcagctacggttgcacatagttagtgtcagagcgtggcattaaagcaactgccgaatatgccctttgactctcttaaaatatagatccaatttaattcgtatccttcaatcgtaatactagatatttaaatccccccactatcaaaattaaagagagttattttgcaccgatttaatagttagggagttaagatatttggtattacggttgagggatacgaatcatattataccaataatgagggagtcaagtggacttatttattttctcacaaagtctccatgagtttgcaaggcccataacttaacccaacggtggcccatactcattttaccccaaaaccatgtttgctctcacttcgcttagggggtgtttggatccaatggtaaatttttttggcgtgttacatcggatatacgtatacgtatttaaagtattaaacacaatctaataacaaaacaaattacaaaatccgcctacaaaccgcgagacaaatttattaagcctaattaatcagtcattaacaaatgtttactgtagcatcacattatcaaatcatggagcaattaggcttaaaagattaatctcgtaatttacacgcaatctgtgaaattagttattttttagactatattaatacttcatgcaagtgttcaaacgttcgatgtgatagggtgaaaaattttgaggtgggatctaaacagggtgttaagtgcaatgcaaacctcaaggtcttttatctactaa

SEQ ID NO: 51750 - DNA, 1501 bp, Oryza sativa
gtgtgccgcgccgggtggagcagagcagagtaacgtgtggctcggcgcgggctcccacctgaaccgacggcgacgtttcatgggagatttggccgccggacatgcagcgcgcgcggtggccgcctgggttggcgacggtattcaaggctggactgcaacagtgcctctcctagtagtagttctagtactagtattggggattggtcgggtcgtggtagtggcattccttgtgcattcaattcggctcgtgctcgtgcagcgatcgatcgatttttttgctgctgctgcccccgttcgacatgcatgcagacgacgcagcggcagcgaatcatttcctctgttttcatcccagagaatatactagcagtactacaaattccagtgaaaaattcaactctgttcagcatgtgtatcctctcgcaaattttctgcattgaaactgtatagcggtgacttgaaccaggacgcagagacagagaggatcccgttgtttatacagtaacgcaggtgtcgctgtaacaactgggatggtggattggcatttgcggacacagactgagttcacccccatccagagaccagagagggcagatcgacagccaagtactgcacctgcactgcagacacctgacctgcgtgcaaagtcgtggagacgcgcaacgcgaacacaacaccacacccctgccaccgcagcataggacccggcccaagagagaaaaattaattaaaccagcagagcatgtcgtgcgtgcgtgcaactgtgcaatccttaaatatctccttttttttatgaaacaaaaaagagagagaaaagcttcctcactttgctcccaatctttaccttatagcaggtataatagagcagttatatatacatatcgagtagataaaaggagagagacgaacagcggtgctacataaacttcaaaacgtaatgtgtgtataacaatgtgactaaatattaatagtatagtagtatatatttagtgataaattatctattaaattaagatgatttagaacttttagttagctatactattaaacttgctgctatggagtgtaatatttatgtggaaaatcatgaaaatttcagtcacatcgtcccctcctccgtagtttgtactactacagtagtacagcacagggtgaaccgaataccttactgaagtatttactgcgccttggctgctgcagcatcagcagcaggagtaattcttcagtctcctcttcttgctccccccatctggttggttttccttttcttccccgcatccgcacccgagtcgccagcgatcgatcgttttggtttggtgccatctccacatccaccggaaaactacgcttcccctacccaccgcatcatcctcttgcctcgatctttactgctctctactaggctcgagctgtgtgggtggggtgatgcggtgagcttttctttttcttcttctattgatcggagtggccatggcggggatggctgcggcggcggcggcgttgg

SEQ ID NO: 51751 - DNA, 1501 bp, Oryza sativa
catcccgttcgtcgtcgaggccgaagctcccgctgcagactacgcgaacctcatcagcttcggatccagcggcggcgcgagcacaagcagagtcgaccctcttcgtcagagccgccatcgtttgatggcagaagccgttgatccgacgccgtcctgcagcttcgccaactgccactctccggtactgtcctcggagtgcgccagcgaggcggcggcgctcagcagcagcctgccgctctccgccgtggtgggatcggcggtgacaacgccgtcgacgtcgatcgtgggttcagcgcctgcggattacgactggccgtcagggctcgccggaggtgacatggccggcagcttcccgtcctctcccagcagcctcgggttcatgactggctcctttgggaatcttcctggggatgacgacgacatgtttggcttcgatccttaacaagggctgtgcatgcatacattcttgccatgctaattattgctactactaatattcaagaaaaacaagtccgctatttgcatgcagaagtgtatgcatgcatgcataatactattgctgtgaggctatagcaaattagcaatacttgtagtacatgtgtgtactgctattggaggaaatccaatatatatacggtacgtagtaaatatgtgtattagttgatcgctgtactagtgagttgtgtgtatgtgattttgtaagtattgaaacataatttgaaattaatatatagtagtgaaagtaatatatactccgtgttaccttttgcgctacctatatataggtcatttaatgctccaaaaataactagatgaaagatctaatctaatttaatttagtttgtccaattggatttggaacataacaatcaatatataaaatgcaagaaagaatctagctagctagcggggaaattttacgcataaaccaactttaaattgaagtgtgtgtgctcaacgtacgctccctctgtacttataaaagaagtcgtttagaacaatgtttaagtcaaaccttgggaatataaatcataaataactctcaatttgttgagtttgaaaatgtaaaaattatatgaatagatttgtcttgaaaaatactttcataaaagtatacgtatatcaccttttcaataaatacttttatagaaacaagaagtcaaagttatgttttagagaccatatcgctgtccaaaacgactttctttacaagtatggagggagtatttgacaacaaatttatgtctagataaaaactccaataaactcatgctgttactttttttttgttcagagtggtcattttatagggagcaagatgtcccttgcatgcatatgttcctcaccccccaaaatataatgttattcaaacagattataaaagttgtggaaaagaatttacagctaaatttatcttttttttatttcgtgggtttgaattttcttagtgataaattaatgtgcatatgtgacaccatagatgtatggtgaaaagtttcat

SEQ ID NO: 51752 - DNA, 1501 bp, Oryza sativa
tatatcgatataaggattatatattgttaatatctacagccgatcgagtagatttagttcttctttacgtattcatgactgccgatcgatacatggatgacatcggcccaaagataaatgatatgtcatcggcatctagccgatcggctatcatttatagatttaactacggtttctttgcttctatttcttgttgattacaggatcaaatcaactggcacgctaatacatccaaagacgagctttggacctgcactggagttaagcagatctcccaggccacgtgttttctgtcaacacctatgtgacatgccaaaacttttcacccttggatctaaacacaaccttattgcttatccttttcttaacctgtacgtcatcacgactcctctataacttctccttctttactctatgtctttctcctattttcaaggtattgggtaaacactgaagtcagatgactctcaaatactctgtttgagaagaaggtgattttcttctttcttttgttatttgttgtagactcagtttttttcggggatagactcatagtataccatcaccgctaaaacaaggtaatatacgaggaccatgttttgtaatagaaaagagggtgttaagttgattttaggttgtgcatctaagattttttttgttgaaaatggattgaaaaccttctcaatgaaaagatgagatataacattaagggagaagggagatggaggtaggaagtagatgatatgcgagaaaatcattttttttattttgtaaagaaagtatatgacgtctatttatgcatatactgctgttttaaaccggtatcacatccggggtttacaaaatcaagtgttgtgaagtgatagattttattagaatcaaatgtatattatagacaaggcaatgttattttccttgctaatagtgcacaacttttatccatttgatttttcatctctctcccgctgccgttgcagtgctagaaccctagaacccgctcgcactccgaaaccttgctgattgcttcttgatttaattagcgaagggcattcttggtatttagaggattattattcaccaatttaaggccaccttctttcctttaacacttttagcactaataattttgcattttcacaacataacaccatcgagactaaaaaaccttgacactttcaaaaatttaccgggactacccttcgtccccattcccccttcctcttcagttcgtcctaaaacccctcgcgagaagataacagcggcgagctcctccaatcctccgccaccatccaatctctcgagcgacgcctcatccacccatcatctcatccctcgaattccattcctgctcgacctcgcgagctccaatccacgaatcattgctaggttttggagatttttttttgttttgatttggtgagggcgtgaggctccccccaattctacttccggagagctaaaacccggatcggatgctcgattaatctgctgggatcgcgca

SEQ ID NO: 51753 - DNA, 1501 bp, Oryza sativa
gtttcactttcacctctatcctgataggcgtattcgctaggaaagcatataggagtaggaaaactcagtgaacgtacactcgtgtacttaattttaagaaatattccctccatattttaatgtatgacgccgtttactttttttcaacgtttgaccattcgtcttattcaaaaaatttatataattatcatttattttattgtgatttgattcgtcatcaaatgttctttaagcatgacataaatattttcatattcacacaaaatttttaaataaaacgaatgatcaaacgttggtcgaaaagtcaacggcgttatacattaaaatacggaaggagtatattactagtatgtactaatatattattgtaaaaacatactccctccgccacataatataagggattttgggtggatgtgacatatcctagcactacgaatcttaacaggtttcttaatcagattcgtagtactaagaagtatcacatccacccagaatcccttatattttgggacggaggaagtataagtttaaattcggcatttacaagttataaaaaagatgaatatacatatactattaaagtctaatttatatgtttgttataatttatataaatgttgcacattaatctatcttctttttcttttagaaaagatactagtaaacaagtaattaaaactatttttcctcgtgccatgccgcgcgcgaaccggttggtaaggagaagtaggtcgatagctgcaggttggtgaagctcgcacagtcgcaccgtgcagtcgcagaggcggccggcaccggcgccgcccgcggccacacgtacgttgcgtactagtacgaggccgtacgagaacgagccgctctagctgccatgtgtacaccgacggtgcctacctgcagccaagaaacgcctttttcgtttcatgatcatgatagccgaacgctgtggctatcggctcattcatttggccgaaccgtccatcggtccatgccttcctgagcctcctatgtgatatttgtcgcaccggcatgcggcaacaacatcacgaccaaaactatcaacggcacttcgttttctatgctcactgcgcacacacgtagatagtcctatagtacacaggtacgatgccaagagatagatagagctagctagctctgcacgaggtcaaagaccatcatacacatatcgttgcctttttattttcctcgtgtaagtgatcgctgcccattgaaagtgggttggtctctctagctcgcttgctccacgtatggatgtgaaacggcatgcttgcgcttttcttctttgtttaagcaaggaacatgcttcatgcggttattgctgttctgtttggccgcggcgttttttttttctaatgattgcgtgtgtctgcaaaacttgctttgtctgtgctatgcacacgattccggactccagttggtacacactagtacaatttgttgcaaataaatagttctcgtactaaccaattttattttcttg

SEQ ID NO: 51754 - DNA, 1501 bp, Oryza sativa
gagaggatgtctgagaagaaaccatcatccaaaggcctactacgtagctaaggttgctggttttgcaggccaagcttccacactaatagaaactgaagacttgtgctaaagtagtctaaagaaggttccctccacaacttccaatgatggaaggagatgcagtgctgcaaacggtcttgagcaagtggaattttcggccaggaattcccaagtatcctgcaaagaggcagagcaagaaaatgctgctctttcctgctgaataggagatgctggatgccagtgcttttcctgaacttgaactcatgaagctgagtttgtctagactggaagcaaaatgaatatggtgttagtcttatctctataggaaagagagaacatactgaacaacaggttttataagggctagacagggattcttttttgtggaactagttaatttacaggggaaaaaaatcatttgcatgggaagtttagaaagttattctgaattcttttgggaacatttttcctttcagtttttactttgtttggaattatacatatgcagatatctgatgctaaatattgcatttagttctgaatggcacaataaagcaaaatcacaatcaatcacagtatctagtagaaatatgtttcaaagtaaaaaatgccagtcagctggccgttgcagtctatcagaatgcacatattagagtcatagaaaagcaatcaaagagcatctaactttacaacctaaacctttgggttccagttgacctttagattcataaagtctacctctaaatttctagagtaaaaagcttccgccctgcttcaaccaatgtcctacctctaataaagcagggactatgcattcagcctaaaaattagctcaagaatctactataatcgtagctacactatgatggtcatcgtagctacactatgatggtcaacgcctcctgttactgataattgtacacactaatccctagttaatctcataattcataaacaatagttcgctaccagcattttgctgaacgcctgaacaaaaaatcaaccgagaatggtgtcccgatcagggatcattttcatccaattgatattcccattaagcatgcaaagctcagtctaaaaggcacaagctcttctccctctcccaaccacatctccacatcgaaatcatctgttcaatgtaagaagcttgaggaatcggcggtaggggagctcccttccgacctgaatttaaccgattgctcaaaacaaaaatggaaaactggaaaacctggctcgacaaatcaaccctaggattcattcaggagaagcacatgagatgcgggaggaaagcacaacatttccactgacaaaaaaaaagggagaagaatcatcctaaaggaccaaatccacatcaagaaaccgaaacacgaagcaatatcgatcaactcaaatttcacacaaattaaagcaagctgagaaacggggcgacgaattcagagagagagagagagagagaggtaga

SEQ ID NO: 51755 - DNA, 237 bp, Oryza sativa
tttgggcactttagaagcatacaaggaatgattggtaacctttatttgctatcttctgatgaaatgcggttcttatttggagctacgattgaaatcttagtgcagttgttttaactgttatcactgaatgctcgctacttttatttcaacaggatcggctacttatttgacataaacaaacgaagatgctgctcgtctagttcctgatttggagattcatcaaatggatcatctcag

SEQ ID NO: 51756 - DNA, 1501 bp, Oryza sativa
atcaattgtaagaaaaatcaggttgcataactacaccaatttcacaatacatctattttttaccaagcagcaattttgacaactcatagagctttggcaaacaaattcccccctttttacaccaaagcgcaggaaacgtcatccgggacagcaatccagttacaagtcaccacaaatataattttaattgtgagaagctcatgtgcagcaagtaactgaacgatcatcgaaatcccagttgagcatgatgtccactcaattaactgctagctaatcgcacaacgagccatcaagtcaaccttccaaagtttcaccggattttccactttccaaaaattctacacgcgcaacactgttgcttctaccccggcacagtttcctcataaatcaactaatttgggcgccaatacgagatcaccacaaatggtaatggtaaaaatcacatcaaacaagtaataaacacaagttgtagccgttggaaaaacaaataaatttagggagaaaaagaggggaaatcatcgagacgatatacaggaaacaaccaaaaaaaaaagagcacagcagctaattcatgcagccagccatttcagccgcggcgcgtggaccaccatgggcgcgcacagcaagctagcgcggaggaggaggaaccgagagaggaagaggcggaggcgtacccgcacttgtcgcagagcacggcgaagccaccggatcgcagcggccagcccttcctccactcccctcccgccggggacggggccggggccccgcacgcggcgttcatgcacctcttcgccgccaccaacgccgccgccgccgcagccatccccgccatggccactccgatcaatagaagaagaaaaagaaaagctcaccgcatcaccccacccacacagctcgagcctagtagagagcagtaaagatcgaggcaagaggatgatgcggtgggtaggggaagcgtagttttccggtggatgtggagatggcaccaaaccaaaacgatcgatcgctggcgactcgggtgcggatgcggggaagaaaaggaaaaccaaccagatggggggagcaagaagaggagactgaagaattactcctgctgctgatgctgcagcagccaaggcgcagtaaatacttcagtaaggtattcggttcaccctgtgctgtactactgtagtagtacaaactacggaggaggggacgatgtgactgaaattttcatgattttccacataaatattacactccatagcagcaagtttaatagtatagctaactaaaagttctaaatcatcttaatttaatagataatttatcactaaatatatactactatactattaatatttagtcacattgttatacacacattacgttttgaagtttatgtagcaccgctgttcgtctctctccttttatctactcgatatgtatatataactgctctattatacctgctataaggtaaagattgggagcaaagtgaggaagcttttctctctctttt

SEQ ID NO: 51757 - DNA, 1501 bp, Oryza sativa
ataactcactttacatttacattgatatgttagaattctatggtcttcttggttacttggtttcagtgaacatctatcacgagctgcctatattgaatggactaggttgcaccaacagctattttgttcggtttgctccttttcagtggtgccaaagccttggttattgttatcatatgacccatagtgtgcaggcactagttcgtttttcctttcatgtttctttctgcaaatttgctttatgttctgcctttttcttccctctatgcaaagaacacatctgatgtgagaacgcattggcaggcaggatgtacatttccatgtaccgtcatccaatatatgcgtgtgaactgtgaagcttgaactcggtggtatttgagttagctgatattcaatttatggtgtttacttgtgatggatgcattttcattgaagttgcatttcttttttctttatttgcaggcttgttgcttctgaagggggtgcaatgtttaggatatatttccccctggtttacttgtgtaatgtaatgataaattgctacctgttctgatgtactgacgtttttgttactggttttgtgttcagggtattttgacccggtttgctgaggagttcccttagattaaagatcccaaggagatgatatctgtcctgaatgtttactttgttgccgttgcatgatcccctccgctctgaagagaaaatgatcaacatagtattactgctgtcccaataactgtattattagcaaaaaaatgttataagctactatcgagattgtgaacttgtcttattattagagtctgtattattaatgttattactatgcctggaacgtcacttatgtatgtctggaacgtggtattagtattactaccctgctctgagttgatggatcaatggatggatggttagatcgtatagtgtctgttttcttcccggactgttagttgttactttagaaaatgttttaaattgtattgcgtatgttgtggtttgtgatccatcagacaagctcctcatcagtcactagttacctaaagttgctttaaattctgtacctatctgagaacatgagttgtggatgtcgaacttatatttgatagtacagaacacgaattttgcttgaacattgcaacacttgtgaattttgcctggagaggtggtacaaaatgctcaggaatcattccatattcccatccaacccaacgcccatcagtagacgacgacgtcgacgcaaacgcccacagatacgaggcacaaaatcgtttctctccgcgtcgcgcacacgccacgcaagaggaccaggtcggtccggtgcgcgtgcacggtgcaccacacccacacccgtgtcggacgcgacggctcaaccgctttgacccacctgtcagtcagagccaccaaggcccgacccaggctacagagcccacctctcctcctccgtccggttcgcgccgcgctcccttcgttcgtgcgcttcctcggtcgccggcgatgg

SEQ ID NO: 51758 - DNA, 269 bp, Oryza sativa
cttatatattaacccacattgtgagatatcactttttggtatttcgcaacattcagcggtttttggaaacaaatccagccccattttaaaaaacgtttttttaccctttgttttttaaagccccctattataaggaggcaaccggttgtactccagaataacccttaaggccttattcttaccatgacttatgtagtcactagtgcagtccagtataggtatagccttcccaaatttttttttagaatcctcatattggtcgcactttc

SEQ ID NO: 51759 - DNA, 361 bp, Oryza sativa
acacatgagcctcgtcccaacacatgagacgcgtcacggcaaagcttttcgataacctcgcattggcagtacccgctccatgaacttaaatcctcatgcactctaggcgtccatgtttctagcagtgagtggagttctggcgctcccgggaaagagaagtctcacacgcatattaaattatggttcaagttaagttccctctctcacacactcatggcagtcctaccaatggcgacaccgatgtagggcacgcctctcggccctacctcaacagctgtcccaccgtagcgcacctgcctcactcaggggtgaaccatctatgcagggatactgcctctgctcggctatctaatccgctagt

SEQ ID NO: 51760 - DNA, 352 bp, Oryza sativa
tgcaataatctctgtaggtgaacattgaattcaaaaatatcaccaattttgttaacaaaacaaaacgcagaaccatcacataattttagtaaattcgaaaaatgagtccatataaatagtgtgtctagtactttgaagtccatagattaaattagcattgggtacagcaattaattctataagttaggccacttgtacttgttgatgcgaaaaacacacagtggcctggaagatctgcttaactttagtgcaggtccaaaaatctttcctttaggttcgtgagcgtgccagttgatttgatcctgcaatcaacaagaaataaatacaaagaaaccgcgattaaatccataaa

SEQ ID NO: 51761 - DNA, 508 bp, Oryza sativa
aagcaagaactcgtcgaaacaaaacgaaagtaaaagggtggcgatgcgccgagattgtattgaacgtgtgtttattcgattacatggggttcgggtctatttatacccgagaattacaaaatatgtccataccagacacgactcttatctgtaacaaactctaagataccataagtcttcgcggcagacttttgcccaaacttatctctaaggaaattacataaaatatcctaattaatagatacaattgacttctcaggactctatccatacgccgcaatcatcatgaagcacatcaacctaaaccgacaacgtttgctgcatcatattgtcggattcggctcaatcggctaacactgtccgactcgaactctgccggtcttagccgtagccgattcaaacttcagccgattcttactctgttttcgcgacgctcttcatctttgattccgctttgatctaatcttctttttcgatgctgacattaccaaatttggtcgttaacaca

SEQ ID NO: 51762 - DNA, 1501 bp, Oryza sativa
ctgatgtaaatcacatgcgagaaacacacaaccaaacttaaaacaagcaaactaacacaacgatctaagacaacggtttgacaaggcattctaggtcttccgggcatcggagttgattgaaggctcgttcggctcgtctccatcatcttgagtggctccccactcgatcttggaatgggtgcgcttggattcttctccttcatcatcacttacgttgacgaccggaggatccgctagggctggggtaacttctttctccaccacacggacctttggcgccaattggtagcgagggacaaatagagctctcttccttgcggtaagacgaatcctggccttctgcggtggtgcttctcccttcaatgcggctagttccttctccaaacgatccactttgtcctctagcttgcaaatcttaccacgattctggtcttcacgatcttgagccgctaacacagtcttcgcacgggtttcatccatagcccacagcatctcaaccaaatgccttgtggtagcatcattctcaattccctcagtctcaaggtagctgccatggtcacttccctgtggttggcgaggatggtagcgataaggtgtcggccaactgatcactgtagcgatcgcggagctctcctatggcgatccttgccacctcctgacatgcatggatgtagtttcctcctccagcttcgaacatcactgaggagatatcttcactattactgttcaaggtgactttgactcggcacttcttttcgtgacgatcgtgaggaatctgggcatacaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaagtaaaccaagcttgcaagataagttgaaacagttggaaacaaggtcacaaattttgtacttttgaacaacaggttccaaaagaaataaaagaaagttataaaatcaacatgctaaatttatttcattgcagcaagattaaataaaacaatattgtaaaacttttgctggtaaatgagccattagtacagtaatagatgtacagtactaataacactggaataaattttgaatgagaaccactaaaagagattatgaagtgcatgtgctattagtttggtttaattaaaagagaaggggaggagaacagttctacttttccaatatttttagagggcttctatgggtaaccatttggcataacctagggtcaaggggctctgataccaacttgtcacgcccggaatttctatccaaaattccaaatgcttacatgtgtgtgaaccctcgtacaggaatcagccgaggcacacaataacaaattgataatagagtacaattattactcta

SEQ ID NO: 51763 - DNA, 1501 bp, Oryza sativa
ggatgtacatttccatgtaccgtcatccaatatatgcgtgtgaagcttgaactaggtggtatttgagttggctgatattcatatggtgtttacttgtgatggaagcattttcattgaagttgcatttcttttttctgtatttgcaggcttgttgcttctgaagggggtgcaatgtttaggatatatttccccctggtttacttgtgtaatgtaatgataaattgctacctgttctgatgtactgacgtttttgttactggttttgtgttcagggtattttgacccggtttgctgaggagttcccttagattaaagatcccaaggagatgatatctgtcctgcatgtcacactttgttgccgttgcatgatcccctccgctctgaagagaaaatgatcaaacatagtattactgctgtcccaaattcccaataactgtattattagcaaaaaactgttataagctacggtcgagattgtgatcttgtcttattattagcgtctgtattagtaatgttattactatgcctggaacgtcacttatgtatgtttggaacgtggtattagtattactaccctgctctgagtctcagatggatcaatggatggatggttttatcttggtgtctgttttcttcccggattgttagttgttactctagaaaatattttaaattgtattgtacctgtatctaccccatccaacctgagaatatgttgtggtttgtggtccatcagacaagctcctcatcagtcactagttacctatctgagaacaagaattgtggatgtcgaacttatatttgatactacctctgtcccattttaagtttttaggtgcaaccataatttttcgtgtctaattttgatcgtccgtcttatttgaattttttttaaaaaaaaagttcaaaaatataagccatgcataaagtactacttatgttttatcatctaataatgataaaaatactaatcataaaaaaaatcaaataagatggatgatcaaagatagatatggaaactcatgactgaacttataatgggacgaatggagtagcatagaacatgaattttgcttgaacattgcggcacttgtgaattttgcctggagcggtggtacaaaatactcaggaatcattccatattcccatccaactcaacgcccagacgacgacgtcgacgcaaacgcccacatatacgagagcgagtcacaaaaccaaaaagaagaagaagaagaaaaaaaaaaacagcagtagcagcggcggccactgtttctctccgcgtcgcgcacacgcttgacgccacgcaagaggaccaggtcaggtccggtgcgcgtgcgtgcacggtgcaccacacccacacccgtgtcggacgcggcggctcaaccgctttgacccaccacccgcgtctggtttatgcgggccccacctgtcagtcagaaccaccaaggcccgtccggttcgcgccgcgctcccttcgttcgtgcgcttcctcggtcgccgg

SEQ ID NO: 51764 - DNA, 435 bp, Oryza sativa
caacgccattcgcaaccggacgccgccgcctcgactcgacgtccttcttcggatcttgctcgcccgccgcgccttcatcctccgcgaccagctcgtcgctgccctcgtcaggagctcgcctatgaagttctcgtggagctcgccgggccagacggggtgtggcctgagcttgcagcacatctcccatcagatatacttacacgcttgtggggacgctgacgacgccgaagcggtacgagcgtcgcaacatcgtgcatctcgatagcgtacgcgctgcagccggcgatgcccgcgcatgtggacgtccgcttcgtgttctgctccgtgacggatgtttgacgatattttgtcattttacgttaagcaaacaagattactatttataaaagaagctagctcgctggtttttatgagatgcatgggccatgcaaactc

SEQ ID NO: 51765 - DNA, 342 bp, Oryza sativa
gggtggagagattggacgatgcgagaatgggggaggaagagtaaaaattcgtgacacgttgtcacgttcatgtcaatctggcacgttacgaatagagtctcgggtccacgttacacgtttgatacatgggacccaccaaggaataataattaactaatttaccaaagtaactaagaatttaccacggggtccacatgtcatagacatgtaatgacccacatgtcatagatagccaaatcttcaaagtggcaaaaaaattaaatacccaaaacccccctccgttaaacccgaagaaaaaaaaccgcaccaccagcgtggcgccgatcggagccaccggataaa

SEQ ID NO: 51766 - DNA, 365 bp, Oryza sativa
tccccacctgaattgtcattgcataaaagaacccatataaatgacagtgggagcaacgttttagctgaaaatgcaatggaacattattttggccatcaaaatgagagcaatattttgactggctgtatgatagaagcacctctgaatttaccatttgtgaaatgggtcaactaagaaatgctgaaacccaattattcaagagtgatatttgtcccttggattcttggaaccaccaaaacctgaccattttacacactactgaaccaaaagaaaattcagtaagcctcaagtacaagtaaaatcgcattcctgcggaatgctgaatccgactgatgtcgtttccccaattgcatgatcctcacagg

SEQ ID NO: 51767 - DNA, 1501 bp, Oryza sativa
agtgtcgcgaaaacagagtaagaattggctgaagtctgaatcggctacagctaagaccggcagagttcgagtcggacagtgttagccgattgagccgaatccgacaatatgatgcagcaaacgttgtcggtttaggttgatgtgcttcatgatgattgccgcgtatggatagagtcctgagaagtcaattgtatctattaattaggatattttatgtaatttccttagagataagtttgggcaaaagtctgccgcgaagacttatggtatcttagagtttgttagagataagagtcgtgtctggtatggacatatcttgtaattctcgggtataaatagacccgaaccccatgtaatcgaataaacacacgttcaatacaatctcggcgcatcgccacccttttactttcgttttgtttcgacgagttcttgctttcgggttgagctgcatcggtttcgatcttcaacaagaggtaaaacttgttatggcggcttgtgttctcgggattagtgcttccatctttatgacactctaatcttgtttatgtaattcgtcgagttatcatataccatacataatctctggcgatatcgatatctaacctacaatcggctaacatctgtcgatagaaggcagccgattaggttaaatacctatgttgacttagattatataagatatccaccactctatgacacatccaacggcttgattgtttagatattgtccttcttttcatatttatagctgcatcagttgagtttgatcttatgagtcgtgattagaatctcaatctcttgcctgcttcttggttatcgattagggtagcatcggggtttcagccgatcttacctgatttaactatatttcccttatatgcttcattgatatgttgaatctgccatttatattaagatcttgtttcatttaagtatattaggcttttgtttagtatattctacttgctctaatatcttaatatagagtagtatcggagtattggccgatacatgctagatctatctgatcggctatgctatgaacatatatagtcttattattaatatatatttcgatctaagtgatttatactgtctcggcatggcgactgatctatcccaatcacttgatttaagtatatatcgatgtaaggactatatatcgttaatatctacagccgatcgaataagatttagttccttcttatttattaatgaccgtcgatcgatgcatatatgacatcggctcaaatataaatgatatgtcatcggcacctagccgatcggctatcgtttatggatttaaccgcggtttctttgtctttgtttcttgttgattacaggatcaaatcaactggcacgctagcatacccgaaggcgagttttgaacctgcactggagttaagcagatgtcccaggcctcgtgttttacatcaacacgcttttggcacgcctggtgggattcattaagaagttagaatcacaatagcagttttctcca

SEQ ID NO: 51768 - DNA, 712 bp, Oryza sativa
ggagcagagggggtcaccaaacccggaataaaagaggaagataaactattaaccaacttttccagaagctccttcctgaggaaaaattcttgaatccttccttgtgtttcatcagaaataaaatataaagggccttcttcagcaacagtgaacacaacctccaaagcaggatcaaccaaagggacaaaaggcactatctgcatattaccattagaatctgaattctgattctgattctgattctgctgactcactccagaatcccctatcacatgctgatcctgattctccccttgctgctcccaatctccccaaccaccagcatgattatcaagatgctcctcctgaaccggcccattgctatgattattttcaagatcaggatctagggcacccattggtggtaaatcttcatccggagcctgaatgccggcaaaatcattgttgaggacaaaaacagagaaagtccaagactccccctgaccaccctgattgggtatttgcttgatcactattgttctaggaaccatatcaacatcatcataaaaagctcgcagcataactcttcccgggactacatccatctactgccaataatcaagcctcccaaaaagactaataacacggctgacatagctttgggtacgaaaatccaaagggaacccaagaaacataatccaacccactctagcataagcgaagtggaggcctg

SEQ ID NO: 51769 - DNA, 482 bp, Oryza sativa
gcctaccctcctcctcgtcgtctcaccctctcgcgccgccgccgcctccacttccgccgccgtcgtgttgctgtctcctcgcccctccgtgtccgcctcttcctcgcgccgtcgcccgagcgcaaccgtctccgcctccgccactgccgtcgctgtcgccgagtgctgccacttccgctttcgcctcgctccgcccatacctagcaccgcgccgcagctgccgccgttgccgagcaccgccggagcgccgtcctccatttctgtcgctatcgccgagcgccaccgatgcatccttcgccgccatggctgacgactgctgcgccaagttctcctcgagcagctcgccgcagttgtcgatgaggaagtggcgtcgaatccggcaacatctgacctgctgctgcgcctgcgccactgtcaacaatcgatttcacctgccatgaaaaaacaaaagaaaggtcagttattccggttccctgccttat

SEQ ID NO: 51770 - DNA, 1226 bp, Oryza sativa
gcctaccctcctcctcgtcgtctcaccctctcgcgccgccgccgcctccacttccgccgccgtcgtgttgctgtctcctcgcccctccgtgtccgcctcttcctcgcgccgtcgcccgagcgcaaccgtctccgcctccgccactgccgtcgctgtcgccgagtgctgccacttccgctttcgcctcgctccgcccatacctagcaccgcgccgcagctgccgccgttgccgagcaccgccggagcgccgtcctccatttctgtcgctatcgccgagcgccaccgatgcatccttcgccgccatggctgacgactgctgcgccaagttctcctcgagcagctcgccgcagttgtcgatgaggaagtggcgtcgaatccggcaacatctgacctgctgctgcgcctgcgccactgtcaacaatcgatttcacctgccatgaaaaaacaaaagaaaggtcagttattccggttccctgccttattcgagaggaaaaggaagtattggtgtaggcgtttagctacaaatatggtcatgcagcggcgagagcagagctgaggcatcaggcgtggtgcgcgtcgcttgatggtgcttgccggcactgtcagcaaacctggcaagaggaccactcgatgatcttgtgaacatttacagacggcttttgcatcattaagggaacttgttgcatcatggatgactaggatatcagaagagtgcaagttgtggacttcttctgctctatccaaacaaggaagacttcagatatcctaatatgcatattaatggaatttttagaaataaaattttcagctcctttaactttctgcttcaaatgcatatttcccattccaatgctcctaatggattgtattttgtctcaagcagttgttttagtaaaaaaattgtatgtaatacatgagatagcctgggacagtaatagctcaagaaacaaaactctctttgagcacaaagagaaaagtcctttcaagccgtgagaaacttttgggtacctttttggcctcctatcatatgagctcctttttcttctcccctgtaaatttgtcaagttctacctcactgtaagagagaggagatagagagagatgtactaactgatgaactgatcaatacaagtcctaactgatgaactgtacaaattatatgtgttgcgggagcgagaagttgtgcacagctgagttgggatcagatcatctaatgcttactggag

SEQ ID NO: 51771 - DNA, 1501 bp, Oryza sativa
ccagtccaccaaatataagaaaaatctttaaacttactagtagcttgtcgaactctatgctgctcaggcacaaggtgggcactaaacttttgctctactgtcatctcccaatcaaagtatttctcagcatcataataacccaaaacagatggtattttaaacttaaccttagaataaggatcatcaggcacgcgattattgttaccttgttggtatcgttgattttgagcaccactcatacttgtcattgcaaacacaaaaacaacagcaaacagtgaaggttatccctaataatctgctacgcggtgtagtggtgcctctcaacaactcagccaaatggagcaccttaccaagctcttacaagtgtcttaccagcactgctaaggacggtacaaccggtggctggttcgtgacaccttgaaggacgtgatgtggcgattgcaaggatcaaagtggtgctgaccagaagtatatatgtgaagcttaggaggcacaatatatagtagcaaaggaacgcaattgtgctaatcagaaaatgcaaagttgaataataattcaaagtactagtcaatgtgctggcctagcttagactcaactctagctcaaggaagcacccgacaacactaaggactagatatgaatcaatgcacaactctacactctgaaaacatactcaaaggatgaatgatttttttttctttcttggtgcggctttttttaagcacatttctgccttttttttctttttctaaggtgcagttttttctttccttttctttgcacctttctgccttttctttcttttttttattttttactatttttttcaacaagaactgaccattgacctcaaacagggtctcaaatgtaaatatgaatattacaggtacttaaatgctaagtgcaaaactaaaattagatcacctcaaaaatggaatgctcatgtcatgtaggttccgtttttataaaaatatctcaaatcggcaaccactaaaatacccaacaatgtgatgtaatgccctagaaaaaaagtagaataccgtagaggatatattggaagtccctaaggttttggtgtttgaaattagaagaaaaacaatagttatacgctagctgggctagctttcggccagcccaaggcccaggtgccccctccacaccccctcaaaaccctagaagatcccctcacctccccctagccgtcatttggtaccctgggcgcccacctccccctaggggtgggcagaaaaagaccgaaccgaactaaccgagaccgagaccgaaaaattcggtcacaaattcggtcatcagttgtaactaaccgaattttatacagtcttttcggtcatctcgctcggttaaccgaaataaccgaactggccgaatcactgtaaaggcccaataccagcccaatagcccattagctagagaaaaccctaaccttccttcccacatcacacgatccttcccagtccccacaaccccacatgcgcgtgcagat

SEQ ID NO: 51772 - DNA, 1501 bp, Oryza sativa
agatcgaagcgatgcagccttgaacaacaccaatgtagccgacagattcaccagggccggcggaacgtaggacttaccctttcgccggagatcgaactgaaccgatgcagccccacgtcaggtgccaaattccgtcggttgataagtaaaaacctcaggaaagagggtggcgacgcgccgagagtagttttattgattgtgatattgattacaatgaccccgggtgtacatatttatacccatgggtagatactagtccttgtaggactagaaagaaactttcctaaaaataaaaggaaaacataaagtccttaccggacactaaacacactttcctaaaaataaaaggaaactaaaccctgcctaattaatagataaactgccatgttgtatccttcttgaacttggactcttctagataagcttcctttaattgatccgactccaccaagaacacaactgttggactcttctagataagcttcctttaattgatccgactccaccaagaacacaactgctggtgacttgacaactcacatcgaccgattccgagactctgaagccgatattgactctaggccgatgatgattttgggcttacctaattttggcgttaacaggtatatggcactttgattgtcacaaaataggttaatgcaagaatcaactccacaaatctcagcaaacaatcctttcagccaaactgattccttacatgcttcagcaatagccatgtatcctgcttcagtggtagactgggcaacaacaggctgcaatgttgccttccaacttacagcacaactaccaatagtaaacacataacctatgagtgaccttcgcttatctaaatcagcaataaaatctgaatccacatagccaataagtcccttagcagccctgccaaatttcaaacaagcatatgttgtgcctcaaaggtatcagaaaatccactgaacagccttccaatgttctttgacaggattagccatgtatctactgaccaaactcatagcatgagataaatccggatgagagcaaaccatggcatacatcaaagaaccaacagcacaggaatatggaacccttgacatgaattcaacctcctcatcagtactagcacattgtaaagctgataatttaaaatgaggtgcaatctaagtactaacagactttgcatcatgcatgttgaaatgatgaagaaccttcttaatgtaactttgctgactaagaaaaaacaaaccagaatttcggtctctagtaatttccataccggcgacaggcctccacttcgcttatgctagagtgggttggattatgtttcttgggttccctttggattttcgtacccaaagctatgtcagccgtgttattagtctttttgggaggcttgattattggcagtagatggatgtagtcccgggaagagttatgctgcgagctttttatgatgatgttgatatggttcctagaacaatagtgatcaagcaaatacccaatc

SEQ ID NO: 51773 - DNA, 1501 bp, Oryza sativa
ttcgtgatggtaaggcaggtaagtatttcaaatttatttatttagaaatgtagctgagatattagaaagtttgaacacaaaaaattacaaattagttcgaatgagcccaatataaaatcgttctattcctaagcctcatcatcgaaatttcgggacgtgccagtttcctttttctttccctttcttctagcaccagttggaggtctgcgccctgacaaagataatctttcaggtgaatatcgctcgcggacagacctacggacgacttcaacaccgcggagatcaacatcgtcgtagtcttgggctggctgagttattggtggtggttcatcatgttgcaatggtcctatgtcgtgttgtgctgttgacgagcccccaccgtagctacatggttctccgtatgactgtatgctgccggcatatcccatcatttgttcagggttgtacattcctacaaaacattgaatgcaaagttgtagcgtgcacacatactgaaaataaattattttctagtaaattataagttgtacctgttgtttgtggttgcatgataggtggttgattgaacaaccaatctccatggcctaacatttcgagaaagcttggtccttgtggttgtgtgttttcattcatggacatttgatacatccccctgcaggtggagagctaaattaatatcacaatataaagatagtgaaaaaatgaaacacattatttacgaaccaatgttgaatgttggagctccttggcactaatcattcatacccgttgaaaacatgggcatgttaacttgaggtacacctgcgaaaataagaaaatatgtgcgtggctcagtaaattacaaaatgatgaacattaaaatgtgtgtttattgaactaccggaaaacgatacttggaactgagagcttccagcttctgtatgcatggggggaaccatttggctggatcctgtgaaccacgcaaaccctccctgccattgaccagtggtatttgcatggggaatagaagggatcacagctgtactacctgcaataatctctgtaggtgaacattgaattcaaaaatatcaccaattttgttaacaaaacaaaacgcagaaccatcacataattttagtaaattcgaaaaatgagtccatataaatagtgtgtctagtactttgaagtccatagattaaattagcattgggtacagcaattaattctataagttaggccacttgtacttgttgatgcgaaaaacacacagtggcctggaagatctgcttaactttagtgcaggtccaaaaatctttcctttaggttcgtgagcgtgccagttgatttgatcctgcaatcaacaagaaataaatacaaagaaaccgcgattaaatccataaatgatagccgatcggccagtcgccgatgacatatcatttatctctgagccgatgtcatatttgaatcgatcggcagtcataaataaacaagaaagaactaaatctactcgatcggctgtaga

SEQ ID NO: 51774 - DNA, 1501 bp, Oryza sativa
cgctgggaacaccaagttcgtgggatatcttaattgaggattttcaggacttactgcagatgttagaaaatcccatccttgaggaggcttatctgatgagaaaccaccctgctttgcttgcactgaaactgcactcacagtttttcatggcatgctatgaaacattgatgagggcatcacttcaatctgtgttcgaagtgttcaagatgctaccctatgggatgaatgattcaagtggtcactggaaggtacgtctagagcaacacccgtacctttggtggatgctccacagtcagtttacatcctatggagacagaaactctgagcagtgcagataccgtcggaactactcatgccacaagattcatcatctcacaaaaaggactgaacgattcaaatggtattctgcaaatgatgttgacatgctgctttaccaatatctacccatgtcgcttcctggcttaatgagagcaatgtgggacgaaggactgcttgcccttttctgcttgcgtctagatgagcttttcaccaagtgaaccggtcatatctcctggtggcaagtgaaacacccatttctggtaatcgacgaatgtgacaaactcagtcttaactgtctggtaatagtttttctgctgctcacaattcatatgttttctctggagtacatttctctcaaacgcttcagatgatctcgttgagtgagggttgggctagtactgtagcttgctgttactagtacattacttctcatatccagtcctctgcagtgaggggtggggttattactttactgtcgcttgctgttactacataactactcgtgtaagtatatctagtactcctggattacggtttcgacagaatgtatagactacttttgtccccccggaggtgtgcttggaatttgtattccgtattgtataatgctcacaactatgaaacctcttgtatctagttagtagctagaaatttttcagataaatattcacacgataaacttgggagcacaatatttttgcccttgttatatatttccagttgtattataatacaaccgatccccccccccttctgcattgtacttgttttgggtaaatgctatgccggtgatctgtcaaaattatcaacagagtagtatagtgggtaaatctccaatctgtcattttattggaagcagtagcttgcacttcagtacaagcagtagggtttttcagcaagctccagtaaatctttatgtcctatcaagaggatcatcgattcgattcacaagggaatgtttgctacatggaatcaggaatgtttgcttcaaattagttttgtcatcttgagctgaaacaaagggttgatggaattttggccattaccaatctgcgcatgcttacagtctctgactgcctgtgctagtagaaatctgtcattgtttccactcatgactcatgtagcagtaattatttttttgccgggtcggtgaacaggaatcctactttactttattatggga

SEQ ID NO: 51775 - DNA, 1501 bp, Oryza sativa
aaaggaaaattttgtctggttctattattattatttctttgtttggaggtaatgtgatgttttcagatcactggaggctctaaattttgcttgtaatacagatgattaccactaatcactgtgaagccatcctattgttcttgttagtagttattgagaaatatataacatttgtcttgatccctggagaatacccaacttcttgaagagaaaaaccatatatataggagaatctaatcctaaactaatcttttgctctactacttttcaggccgtatatgcatatcttgggagtaatagatgttccatgtgtcaatgcatcaactaaaatacctgatgaacatgtatacgattcttaggaaattacatctgcaacaaccaacttcaatttttttttctcagcatctcagggcattattttcatcaagatttttggcctacgctaatgaccgatgttgtgaccttaggtcacgaacaagatcggggataggccggaaagaagtgttttcccgcctatccttagaaacgagctcgaacagcaaacacaacttttgaggattacttttgtattaaagatgtcttgtcctgctacaggtttttgactggcttttataaccggtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggaccccacggaatcttcccttggcatcttctcttgttcgaggagtgctcttcctcgaactcttgggaaaaatgcattttccgtcctggaccgtcttcttcctcctgggaattcgaattcccctttgccttctctttcatccttggaaaccacctgtgaaattgtaacttgtccaaaatatgtgtagttgcattagcgattatggaatgtccctaaaaaaggtgttcttcacccgaagaggtattttctattcgaatgagtgttcttcctctgggaaggtattttccttttgggaaaggtgttcttcctcttggaaaggtagtttccactcaaaatgagtgttttcccctctggatacttaggtcttgcaaaacctcgtagtgttttgaccaaattggaggaaaaggtgtttgtaccctgctacaacaagcccctcacgggtaagggcgatgtgtgttttcggccgaaaccgtgcttgagtttatggaaaaagggggaaaaccgccgtcctcctattcggtcgaaacacactattcaaatatgcatatatgccacgtttactattcattatttttatttttattcttattatttttcatttttatttatttatttattattttttaaatgttttttatgccacgtgccggtatttcattggtgcgcttaaggggtcgcgtcgcttcgggtttcgtgtccgctcgtaaacccgcgacccttaccaccctg

SEQ ID NO: 51776 - DNA, 1501 bp, Oryza sativa
atcctcctcttctcaaaatcacgcgccacgtggccataatttatgagtcagtggagatgtttaggggcagtgttggtgtgaggactgagtgtgaaaaaaaaaactgagatgattaggagaagctagccatccgatgtaattaggataggataggactagccacatattttcaaacctttcatttaatctaggtaaaatatgagcaagttcgagacttcgatgctggttctatagggaaaaagcaaccaacccttgacaaatcgatatgattaagaaatacttgaaacctaggaggctaggactaaggagagcagttaatgaggacatcaggagaacagaaaaggaggtccacaatgaaattcaaacaatatagggtcatatggtccaaggtaaaaatatgggttgacaaaagtgtatggtgaaactttggttagaagaaccaaaagttggacattggctgaactcaggagttgacaattttcagttgaaagctttttagtttgaatatatcactggttacacaaactaaatcattagtattgtctcctagtgctaatacatagaaagctgcacatttctacctcaaggttttagtattataaactgaactcaaaagttcaagttttcaaatcaaaagaactttttgttgaagattttacaaattacaaaaactaaatcagaatactatcttagtagtattaataaaataggaaggttgaaatttctagctgaaacaacaaggagatttatgtgtgcgtaacgcacgatgtgatagcaaacgtgggtgcatcttcttgtattagcgaaaaatgtggggaatacttttcccacaaaaggacaaaaggctactgtttatacttatcaaaacgttgtactccctctgtcccataatataagtgattttgagtttttgcttgcaacgtttgaccactcgtcttattaaaaaaatttgaaattattaattattttatttgtgacttattttattatctacagtactttaagcacaatttttcgttttttatatttgtaaaaataatttgaataagacgagtggtcaaacgttacaagtaaaaactgaaaatcccttatatcgtgggacggagggagtacttctcaagccaggtacacatgatttggaacttgcgacatgtctgcctttgaagaatgtagttagagaactttttacccaggatgatctagtctacggattgataagttttaaaacttcatgtatcgaattcaaacgagagggtgtgagagtgctttggccatgtatatccttgctatgtagagatcgaaagtgttagtacaattgtatcgtttcaatgtaattggggagttcaattaaaaagcttccattgtctaacaaattagccaaaagatgaccttgaatgttctacttttcagggttataaaagcaaaaatgacaattgaaagttcacctttcggtgttatagaaagctttttgatcgaggaggtcagagaacacaaattggaa

SEQ ID NO: 51777 - DNA, 1501 bp, Oryza sativa
aaatattactatctccgtcccaaaatatgagttttagggttgaatacaggcattaagaaagatggtggaattaaatagaggaatgttgtgattgattgagaagaggaggtaggaagggatttgaatggtggaaagttgcgattggctaagaagagaatgtatgtggagaagaagttatattttagggcaaattatgaaggctagatgttgttatattttgggatggagggagtagtaaactaatgataccttcttgactagtaggggttttcctcctagtaggtgttgcctttttgcccttatttagtgcagcagcatctccatcccctgcatggtctgaactagccttgttttcccccttttgttcttctccagatggtgtagtccttgtaggactgttttcaggagaatcatcggagcccgaagaaagcatcaccgtcgatgtagttggtggctacgaaaaattatgcaaaataaaattggtgatattatcaccaataacaagtcacaatcttggaaagccagagaagttgtaccaagaacagaaagtgtaacaagtactagatacagaacatgcttgctgcctcacatcggagcctatcggacatcggaaccaaaatcaagacatgtgttcgttgtgtttaaactaggaatcggcgataccatagcgggaccgtttagcaaaaccattggcatagaccaagtaaacaagttgttaaacacatgtacaaacaacgttttctgaataccgaaaattcgcatcgagttgtgcgaaggattatcaaagagcacgaaattctcacgaacatcacaaagcatatttaacacatagcctagaagcacaacacggaatgccattttgtgaaatgacatagatcaaacttattagcgcgcccactaattcagttcaattctcaacttaaatccacagagaaaaatgggtaaatcgaaaccgctcggcaggatggaccttattcccacggagacctggcaggatttagctagggcacatcacacggccacgggaggcggaggagaagagatggttacctggaacgcgcggagccagtcggggtcttcttcttcctcgcccatgcctgcgcctccctccctcaaaactcctccagagccgactatggaaggcagcccactacgcggaccagccgagcgagcgagcgcgccggcggcgaggcgaggcggcggcggcggagcccgggtcgtcgacctgcgcagctgcgctcgaggagaaagagaggtcacgtgcgtcagagctgttgctacgaggccccgttccagccgggccggcccacgagtgtggtgggccaaacacgcgatgctggattaggatacggcccacgagtaagtaatctatgagtatacctttcctaatcgttcacgcccttgtacgggtggaaacctagccaagatccccatcgtcgccgccgccgccgtcgccgtcgccatcgccgccggcggccgccattggcagcagggaagagga

SEQ ID NO: 51778 - DNA, 1501 bp, Oryza sativa
acttgtaacgtttgaccactcgtcttattcaaattatttttacaaatataaaaaacgaaaaattgtgcttaaagtactgtagataataaaataagtcacaaataaaataattaataatttcaaatttttttaataagacgagtggtcaaacgttgcaagcaaaaactcaaaatcacttatattatgggacagagggagtacaacgttttgataagtataaacagtagccttttgtccttttgtgggaaaagtattccccacatttttcgctaatacaagaagatgcacccacgtttgctatcacatcgtgcgttacgcacacataaatctccttgttgtttcagctagaaatttcaaccttcctattttattaatactactaagatagtattctgatttagtttttgtaatttgtaaaatcttcaacaaaaagttcttttgatttgaaaacttgaacttttgagttcagtttataatactaaaaccttgaggtagaaatgtgcagctttctatgtattagcactaggagacaatactaatgatttagtttgtgtaaccagtgatatattcaaactaaaaagctttcaactgaaaattgtcaactcctgagttcagccaatgtccaacttttggttcttctaaccaaagtttcaccatacacttttgtcaacccatatttttaccttggaccatatgaccctatattgtttgaatttcattgtggacctccttttctgttctcctgatgtcctcattaactgctctccttagtcctagcctcctaggtttcaagtatttcttaatcatatcgatttgtcaagggttggttgctttttccctatagaaccagcatcgaagtctcgaacttgctcatattttacctagattaaatgaaaggtttgaaaatatgtggctagtcctatcctatcctaattacatcggatggctagcttctcctaatcatctcagttttttttttcacactcagtcctcacaccaacactgcccctaaacatctccactgactcataaattatggccacgtggcgcgtgattttgagaagaggaggataatgggggtccaaagtgaaataagaaaaataaacacagacaaaaaaaaaaactaaacaaggcactaagaggaaaaatctgacaagccgaaactgaaattcactcgaaagacaaccagattggttctcccttttgggccactcgccacagaatgagcccatcaaagccgaagccttccctttcttggcccaccaggcccggcccacccgttcgcgaaaaaaatccaaggcccacagatccattcttggaggagggggcaaatcgagtcgaaacgaagccccccgtcgcctccgtcgcaagcaaaccggagatcccctttcccttctttgctcccaccaccgcctccacctcgcacacccagcggcggcggcggcgcccgcggatttctcgctcgcgcctccgaaaccctagctctcgcccgtagtagcca

SEQ ID NO: 51779 - DNA, 1501 bp, Oryza sativa
atccaactccaaatggatcagacttgagaaattccaaatgttgtatgatctgggttatcagtgtagcataatgtacttcttttaggcgtagaatgaaattagaagggatacacatgattgcaaaatccatttttatgtctatgaactctctgtctatcctcatttgtatgttgtataactatcaaatagccaaatttgaaaaagtctggatatcaaacacttgccattcatctttaaagtgattcgagctatttcacatgtgcaaattgaagctcactggcagcaagaacattctgaccactgttgttactccgtactagtattatacattttgctgttctgttttggcaagaagttgcatccaatcttaggctgtgtttagtttagcgcaaagtttggattttggttgaagttggagatgatgcgactgaaaagttgtgtatgtatgacacgttgatgtgatggaaaaggactgaagtttggatccaaactttggctgtgtttagttcagcgcaaagtttggattttggttgaaattggagatgatgtgattgaaaagttgtatgtgtatgacaggttgatgtgatagaaaaggactgaagtttggatccaaactttggatctaaacacagcatttggatctaaacacagccttacggttaaggctcattgttttgtctcagactctcaaacatgattgctggagacccagaagtagatcggggtagtcaacataaaaaacaaaaatggaagatggtcaattggtcactccataatatttttataaatcgacattttttattttggaaatagggataaagagggaaaaaaaaagcggcgtccgcttttcctggatcgggcttcacttaaaaaatcccatttttaaaagtaaaatagacgttgcagggaaaaaaattaaaatagtcactttgtaaattatttttggaataattgaataaatttaaattatatattggcatttttgaacaccaaatatccatttagctcattaacaacggtattcaggtatagtcaacataaacacggttggcaaaataaaataaaatagtaaagtgggtctaattgatttcttgcgctgaaacctactcatccggattagttcaaaacttagcattttgctcgcatttacgactaattattctttcggcgataaacaacatatctgtgaacaacgaagtacccgtggtgacttcatcaatctcaaaatatatcagcctagtcttcgtagaggtgagtgtgcacatcttacgaaccccctacatatatttctgaataataatgaaagaaatggtcccttcatagacgatatactccctctgtctctaaatataaggtattttgcttggatgtaacatattctagtccaacgaatctggacaggaagctgtccatccattatatttaaggatagagggagtactgttttggaaagtaaaatcaaattataaataaatacccttcagaaatatagagagggaga

SEQ ID NO: 51780 - DNA, 169 bp, Oryza sativa
gggatatggttggcatctgccacagcatcccatgctgcggccgcagcggcttcggtgtcccgcgctgctgccgcctcccatcccaggccgccggcgccgcctccacatcccatgctgccaccaccgccgccttagtgtcccacgccacctccgcatcccacgccgcagg

SEQ ID NO: 51781 - DNA, 202 bp, Oryza sativa
ggtctgaccaccgagatcatctgccgcttgctgttgccgccgccggtttgagcgccttgctcccgccggtcggaccgccacgatgccaccggtctaaccgccggttagttgccagttaaaccgccgaaacccggtgaagcacaaatcgaagaactcttaaagtggatgacgactttattacttctctttgtatttacaaagt

SEQ ID NO: 51782 - DNA, 1501 bp, Oryza sativa
ttcgatgtgagcaaaataatgggtgccgaatccctggaaacagtcttgacgacagggacgtacccggaataaaaaagagaaaaatatgagcaaaaaggctcaagaaaagaaaaagttaaaaattctctttgttgttttgtgctaaaggcttatttgagaaagagtgataattgcaataggtatatgtgtttagtgtttattcttcaacctatgtgcttgttaagatgttgcattataaatcgtatgaaatcatgaattatgattgttaattcaagcttaactgtaaaatctttggttcatggttatactttaattcatgtttgttatgttatagatgggttcattttctttttattgcaacacatgacgtaatatgctatatgtatgctaagctcttgaatattaatgaacataattcctatacttgatgaaatcattgtcaaaagggggagaagtaatgtgaaaatttttggagaagcaagattaatttttgagagttgttgagaagagcaaagagcatgttttttgttcaattgggaatttctttcttttaaaaagggggagaagttttcttttggatttttgagcacgatgtgtacatttgtacgaagtgtgctttttaccacttttgttttttttttccaaacaccaaaacatttttatgaatttgccaatgtgttcatcaagggggagattgtaaaatcaaaggtgtttttgattattattctgtgatgaacaattgggcattggagattattggttttgttatttggaatttattcacgaagtggttttggagatgattggatttcacaggtgaatatacaggtactgctggatttgggtccggtcagaccgggcacgggttgccggtcggaccggcgtgtattgcgcggtctgaccggccgacgctgtgtcggtttcggtttcgagttgtttatttggatatccgtgattatttcatgattatgacttctagatggatactatacgtatgtaatactattgtttgctgctaatgagtcaagttggagatagattggtctcggaatatggtttctttgtttgttccatgtgtaggtgattcgatgtctctggagagtatttgcggtgatggaccgggagtcggcttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgt

SEQ ID NO: 51783 - DNA, 475 bp, Oryza sativa
gatgccaatgccttccgtgagttcttcaactgggccgcaccacgtgtcttggctgccgtacgttctcagcagcagcagcatctgctgcaagtggatccaggaggggtaggatcagcatcagctagagacaacagaacagctccactgcaccagattgaggatgatcttcagaatctcgagaacgacctatggctgatccaatcaactacatccacaatgtatgacctcatcgatcgtcttgaatggcatagccacaaggatacagaagactggcatcttcgccagatcaaggatgtagcgtacgatgccgaggacctccttgatgagtacaattactatgctctcaaggtgaaggtggacacgagcaagaacttggggcaagatcactcgcatgaaccctttttggagttcctgaacagtgtcaacttcagtaaagtaatgaaaatcaaaaatagactaaagcaggtttttgacc

SEQ ID NO: 51784 - DNA, 1501 bp, Oryza sativa
tttgcttcttcaagtataaaatactggcataggtttttctccaaataaaatgagaattttgataatatattgcaaaggaaccacacgtaaagtttcttcaaaaataaatattctatttttttaatccttacaccgtgaaaagcctattttcacatgaactaaaaactgccctttgtttcaattttaaccttttaagtaggtccaaactgttcctaataaaatgtagcctcttaattacctgcatctccaaactcattttcttttggaaaaataaaacacctcccatagagaggttcataatgttactaatctccattcacttttaaagaggcggtagtatacgcgctatgtcacttccacgatgcagatacaccaagcgacatttttctctaaattaaccatgttaataactttctataaaaaaaataaattttgcctcgagtttctttaaagaatatttagtacaaagttgatactttttgagttgtaagtttaaaattcgaattcatagtttcaaattttgggttcaaagttccaggttattagtagaatttatactcggattttaaaatttgagatgaaaatttccgttcaaaatgtatctattgcttaaatctcaaaaattattgcacggcaggaatcaggtaaatttctgcaaatacattatgcgcaaagtcttcatcccaagtgattgaacgtgcatacataccgaacaatttcaacgactgattattgatatatcatattcctattaaaaacggcaataaattagatcagaagacgatggggagtagctgagttttgactccaaaagtagtgcaaaatgaaaatcctgaggctgaatgatatgaacttcaatgcaaaatatgaaaattagcagaatttaggatattcattcatgggaaggatcctttccaaaatactcccactgtttcataatgtaagtcattttagcatttcccacattcatatggatgttagtgaatctacgcatatatacatatatctagatttattaacatccatatgaatatgggaaatgttagaatgacttatattatgaaacggagggagtacaccataagatgctcttactctagagctgaccacaggaattaagtgctacttcctccgtttcacaatgtaagtcattctagcatttctcacattcatattgatgtctgaaaactatatcatcaccaacattgtagtgttcgggattcagccaaagtgagatgcttttaagattcttgcaggtctgggatagtgcaatcatgtcactgtcaataagaccactgacatactccaggcacagcctctctaacgccttgcacttgcccaacagaaaacgaagtccgatttctgggccttctggctctgttacaagatgcgccaacctcaaatccttcaaactctcgcacaacagatcatacctataagtatcagccttgtatgatggatcccaatctcggtggaaaaaactccaaaagccttgctcgtt

SEQ ID NO: 51785 - DNA, 1501 bp, Oryza sativa
agttagtctttttattgctgtggtccgctgtagcataagaacggcttcttgtgtattttggaagatggctcaatgaatgaaaatcctcaatgatttccagcaatgatgttgtgaagattattctgtttattttaccttgaaattcatataattcagcctcaggattttcgttttctgcaacctttggagtcaaaactcgctattcctcattgccttctgacctaatttaatgcggttttcagtaggatatatcaataatcaatagttgaaaatgttggatatgtatgtacgttcaatcactagggatgaattgactgtgtgggaataatgtatttgtacaaatttaccatatttcttccgagcaacactctgagagttaactaatagagactctttcaacggaaagtttcatttcaaaatttaaaattccgacattaactaaaattttcaaacttcgaattcaaacttccaaactcaaaatttaagacattgtacattttttaaaaaaacaaactcctgctaaaatatactccatccatctacctttgatagtcatatttcatcttaacacatgaccaaggataagtaattttacttatcatacatttgaatatgctactaatcattcctcgtaaacaagcgattcattaatatttacatttttcgatgcccatgtagccaatcttgtgtggaagaataaagagtcacgtattaaatccgagaaagtcattaagaggataggttgttggattgaaatatgcctatcaaaaataaatttttcagatttggaaatatgactataaaaaatagatggatggagtactaaagttattaacgtgattaatttagagaaaaaaagtcgctaagcgtgtcattatggcggatgtgagatagcggatgtactagccgccctctttaaagtgagtggtgattattttgaaaaatgggctcggagataaagggtgataagaaattaaattttagtagcatgatatttttgatctatttgaaaagctaagaaaatgatttaagggacaatttttacttcacgtgaacaataggctttcacacagtgtaagaactaaaaaaaatagaagttccttttaaaaaaataatgttgcaaaatgtacatttgcaatatattatcaaaattttcatttgctttggaaaaaaacatatgctagtatatataaaggaggggaaaaacattgaaaaagaataaagagaccatagggccaggagcccagggcccaacaagaggcccaggacgcgagggttttctcactggaataagatcactttgactccctcaactgaccaccgaatctaaatcgtatccctcaatcgcaataccagaaatcttgaacccccaacttacagaaccggtacaatttgactcccttggtggttttggagagtggttttgctgatgtggcgcacacctggcagtgttgacttggtcttcgtcccacgtggaattgacatggcgcttacgtggcat

SEQ ID NO: 51786 - DNA, 1501 bp, Oryza sativa
cagactgtggtcggcgcgaccggcgtctacgagctagctctgtcatcgctggccgcctagctcctcctctgcaatcgagctccatctccgttgccgcagaccagcgcattctccggctcagtcgagtactactcctgctcctgctcctgctcgtgctagtccgtcgtctcctgcagtcctgcttggaggcatggaagccgaacagctttagccttgggattgacatgctcatgactgcaaagatgagtagctagcagcacaacgtactagcttgccgagattagtaatagtatatatgagtagttgtgataaacaggagaagcatcacacacaggtcacaagcgacaggtcgaggtgacgaggtctatatcgcgcttgtgtcggagctgcttcttccttgctccctgcttagccatctctgcggtcgtgcgcggcttccgccgacgaccgtgcgcagcggcttggagctgctactttcccgcgacaactcctccgccgacgaccgcagctgcttgttggagatgcgcgccactgaccgctcaaccctgccttcgcagtgccgctaccgccgccgctcgtgaaaaagcaacgtcaaaacaacccagcaatatgggcttagcccgcataatcataagtgctgacgtggcgaagggttgatgtggcatcctacatttcatccacgtgtgtaaaatccatggtaaaacagcccaagggggtcaagtatccggtattaacagttagagggtgcattatacctggttttgtagttcgggggtgtattttagacaagcataaaagttcgagggtgtataatggacttttccaaaaaaaaaaccctactaatctttggttcagttgcatatggtggctttacttgggcgcttccaaatataacgtccagtggattcttgttgcaatttttttctaggcttctgttagttgcaatttttttctaggcttctgttaaacctagtctgctttgtttctaaaaccttggattcctcaattgactcatcaattacagtttattttcccaaatatatcagttccaggttttagcttgtataaatgtagatgcattttattagttgattgatggaatgcttatttgttactctgaacaagaaattccaaggtttcaattcgtttagcagtaaatcctttcgtttcaaattggtgctgtaaatcatacatagtttgttagactaattcggttctaggtttgaaaagttgctctatgttaactgattttgagagtttctatcttaattaatcatttcgtggatgaataaataggttacttctttaaatcgaatcgtgaagcacaaacatgtacagcaaaaggaaaataagttttaaatttcgttagtataaatacgttatgtgaattttccatcatgtattcatgtggttcattatgatttcaataattttaatccagggatctggacacctgctacaccttgaaatacctactagctagcagtgctgtatttctcaa

SEQ ID NO: 51787 - DNA, 518 bp, Oryza sativa
catcagacattaaccacaccgccatcaagtttggcagggagggcgatggatacagatcgttaagaagataagcgaagacttgatagtccaagtcttcggatgtatttttcccctttgttaattatggctaattagcatccaagtactccctccgtattttaatatatgacgtcgttgactttttgacaaacgtttgacctttcgtcttattcaaaaaatttatgtaattataatatattttattatgacttgatttatcatcaagttttctttaagcatgacataagtatttttacatttgcacaaaaattttgaataagacgagtggtcaaacgttagttaaaaagtcaacggcgtcatacattaaaatacggagggagtagaatttatcagtgctgtacaccttgctctcatcttcttataccactcatttgaactaacgagagaggtagctcgagtgaccgaccatacacacaaacaaagtcgtagtagttcatccatgccccatgcctctccac

SEQ ID NO: 51788 - DNA, 1501 bp, Oryza sativa
attattttccccatttatgccagcttgatattttttgagtatcagataatagtactacaattatcaacagaaactgtttttccaattgtacccaaagtctgcatatttcagtcttctgtgttcttcgtcaattttataatgtagtagtaagcttagaaaaatttcaaactgtgcctgttgtcttacatgttgctttcaccacaactaatagaacttcctgagaaattatgtgcctatttgagatagaattgtatttaatacaattatacttttagttgtacaggcagactgcatgttgcagccttttgtgttgttcaactttatactagacaagtaatgtttgaacaaaatttcaaaattgtgcttgttgtcttacatgtagctttaaccaaaactagtcaaatttccttctaaatcatatgcctatttgagatagaattgtatttaataaaaccatatctttagttcctataggctatactctcacaaaacaaagttcctgtccatttttagttatggatctataatatagacccgccctaatttctagactttatttaaaaaaaatagtagatacataggtgatagatttgccttgaaccactagatacagtaaatgtagctttggcatggtgcatctctcccgacatggaactcttttttattttataaaggaagcttttattaatctcagacgattacatcaagttgatagaaccatactaagaaaattcccggcctctgcataactaggatgcacacagccaaaacatacaaacccacaaaagagtttgtaacaagagaaggaaagcagtaaaaatcagggagcaccaatcttcaggctagaccgccacccatgtccctggtaaaacattccctgaccacctgctccaaaatcttagcgtttagtttgattttgtttgcgtttatgatcatacagcagtgctcaattggctatggacaaggtcgttggaatattgaggggagcagctggtcttgctgctgacgccaatgcgttccgggaattcttcaactgggtcacaccacacgtcttagctgccgtatgttctcaacagcagcagcaacagcaagtgggttcagcagggacaggatcagcatcagcatcagctggagaaagaagaacagctacactgcatcagattcaggatgatcttcagaagcttgagcacaacctttgggtgatccaaacaaccattaattgcacccacaatgcatgacctcatcgaccgccttgagtggcatagccacaaagaaacagaagctgggcaccttcgccagataaaggatgtagtgtacgatgccgaggacctccttgatgagtacaattattatgctctcaaggtgaaggtgaaggcgagcaagaatttagggcaagatcacttgcatgaaccctttttggagttcttgggcaatgttaacttcagtggcaaattcaggaaagtgatggaaatccaagaaagactgaagcatgtttttgacc

SEQ ID NO: 51789 - DNA, 929 bp, Oryza sativa
catgtatatatatatatatatacatgtatatatatatatatatacatgtatatatatatatatatacatgtatatatatatatatatatatatatatatatatatatatatatatatatatatgttacttcgcatttatcctaatacattttttttatcttgcagaaaagacatgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 51790 - DNA, 1501 bp, Oryza sativa
ctattttttttaaataaagtctagaaattagggcgggtctatattatagatccataactaaaaatggacaggaactttgttttgtgagagtatagcctataggaactaaagatatggttttattaaatacaattctatctcaaataggcatatgatttagaaggaaatttgactagttttggttaaagctacatgtaagacaacaagcacaattttgaaattttgttcaaacattacttgtctagtataaagttgaacaacacaaaaggctgcaacatgcagtctgcctgtacaactaaaagtataattgtattaaatacaattctatctcaaataggcacataatttctcaggaagttctattagttgtggtgaaagcaacatgtaagacaacaggcacagtttgaaatttttctaagcttactactacattataaaattgacgaagaacacagaagactgaaatatgcagactttgggtacaattggaaaaacagtttctgttgataattgtagtactattatctgatactcaaaaaatatcaagctggcataaatggggaaaataattggatcacacacctgggtccttaatttgttcacaattctttctacccaatgatcagaccacctagctagctcctcttcttgatcttgctcttcttaatgtctgctacaagcaaagcgaccacctgcttattcaaatgttagaacaatatgactagagattagataggaaaaaagagtacagatacactagtttcagatagagtaccaatttcatctcccaaattcaaacgaagagaactagatgaaatttggaagagtacaacctccaatttcagttagttcttttcataggtagaacaagggactgaactcatttttgggggcataggttgcttccacgtacaattgctcggataaccctctgggaaattattaagaggaccccaggatgttttcagaacatggcagaaaaaaagagcctgccgctgccggcggtggcctccacgactcgaccgcgcacggttgcttggaatggaccctacattttaacaaaaaaattgagagcagaatttaaaatagattgtgttcaatttttatacatttttatctaaaagtattttagggctaggtaaataagattgtgaaatactcattaccacccttaacgtgccaatttgatattttgccatcctccaaacggggtttcgtttttgctgtctaaaagcatctccaatagcctctttaaattggactctccaaacacctgtatagctaactatctatctgatttggctaatcaaactagatggtcactccaacagactctctattaatcctctctaaaataacaacggacccacatgtcagcctctactcctcttcttcctctctttctcccccttcttccttctctttctttcttttcccttttctttccttcccgtcgtcaaccaggcggcgcatgcagcgcggggaggtggcaggtggcggc

SEQ ID NO: 51791 - DNA, 1501 bp, Oryza sativa
gagaatctattctgtgtaccactgagttcgttcgagttctcaatgatttgccatcaacattgcctctttgtttaatatactggcgactttataaattgttctacaatataccattaggttgagtcatcttttcaaaaatatccttatgaacatataaggttaataattgatttatctcattaggagtgtaaaaaaacttttatggggcctccttatgcacacaacatggaaatttaaatttgtataggagtttcaactttttgacaattctattttttctaaaaaagatactttataacttatctgttatacagtatataaaaatactttattattattatttttaatataaatcatctttcatacactacagaagatatttttatgctatcatctcatgtataagcaaattctctctcatataccacataataatatttgtttagaaaaaactaaatataccagaaaaaaatttaaaacctatgtacaaacttccatgttgtgtaaggaggccacataaaaattttcatattttttgaaacttataacgagataaatcaattgtttatcttgtatatctctaagggtattttgagtatttttaaaaggaggtccagtctaatgacatatcgtagaacaattgctaaagtcgccagtacatcatagaaagagacaatatcgatggcaaatagttgaactcgaacaaactcggtggtatataatagattctctcaattttttttcccacgcgagggcattcccgttagttattaagcaaatattaaaggtctatcacatctctcatccgcaaattctaaaaacatctttagaatgcatgattcaacactggaacataatcgaaatgtaccaataaaatgttatgcgtgttgaattacggagtgttacagaaaccaaaccatagaaaagtttccaaactaatgtttgaatgatacattagaaaaaacaggcaggaactaaggcataacctcattctttttaataaaactttttatggattggcttattataaactaccagtaacatgccatgtacggattagacaaatataaatatagatacctttttataataagtgtaatagggacaaaacattggatctgatgcatatgcatacttacgcttgtgagcgtgttgcacgcggtgggaggaagagaaacggaagatttccatccaaattaattaatccctatagtggaaatggaaggatttaatttatccctatacaggaggggacacggaaggcagtagagaaattgcgaaataatatatagggatcaatcctttatgccaaaggatttcataggattttttttcttactttacaaatcccaccagatattcttcccttttttctttgtttcaaaggagacctgggattataaatttaatttgttgttttgcacgatgtatgttttacaagcaaaaaggtagatttaatattcaacttttagttttggggcatctacaaatttgctactga

SEQ ID NO: 51792 - DNA, 279 bp, Oryza sativa
aagctcgccgggccacctgagaggcggctgcatcgcctcgtttaccacgctacgtgcgtcacctttgtcggtggtggtcgtggcggaactgcaaaatgggagaggcggtggggatatggctggcatctgccaccgcatcccatgctgccgccgccgccgcctcggtgtcccgcgctgctgccgcctcccatcccacgccgccggcgccgcctccacatcccatgctgccaccaccgccgccttagtgtcccacgccacctccgcatcccacgccgcagg

SEQ ID NO: 51793 - DNA, 1501 bp, Oryza sativa
aaaaacataattctaagacagttatactcttaagaccgcaatgtagcattgaagcttttacacataaaactattttagtggagcacttaacccgtaagatagtattgaatcaatatactcccttcgttatagaaaaacatagctcattttacatcataatgatatttttattctttcaaaatttttatatttatcttcatacaagtcatattaaacacaccaagagacagataattataattcaattcagtaaattctatcctttaaagtaacttccatgggtttctctacaacctgcatgtataagcctctaaggtggcaatataaaataagtagcctttcttataataatattattaaaagttattttttcctaatatattattattttacgattcatgttggctaggtcttttccttaaaaagaagcgctatataatatatgtatatttgatcaattaaaaagagggctagcaggatggtaaaaaaattaaatttacaagcaataaaagtttctcgagtcttcttaaggaaaaaaaacttaacaatgaacattcaattaaaaatgaaaaataccctattttactttcaacttactttgttagaagtattttcgaaataaaataatatggatgcccgttagaagtatttttcaaataaaataatatggatgccccggccgattgcgcgggctaccttcttagttatatgctaattgtctttcacttaaattggcgggtccaatattataaaccattagattcgattaatctgaaaacaaaccatacactacatgaacggtaccacctatcctccttccccgtaggaaatagaatccaacttttaatctacccttaatttagttgtcacccccatcatgagttcgttagaagattcaatcacaggaactttgagtcccttgctcttagcgattttcacttgtaaccatattgcaaggtatatgtgcagatggtatgcatgataattagctaggagtagtttattactttgttgatacaaaagcaattcaaaacagttatcaaattagtctttcttttattcaaaagtcgatgaatggttttttatatatattaagaaaaatatataacccatgaatcattttaaaatgacattgtccaatcttcagtttgcccttaacctatatataggagataattggatcacacacctgggtccttgatttgtttctcaaatctttctacccaatgatcagactacctagctagctcctcttcttgatctttgtcttcttaacatctgttacgagcaaagcgatcacctgtttgttcacaaaaatcgtttgatcaacatgaatagagattaggaaagaaagaagagtacagatagagtaccaaatttgtctcccgaattcaaacaaaaagaactaacagaaatttggaagagtacaacccccaatttcagttacttcttttcctaggtagaatgaagggctgatgaactcgcttttggggctatacgc

SEQ ID NO: 51794 - DNA, 1262 bp, Oryza sativa
catatgtttggattgaagccaaattaaactaatttggctattgaaatggcctatgttatataggcatgccaaaatttggcctcaatccaaacatacacaattattgttgaggttgccaaaaaattggcaagcctaatttaggcctcaaaccaaactggccctaaagaacatagataaatgtacacattgcaatcagattctccagtacctcttttgaattcattccgatgatgtctctcagatcacttagagcaagtctaatagtacagcccactaccagctccaattcatttatagccaatctaatagccaattcatacaatagttacttactataatattagtatatggtcccacctgtcatacacacagtgtgtcttgaagtccgtactgcagctggctacaaatctgtagcccgctgctcttctctctcatcgtttatatcattaaaatatgtttatagccggttaatagcctgctattgtacctgctcttatctgcaaaagcaaaggaatcagctctgggttgcattgtcatgtaataacttctggtcgcttgggtctaattaatgcctactcccttgttgatctagagtgctcacctctttaaatagctctgccgctctggtgactcctcacgaagctcaagtatgtagtttgcccttttttctccgattccctaaacatgtatcagtgggttaatagtaagaaagaagcaatctgggctgccacgatatggttcggagcaaacctttaagctttttaattgtgtaaaattaaaggtgttttttattgttattctatgatgaacgattggcattggagattattagttttgatatttggaatttattcacgaagtggttttggagatgattggatttcacaggtgatctacaggtactgctggatgtggtccggtcagaccggcatgtatcacgcggtcagaccggcgcagcccgcggtttgaccggccgactctgtgtcggtttcggtttcgggttgtttgtttagatatccgtgattgtttcatgattatggcttctagatggatactatgcgtatgtaatactgttgtttgctactaatgagtcaagttggggatagtttggtctcggaatatggtttcttttgtttgttctatgtgtaggtgactcaagatgccgggagagtatttgcggtgatggatcgggagtcggctcggggataagacgacatccgtagtggtcagagatcatgcgggatactaaggctagaattcaa

SEQ ID NO: 51795 - DNA, 564 bp, Oryza sativa
atcctattttagattcaccaacctgtcgagacaattattgatcgttgtaagattggcattcagcatgcgctggaacctctcggtagaggtttgaaccatcctctcatcacaacagtcatatctctgttgatagctccacattggtctttgaggactttgacaagttcctccctgagcacgcagtccttaaatttatcgttggtgcatgacatggttagtagaatatagaaaatagcacaaggatattatccctatcaactactaggtgatgagagaaagacacttgcactcaagcatcttaccacacgcatacacgtagcaagagatgcaaccagtggcgagaagaatcacagtaggaagtatagtgctactatgcatttttggtggttatcagttgagtacttgagttattttatcttggacctccttgcatcattgtgcaggaagtacagccatcagtaggcatgaaaattcgatctgcattagcaaatgaggtacattactatggtttcctttcagccgagttccaaagtgaatgcctattgatataattttggagcaaaa

SEQ ID NO: 51796 - DNA, 426 bp, Oryza sativa
tgttgaaacttaaaactggtaattccccgcttagagtaaactcattaaatttttgatagtttttgtgtgcttattaagttcacagaaaattgtcatgataaaaatgctctgcttccatgtcataaattatgttatacttatttggaatatttagtttcgtgtgaatttcatgattggtaatacaattaaccgtattttcatcaactatggcaaacggactgatttccattggctgtcaagtacacaataagccgatactagcttttccaagactcaacttttataatactatgccatagaatacttatttgtttagatttagttatgttgtaggaaaagaaagatgaaacgaagtacgaaatgtattgtttatattcattggatttgatagttcattggcatcgacgtgcaggccataaataatga

SEQ ID NO: 51797 - DNA, 1501 bp, Oryza sativa
agtttgtaaataaactatacaatacagtatgtatataatatgtagtaatatgaataatttcccttcctagcattcaaacctaatatttaacatacctgtaagcctgactttcattgagtgaagtaaacttagttcgttcttcacatgtcgattcaaccattagcttcttttggcgataaagagcgcaaatagctcccatgcaaagctccacattttccatgaatctgataaccatattttcctcagactcccacaagctggtttcgatttttgacagcagagatgcacttttactgctggatgggagcaccaaagagaagggtacttgctcactcataaaggggcctccactttcttccatccaagcatcaaaagaaagttggttcatcaaattattcaagtgcaaatgagataattggttctgcatttctatatttcccttatttgattcttcaaccaagtgtgggctcatatcgggtacagaggcacaactagttgctactagtgctggagctattggagaaccacccgtggatatcagccccatggaaggaggttgctgcatagatgatggtaacaagggagcagtttcctcttcaattacatactcttgatcaacacttcccaactcagagaatactgatctcttgttccaatttctctcttgattatctgattccaaaagtaagggtggacctaccaagatcgctgttggagggggtactgtggctataatcggtatatctgacaatgatacatctgtggatgcgggaactgtggatgatagtggtagttgcaattgtagaatgcacttgaaattatttgacatggttggtgctggcttaattgaactctggcatggcctccctcttttttttggtgctcttgatgttgtcgatgcaatgagaattcttgcgcaaaactggtgggatagtcatgttgtccatgtcgaccctcttcctcttgcttgaagaacttgaatgattggtgccacttacctcatttttgttggagtcaatgttagtcttcttgccaccttcactatatgcgccctccttggctagaagatcacacttcatctgaagcacatcaatcttggcttgtagacatgcctcagtctcggcagcccgacgctcacgctcgccaagcacatgtgcggccaccttgtaatcagccatgcgatttgtggtttggaggtggcacacaaggttggcaccggagagttgcgcgagcttggctacggtgtcaccatcggaggccatagtgatggttgcggcggctctacccctaagctagactagattggatattggggaaggggattgatttgggaattgcacaagtgggcgatttcgtaggatctttgatttgggaatagcttactagtattattgccatcattaaatagggtagtacaattgtactatgtactacactaccactctgctctgacctatcatcatttctactttggtacatttgacactaattagtatttttt

SEQ ID NO: 51798 - DNA, 952 bp, Oryza sativa
ggacgtccatttctcgatccaacggtagtttccaagtttccactacatatgtggtttgcactacagattttcccttatatcagctcagctagttagtaatgtaccaagcattattgttgcacctacttggaagcagttctttttttggaacatgtactatgcgtacaacctaatttccgtgcatattaactagcaaatgccacgaaaagttctaaaataaaatgacatgtactcctgatagtattacacatatctgttaaatctgatattcaaatttattatattttggccgtaacaaaaaaatttaaaaatttgactatttgaagagaaaatctatcagaatttcgtattttttagagctaaaatataataaatttgaagataagatttcacacctagattgggaagtatgtgtctaatttttttataaattttttctttaaatttgtagttggtgcacgggaagcttgcatcgataaggtattttagagtaaatagtagctagttaccacttggcagtattttttttgggtgcaactagattgattactgatgatttctacccatccataacaaatggcattggtcatattattcctcattttagaggcatggaaggtacttgtttttatcccaacaccagaccagaattaagaacaaaactcgtacatacattctaccatattctcctataacaatggcagggcacatttgtaaacatcatgcccttttcttatctaactattaattcaacaagtgggtgcatcctatactagtccgtttcctcgtcgatgacatcatgtcatggtctaatcttctcgtaggcctgaaggatcagcacatatatacaattggaatttctgacaagatcaggcgtgtgtcaactaattcgcagctatgtacttttgctgaagttgcaggaagaattgcaagcttttcagatatgccaata

SEQ ID NO: 51799 - DNA, 1501 bp, Oryza sativa
ctcgccgtagcagatgacacaactggaagaaatcgcatgcatgagctttgttggatggccaatttccaaagcttcaggacaagatacagcagatctttcttcctcaagagtcctcagcaggagaggcaacaatgttatatcattctcacatgcttcctcaagaacataagaggaaattatctctattatgggcattgtttttttcccccaaaggaagtaattagacaagcttcactcttcacacaagttttgtgatgattcactactcaatattatccacgataatctgagtagtgacaagttattgttgtccggggatgacagtttgtggattgctacagagcttgcatgagctttgtattatctccattttgcaacaacaatatcagtttttcttttaaattttgcttgcatagggatctcaatttcaggacaacatctagatgatatttcgatcatttacctgagataatattgcaacctcatttgatgaattgattaaactatttttaccgtgatcttaagatttttcatagccttggtcagataagattccttcttacaatgtaagatgctctgctacctagaacacatgttggatcagagttatttgttgcgttctttagtttttccaaagaaaaaatctttgtgctatcactggcattttcatcttaagatattggtgattctagaagaaggcccttggtatttcttaaaatatttcttctttgcttttggatataccttctatacttgcagaaaaggaatacccccacacaaacgtagaagaaaaattccaaaggcaacacccagaccaattaatagcattacctacaaatagtgtttcccatatgtcttcccttttattttattttcttaattaggtctcttctaaaccgttattacaacactacttgaatggctggtgcaagattaaacttttgaacgttaccttttcctttcttaaagagtgcacaaaaattaccaataggatgaaagccagagttccaaaaggggaaaaaaataagaatctatacaaaagaatttcctgataaatgataattaatctttttctgtaaagtggtgagaatggaaaatgaagtccaatttgtatgtagttttgaaaaaagatccaaatgtatttagttttagcctgacttgtgaatcattcatattgcaaaatactcaaattacaaaattaaattcattggaagagaaaatcaagtacaacacgcattgtatggtcttggacgccacatatgtgctaatgtgcattatgttgtttttgtatttcatagctaatagtattcatagaatatgttaaactagaggtgcaaacaaccttgatcagctaaaaacatggctcattctaatctgtttaaccttagtagtacgtgaaatttaagagacggtggctaactgaattgttgttgcatgtgcaatacttttcaatggactcatttctactctttttataaccttactagtacatgtggcatca

SEQ ID NO: 51800 - DNA, 1501 bp, Oryza sativa
ctgataaatgataattaatctttttctgtaaagtggtgagaatggaaaatgaagtccaatttgtatgtagttttgaaaaaagatccaaatgtatttagttttagcctgacttgtgaatcattcatattgcaaaatactcaaattacaaaattaaattcattggaagagaaaatcaagtacaacacgcattgtatggtcttggacgccacatatgtgctaatgtgcattatgttgtttttgtatttcatagctaatagtattcatagaatatgttaaactagaggtgcaaacaaccttgatcagctaaaaacatggctcattctaatctgtttaaccttagtagtacgtgaaatttaagagacggtggctaactgaattgttgttgcatgtgcaatacttttcaatggactcatttctactctttttataaccttactagtacatgtggcatcatgcaggcaaaagtgggtgcttaccgagcacaaagagcccatttgccacatgctttattagaatagaattgcaaggctagaatgtatttagaactccatgaaaaaatagggatgtatccctgaaagaaagtacagcgatatatagagtcaggggcgtaatagctctttctgcctcaggcaatagaggcatttgtcatcatcgtcgttgctccctcccaatgttgttacatcaaagaacaaggcaaccagatctggccacccctgaactcgtggcggccatatttgactacccctgggctcatcgcagctagatctgacgacctaacatcgacactggaccacactaggacaaagatttctgctagggctgcagtggaggaggtgagggcgaagcgatttccacagcggccacaaagaggtgggggaggaggtctccaccggcgcacacgggacccaaatgatggtggggacatggaggccggcgagtaaagaatgagttggggagaaggggttggagacaacaggagacagataccaccacacttaaagaatatcaccctttgcctggcgcagcttggctcagctagtgctctgcctagattgattttctgcatcgattcctctaaaaaattgccactagtagttgttttggtatgccagttcaactaaaaagccagcactaatgtgggatcatcagtgctagtttttctcttctcattgcacgtatgagtcctagaagttaggaaaccgctatcaatgttggttcttgcttaatcagcattaacagggcatcaagaacaaggagttctatggtagtggcattgtgttctgctccaaaatcacactcggcaaccttactcgcagataattactttatgaactctgctagtgttactttggatgccattacatatgtttcctccatcttgattgtgcagagtcattaccaaacccctatcccccctcctctcctccatccccacaagaaaatatattgcacccaaattcaaatccatagcagattatttttattttgtatgtcaatattt

SEQ ID NO: 51801 - DNA, 168 bp, Oryza sativa
gttgcacatctctctcctctgcactagttcggagagaggagaggagagaaaaaattctacatgtcacatattacgtccatttgagttcattttttctgtggttggttcttgtgtgtccctaagcgtgaaaaaaatatcacacaaataaaacaaaaataaaaaatttcg

SEQ ID NO: 51802 - DNA, 1501 bp, Oryza sativa
gtccgcaccgacgagggggaggagggtgagctcggccgccgctgccgatccatgggcgttcttgcgatcttggcctcttcttggcgttcttgcgttcttggcgagagaggagagaggagagagagatggggggatttggggttggttgagtgttttggcggggaaggaggaggcgatttgggtgaagcgcggtgaggggaggtaatatagactaaagaagggtgttgcgatgggataattttgggcctaatttggatgggcggagattgagatctatttagaattgtgcctaaacatattagccagttgaggcccagattgatgggccgaaatcttggttcatttatgtgtaggaaaaagtacatctgaggtctctcattttgtcaccgaattacaaaatcatcccgcaacagataaatcagatatatgatatctctcgacttataaaaccgggtcattctgggtcattaggcggtatttaccctggtttttgtctaacgtggcagccgagtcagcgtagaacccacgtggggcccatatgtcagcacatcaatcctcttccacctctatcctctctctcttcccatctcaatcaaagcatctagggtggccagtgtcaggctgggagaactggagaagggtggtggccgacggaagaggcgctcgacggctaacagtggccttcgctggcggtggcgacgcttgttggtgaagacgggtagggggaagatgaacggggatggtggcgctgcgggagagctgagacaggggagcacgggtggagagcaatgggggagcatgggggagggactcaccagtgaactccgcctctccttgtcgcattcgtgaagggatccgaccgggccgtcgcgggcctcctcctctcccgccttgcccagcccgacctcccctgcacatgggaggtgggaggcaaaagaggtgggaggacggcatgctcggtgaggtcgaagcggggcacgagggcgctggaggacgacgtggccaatgaggtcgaggcggcgcgcgaggaggtgggaggacgacgcgaccggtgaggtcgagccgaggcgcgacgaggtcgaggtggggcgtggggagatcaaggcggggtatggggatgtgtggaggcagccggcgaggtccgccatggatcgcaccaagagcagccggtgcgtcctgcttggcagggcgaggtccttgacggagaccggcttcaccctcgagcttgccgctgccaccttcccgccgagataagtgccgctgtagatgctgcccgactgccgcttttccactgcccaccagccgttgtagactttcatcgacgagcgggtgatcttgaactcgctggccagccagcaccgctaccgcctatctcctctccgccgctcttctccttgcccgccgccagccaccgcccacgcccgctcgtgcactgtaaagagacaagagaagagagaggagaagggatggagaagcttgtttctgcttgagccgtacgaga

SEQ ID NO: 51803 - DNA, 1501 bp, Oryza sativa; identical to SEQ ID NO: 48204

SEQ ID NO: 51804 - DNA, 1501 bp, Oryza sativa
cacgtgcaaaatcaattttagaattttcagaaaaattcctccgaggtcggtctgaccaaggtatagtagccggtctgaccaggggccggtgtgaccgccactgtaccgccggtctgaccgatgttcggtctgaccgaggatctgtagccggtctgaccgcgggacccactgtggtttgaccggtttcctcgagggaaaaccagatttttgccactttgattttgcaaaagcaatctctctctcctttttctgtttatgagctaatctgaaacaaaaatcaacaatatgtccatcttttccacaaaaagaacaagtatatttttcacgttgtttagacacattgttaggacaagaagatttagcaacacaagcagaaacaggaggttctgcatgctcaacattggattttgaagaagatgcattcatggtagacatgataccagcagatttaaacacagttttattagtatcatgtttaatcaaaatctcaccacttctagcaccaacagctaacacaataggaggatgtctagaattatgagcataagggtcaaaacctaaaccacggttatgtgtgctaaccttagattgatccaaaatcatgttgaggttctttttaccatcagaaaatctttgaaaagaatttttcaaataagaaacctctttttccaaattagcacaattttcacaatctaccatgacacctttgcttttacgacatttggggcaagaaagcacttcattgtttttcacaacatcttccatgtacttaacacgacctaaagcatcttttagtttcatcttattcaaatcacatgttgagcaatccaaaacaccataaggttgttttaactttttagcagaaatcatgttaaacatcaaactagcatgaaaagcaatttgatattttttttgcaacaactttttagttaaaaacaactcatccaaagtgcgtgtatgcaaggccaaactacaagcaaaagaagatctatttttcaaatcatgtgcagcattaatatctctaatttttgaaatctcattcattaaaacctcacaatttgagcaatcatcatcattaggaataagagattttaatctagcaacttcagatttaagagattcaatgataaattcatgttttctacacatcttctcacacttcttttttttcactcaaaatattaatagcttcctcaaacgcacttaactcattatcttcatactctatgtcagattcaccacgcgccatgaagcaaacatcggagatgttcttccctttatcatcatctccactttcaccatctacatcacttagtggctcgaaagcggcgcaaacttattgaaaagcctttctaagattctccatcttcctcccttgagatgagcccttcgacctgttgttgttgggcatgttgttgttcgtcttctcaccatctttgtcttctcttttgcctctcccaagcttaggacaatgcgaacgaagatgatcaatagaaccaca

SEQ ID NO: 51805 - DNA, 1501 bp, Oryza sativa
acaatatgattttacatgttctgtatcaacaaaactgtcaagcaacgagcgtgtttttcacctttcacattctgcatcatccaagtcaaaataatttaacttacaatggccaacaaacacatgctgcaagaagaaactgtaaatggatgaagtaaaagccaacaagtttaatttgtccatggttcttgatgtgaagagcactctaatcttgattgcagccgtaccagaggtcatggcgtgcgatgctctaaatcattcagacgggaatcaacatattggatgatcaggtctatgactatggctgggcatggttccctcaaacatcatagttgtggcaccatgtaacatctatctatctatctattattatatactaaaagtccattaaactttctagaaacgctctcaagacgccacatgtcactcctcaaaatgctctcaagctgctacgtggcaattaaaaaatctaaccattgattttcatttaaatcgatgggcccattattatcaaccatcggatcaatcttaaaaaaaaaaagatcccttaaaccctgcctcccgcacgtattcatccctgtatgtatgagttcgtacatactgctgcatgcctgcctcccgtaggtgctcaactctgtccaagcaatcatgcatagatttttatgctagctagatagccacacagttgtggatgatctatatgcatacatatgcacaccaaaaatccattaaagatcttcgaattagaagagaaaaataagccactcttaaacaagcaagcaattttttttttgctcttttaaagccataagccactctttatactgttaaatcaaaaactaggttggaaaagaaaattttggctgatgtaagacatatgtatgactccaccgttaaacttataactctaaatccactagcgtataagctaaaaatctaacttaaaaatcgaaagtaataagcctaagcctatatttagaggccctaagcaggttgatcagttgatggtctgattgatgatagaaaatatttagtaatctagctagggcacttggccctatttttccttggctatacttaatttgaatggttgtagtctagctttacaattaaatcaatagtttaaacccatatatttattagggttaaatggatcatactactacaaatatgccatttgagacaaatgccactactgtttacgatattggctatgtgccattaaaatttgaagaaacaaggaccgtgccattccatcacgttttccgtcagacccctagacgagggacccacatatgaggtccatcttcccccatcctccctcttctttcttcccccatctcttcctccatccccgctactgctatgaggacaacgacgatgttggcggcggcaatagctttcgagccctcccgcacagattgggttgaggattgcgactcctgagcctcctgccacggttggcatcgaggatggtggcagcgggtcccgagccctcccacca

SEQ ID NO: 51806 - DNA, 1501 bp, Oryza sativa
tcgtcgttttccttcttggaggcatcgtttagaagtcctattcctttggggtgttgtgtgcttgttttgttttaaacagtaggatcagacgtagacgcgtggtgtggttgtatattttctttttcctgactacagtctcccaggactataggcttgtattttattccttctttatcaatagaaacgtcgcactatcttgtgcgggttgtttcaaaatactctacaatctactgatctgcctcatcgttagctagtactccctctgtctctaaatatttgacgccgttgacctttttaaacatgtttgattgttcgtcttattcaaaaaatgtaagtaattattaattattttcctatcatttgattcattgttaaatatacttttatatataaatatagttttacatatttcataaaagtttttgaataagacgaatagtcaaatatttgctaaaaagttaatggtgttaaatatttagaaacggagggagtataactcagtcttctgcagctaggaaaacttcaacttcttttactttgttagtttgttttgagacggagccaaattaagcatacgtttcgaatctacaagtccttggagctggactttttcactgtgctaattttagtggagttcaccccaaacgtcacctgaaaataatgaaggcccattcttttcatatataccaaagtccaatcctagcttcttattactctgtcaaaaaaaaaaaaaaagacaaactttagctacgtgtgtgttcaggtttgtagctaaaattggaccttttttttttaaggacggagagggtatataagaaaataagacatgagtcaaccagactgcttggagaaggaggcactgggaaattctcttgcttactaacttttactaatgtgctgaagcgtcacattcagctatacagcacggcgctcgagcttatagctataacaatcttcaaggagggatttcgagttcttcagtatacaacacaacactggattctaaattctaatgctttacatgtgtccaatatgaaggaatagaaatattatttacctgaccatatataagaaatatttttcagtgcatctctcaaatccaatcagctttttgcacgatctgaatctgtaattgttctcttttgtctgtgagattcaaaattgagccaaactatgtaatgttgaactgtaccattaattagtaacaaaactctagcgatagggtctaatacccattatattgtaattatgattgtaacgctgatgcacagttatctaagttgtgaaacattgttgcaataccttatatggctatgttacaggagaatattttgctgtagtggatacaagccaatagatagctaggttgcaatttgatacagtgatataggttcacctttccaatccagtgcataataagttcagcattgaaccatttatcacatgcaatttattacaaactggaaacaatggtgcatgtatatatgctgggcatttcaca

SEQ ID NO: 51807 - DNA, 343 bp, Oryza sativa
gtttatacaaggagacatgaaagaggcagctatactatagcttacataagcaattgaggcatgtgagtttatcaaagtgcttggagaaggaggcaccaggaaatttctcttgcttactgctccctcctttcctaaatgtttgacgctgttgacttttttaaatatatttgaccattcgtcttattcaaaaacttttatgaaatatgtaaaactatatgtatacataaaagtgtatttaacaataaatcaaatgatatgaaaagaattaataattacttaaatttttaaataagacgaacggtcaaacatttttaaaacagtcaacggtgtcaaatattttagg

SEQ ID NO: 51808 - DNA, 1501 bp, Oryza sativa
tattgccctctctcacgcttgtggtagctcagtgatagaaaaaacaattgataacttgagaatatcttcagttgttaaaaagaaaaacaacagcgatagaattatttaaccaaatattttaaaatgaaatttgaaatttttaaataaatttgtaattaacttcaatgaaatttgtatttcaccaaaatttaaacccaaataagaaataactttggtcacacaggtgctatttgatcacgtcatgtgaaaaggtgagtcccctatcgcctcggtagcacaaaaatactaacttaatgtgtgaggtgtctcctgataaataatcgtatttttaaattgtattccccaaaagtgacttcgtgtgagtcctacaactaaaatcatggaagtcacttagtgaagatactggaggatgattgagaagattaatttcacattttccttaatcttatcgtggatggaattaatcaaacaaagaccttatgagggagtgcctccatctttgacgccgttaacatttttaaatatgtttgaccgttcgtcttattcaaaaacttttgtgaaatatgtaaaactatatgtatatataaaagtatatttaacaatgaatcaaatgataggaaaagatttaatatttacttaattttttacaaataaaacaaaatatgtttaaaaaagtcaacggcataaaacatttaggacgattgtagctaaaataaactttaccaaattttggcaatgccaaaattttagcaagatgatataattatcaaaattttggcatgattttttacgtatttaccaaatttagcaataaactaaatgtagatatttttttggcaactttaccaaaaaatgatatggttgaaaatggtaccaaagggacagagggagcctattttaatgtatgacaccgttgacttttttgtctaaagtttaaccattcgtcttattcaagatttatataattatcatttattttattgggccgggccgggccgacgcgccgcatcatgtcacgtgtgacgccctcgtctccgtcctactcgtaccttctagatcatcatcccacacacgccgcacaacacaagcagaagcaacccacccaccctcgccgacagcgtgggcccacgccacacgacgcgtccctccctcgaaacccaggagatccctcgacgcgtacgtacgccggcccctcatatatccctacgaatctggacacgagtccgtccacattagtaatacgcgtcacacacacgaggaaattattcattacgcgtatatatacgcgcgtaccacacgaaggcgtagtaaccaacaacacacgtgtgttccagaggcttcaaccgcagcgaatccccccacctgaagaaaaacgagacgagattctctcgctctcttccggcgagattttcgtctttcccccctctcctctccgctcctcgtctcgtctctccgcttcccctcctctctcgattccccaccatggccggagccgccgcga

SEQ ID NO: 51809 - DNA, 676 bp, Oryza sativa
cctgattgagtaataatagagaaaccatttagttgttccacatcttgcggtgaaacatatgaataagggacgaaagtagagataattgctcccattgtgtgatgcaagcggtgagcagggagatttcgttgcgtgctagttcacttatacaattctgagtgacaaatttgtggggggccatgccgagggaggggggggggggatatgggtcttagctggtaaaagaaaaggccattgagtcattcttaatgtagaccgtctaaaaatgaacaggagcccagttgtgtgcactgatctgaatatacatttggaacataatgattgaaactgttgagttttacaaagaaaattgcctatatgttcttaaaacatatcattcttgttgttaagagtggtgtgcggccaatattatataggacatgatcatatgtgatgcagttctttagagttatgaaccaattggcgataaacggaaatataggaatttgcttatattgtatgtgttcgtcttgagatgaattcttaggtgctaatgacttataaacgacacatattaaagagtctattctagaatatctgagtttctagctttattatttggacatttggcaagaaattttgtaagaatacttaaatcgtaccatcgtattttccccctaaggatgtggttacttcc

SEQ ID NO: 51810 - DNA, 520 bp, Oryza sativa
ataactatatggtccgcgcgcgttcgtataaaagggtgtttgttttgatgactaaccttagtagtaaaaccaaatcttaggtagggaatatggtccataaatgtggttatagtaaaatgctggccaaacttaggaaaacttaatatgcaataaacgaatctttgacgtgtgtggggcatatacctacaattgaaaagcgatgctaagttacaatcgtggcattgctaattaaagaaaaaaaattatagcacgactaggaatattgttaagttggacaaaccaccactacacatagtacacttccacgtaagtacgacaacattattccatctacatatagagagatcatcatgagaacttagataagacattgacatagatttttcacctcaggtcgcccgtgagagaacaatgatgtcgtaccaaaatgcgcactgtatgtcctccactgttgacctcacaaactaaacggatccatcagacagcatcacacacatctcgtgcccttcgctccaaaaga

SEQ ID NO: 51811 - DNA, 1501 bp, Oryza sativa
aacccataacaactatctctcacctaatcacaatcatttgtgacctcaacctttgatttctattaaaactctaaaaaaatgattaacctttggaaaatttggcaagggaaaaaaaagatatagagtaaatttcataaaaccacatatactttaatcaaaccatcacaaaactatagatataaggcgtggtatcataaaactacaaatttagcgccaggtttttttataaaactataaatttagggctatgtatcacaacatacaaattaatatttaagttatcacaaaactatagattttggagtttacatacctagaactattattatgttggagctataaatcgatagttttatgataaatttgatacctaatctatagttttatggttcttcatcttaaatatatatagttttgtgataaatttgatgctaaatatatagttttatcatactacatatttgtaattttgtaatagtttgatcaaattatctgagatatataattggtgtgtgacaaatagaattgaatgcctaagaagccaatttgactatccagtatttatatgtcgaaataatctataatgcaacttgcatttctccataatgtgttctatattttactaaacttttgaaaggggactgacgccaggattaattactcagggctcagtcaagatgtcgattggtggaagaggtcgtcgcgacgctcccataagtcctcaggatatctttactctactttaatgatttttcatgtactaatacctctgttcttttaatttgttctagacatttttaaattattagagcgtttaagacgtgaggttgactttgagtgtgcatgattttatatcaagatatgctaatgaagttgtaatatcatgaaagtatttctaaaaacaaatctattggtacaatttacgtatatgattttttttataatttcaaatgtatgaacggcatagattaattctcggacgccagttaaaactgaacagaggtagtatgtatattgtcggaaccacaccaataactttaatttcattttgttggaggttacttgatacatcaaattacgatcgagctaatctttccaaatatcacattaattacttttttggctgttggattaggcagttcttatcaatatttatagtttttgtccacatattacaaccatatgtgcatgaatcattgtaccaccacatgacaacaacatgctgggtgtacagttatatataacaagctagtctaggtcaaggcaggatttgtctagatcacaaataggaatatcgatcgactccgggcgctaagctatccctatgtgaagatgaagacttgaacaagtccaggtcaaggcaggatttgtaaaaattaaaatcattttagctggagttaaagatcgtttctcctacatctattggaagaagtggccactgctatatatcttacctcagagttacttgctcacaagtaagcaacaaccaaaccaaggccta

SEQ ID NO: 51812 - DNA, 887 bp, Oryza sativa
cgagggggcccgcggcggcgccgccatctccgtcgtcgccgttctctctctcacttttcgcgggtggagggcgagagacggtggggggagaagagaagagaaaaggcgctggccatggcgcggcgggcgcgaaggtcgccggcgatggcgacgccgtccacgcggtcgcgtgagagagagaagagaagagaagctagggttttcggcggccggccgggagaggggggttttgatcctccgatctcggcgcccggccgtccgatcgaaaccctagctgatcggacggtcgacgccggccgggccgaaatcggcccaagagggcgcgcgcggggggctgctttcctggcccaggcccaggttgcggcctggggaaggggggcgcccgcccgtgccaaaaggccgcgggccgaccgggaaaagtctgtttgaggtccctcggggccgaaaacaaagaaaagagaacagtagcattttttccaatttattttgtcgatttttcatgcaaatttcaatagaattttgaatagatttttgcatgttttacctctgtttaaatttgaaccaacgggagaattttgcagagagtaaattacagtgttttgctactgttcatataaattttatatagtttttccgctgcaaatagatgaaattgatgaaaattagtgtttctaaaattaaatttcgaaccaacgggagaatttaattttaggaacattaattatgtgctatgatgttgtaattttctgaccaacgttgataattgcaatgttatagttatggctatgtgttatgtctaattctgcccaacggtgatgtaggcttaatgcatactattttaatgttaattttgttctcaccgcacatgattatttcaggtggctact

SEQ ID NO: 51813 - DNA, 693 bp, Oryza sativa
atatacacatgtccggccggcgacaattctatttctacttggaacattcaggcacttcatatataaagtaggatttaaacatatggcaaggaccagatataaaataatcttaccggaccggtggttcaatcgaaaaaaccaaaccagctcccctcaccggctcggtttgctccaaggatccgcatgggaagcgcatagtagaaaatcttaccggctcggtttgcttcgaggagtcatgggaatcgatccttggttactacttatcatccgtttcacaatgtaagtccttttagaatttctcacatttatatttcacatttaataagtctaaattcattaacatcaatataaatatggaaaatactagaatgacttacattgtgaaacgaagggagtagttaggttagaggatttacttacataccaccaggctaagcaagctactacaataataagaaaatactacctctgtcccaaaacaagcttattttttactcatcctatacataccaatacaaaaccaaaaagacaaaaaatacccatactttattaaatcccaatacaattatttcccactttatctactcccattacaattattccttactttcataaactccgacgcaatgattacttaaaaaagaacttaatttggaacaaatggaaagagctaaaaataaactttttacggga

SEQ ID NO: 51814 - DNA, 246 bp, Oryza sativa
ttattcaaaaacttttataaatattattcaaaaacttaattagtagtagtaaatttaacaatgaatcaaatgataggaaaataattaataattacttaaattttttaggtaagacgaacagtcaaacatgtttaaaaaaatcaacagtgtcaaatatttggtgacggaggaagtacgtaaaaacaattccaactcttattaggtttaatcctagattggcactactttaaaggcaaacacagtaca

SEQ ID NO: 51815 - DNA, 701 bp, Oryza sativa
tttcattggaggtgatgagtgttttacactttagtgcttggttaattagtatagtgatagatatatatgtagatcttgatatagaagagattccattaattcaagttaaattcacatgtagtggtcgtgtatatctgtagtactcatttcgtcccaaaatatatatgctatttctagtgttaaaagtttataaaaagattggctatttcttcacttattttctcatgtcaacgagtcacaatcacatctcccgtatttactctagacctagctatgttctcattcccaattacaattccttatttgattttacttcacttcttaatcttcctgaaaaactctagagtgtttatatatttaggacataaaggagtaggaagtgactaattttttactccctccgtccctaaatatttgacgccgttgacttttttaaatatatttgactgttcgtcttattcaaaaacttttataaatattattcaaaaacttgattagtagtagtaaatttaacaatgaatcaaatgataggaaaataattaataattacttaaattttttaggtaagacgaacagtcaaacatgtttaaaaaaatcaacagtgtcaaatatttggtgacggaggaagtacgtaaaaacaattccaactcttattaggtttaatcctagattggcactactttaaaggcaaacacagtaca

SEQ ID NO: 51816 - DNA, 388 bp, Oryza sativa
aaatcatttaaaataattgtcacaaaaggggctccaaagtatcccacgtatcaagatattagaaccaatatgtagaagtttaataaatcgatttcaagaccagcacatagggcagtataaatattacagaaaccataagggtatttgtttgctgcagcaaataccaagaaggttcagattttcagaaccatatggtttatttctgtgttttctatttttagtacattcatatatatatgcaatagtatagttgtaaatagtgtttatttggaacaatggtgcataacatatctacatcatactattgcatatctagcttataaatacggttattggatgtctaaagataccaccacttctgcaaattacaatcttttctccccagaca

SEQ ID NO: 51817 - DNA, 582 bp, Oryza sativa
cggagggagtacaatttttcttttggtcatttctccatccgagtttcattgaactatataaaatttgaatttcaaaatataataaatttaaataatttttcaggtagtaaatgatttcaaatggaaaagtcatcaataaaaagttgtataactcatcaagatatacaacttttggtttggtcattcttacatatgactttgtttgaacagtttgaatttgaattttaaaatatgacaacttcaaacaatattttcaaatactaaataatttcaactgaaaaagttatcaacaacaaagttgtataactcatcaagatctataacttctattttggtcatttcttcatccgaaaaagtgttttgtaacattgttcacaaaatatacatatctcttattgttttataaactttgtcggatgaagaaatgaccaaaatagaagaaatgaagaatatgtacatatctcttatgtaaattttgagaatatgttacaataactttgtcggatgaagaaatgaccaaaataaaagttatagatcttgatgagttatataactttgttgatgtgactttttcagctgaaa

SEQ ID NO: 51818 - DNA, 1501 bp, Oryza sativa
ccgcccgcgatcgctcctccaccggcaggttcgtcacacacgctcgcgtttccccccccgggttgccgtaagtacgtacgtgaaccctccctgtccctgtccctgtcccgccattccgcctgatcgccacctcgtggaacgggatgaaccctagagcggccgtggtggggagtggggagggatgggtctttattctgtcagtcataataccgatttctcttcgtttcgtttcgggaggttttctttttcttgccgtttcaaccctagattaatcctgagactttagcgtttaccattaccagagacagattttattttgtgactttttttaatttttgttgatgatgatagggagagaatcatgtgctacactttctacgaaatcgatttagtgatccgtgcttgtgtagttcttgtctctgcattcctgctttgctgctcgccaattagccacagattcttttgttctttgtactactactagtactagttcttgatgagggagcaataattcggagcgtgaataccccatcgctagcgcaatcgcctcgtcggtatcgacctttttttttttttttgccctgcttggacagaccgtgcaaaagcctgcgcctttctttctccaaaaatgcttttttcccgtgttggccgtcttctttttatcgtctagtatctatattcgtagagtttggccgtgtccttttcgtgtgcctcacataatgtgtgtgtaatttgaggtgccaatgaaacggaagtcgcccatgaaaatgaaactcactgttttgaaggaagtggatgagagacgaccgatcattttccgcgatccgttggaaccgacttctcatcaaatggtttggaacctcgattggagactttatttgttggtcgtacaactaaaagttgctgtagttgctgtatgtttttacctcttttttttttgttttcattatttggctggttcatcactctgttttgcctgtgcactcccccctttttttcccttttgttccaaccttaattggaagattccaatcgaatgatcaaactcgtttggatcgacaatctgctctataggttgtttattctatctttttttgttcttatcaaactagaagttctctgttctgtgaacagaatcttgtgagctctaagcctctaaattcatgcccacgattatttttactgagagaaacgattgaactagtttagtgggtccctattaggttatctttttgttcttgtaatggttatggatgagccttactgctacagtttgacatgcagacttgattctatcacctatagcatctgcaataggaatgttgaacacatgtgattattcacatcatattctcctctgtagggacgggcatatgaaaatccattaataggaataacccgacattgttgtgtttcttcgagacgcggaatctaaacagtttgaagtggtttactgaatggaaattctgttgttgtgtaggacagatattggattcttctg

SEQ ID NO: 51819 - DNA, 1501 bp, Oryza sativa
ttaaattgcattcatcaactgcaaaaaccgggtataacaccaccctaacttcaaaaaccggtgtaaattgactccttcgatgatttggaagcggtttcagttgatgtggcaggttgatttggtccaagtgtgatggcgtggtagctcagtcatcaaagtagctgaaaatagagctgaatgccacatgtaagtgacatggtacaagtaaaaaatggtggggcccacttatcaaccacttcttcctcccttcaatctctatctcttcgatttgaggttggacagagaagtagccaagagctctcggatggcgcaaacctcgatggggagaccggaactcatcttggatgtagcggtagcccgattgtgacggttgtcgatgtagccaccatgggcgagaaggatgtagccatggctgccgttgtgcatggcgggggctatggtgctcgatcgatcagtccacaaaagaagtacacagttaccactgtgcaaatgtaacttacaccattattacttcattcgacttaatcaatcggaaaaggaaaagggtaaagggaaaaaagagccggtcttgtcccgtatgatgtaacggtcactactcacctgtacaccactccactcactgtttgtgcttttcctaccctaccacttgctaaccatagttggagcttgtggccacaggatccaacacattagaggttggggaaaaaagcttggaagcaaggaagagcatgccgacgacgtagaggaatagagatggagaggaagatgacaacaatgatgacgataacgacactctaaaacttatagacacgtggtgggtgaatttgccggcttcgatctcatggctgccagatatgatagtggtgagcggtggccgtggattgaagcagctagaggaggggaaaacgataaaggcggctaacgatgatgatgatttgtgggtgcttgagtgaacaaatgaaacaagaagatgatgggaagcatcaacccgatgttacgctgcccctgcacctgcttgtccctcatccctcacctataccaatttgtcctcgtgttttttgcgtttctctcaagcctagctatggaacttattttgcacgagcggtacaacctctagtgcacatatagatacctaaacaatcagtcaatcaccgtgtcatatccccttatacaaaccaccctccatctaggtaaatacacactcctgaagatgcacttaaaccccctagtgggttttggtgattaatgacaaggtggttaaaggggactaacgtgtttatcaagtttatacacaggagtttagtcccaaagcatgttgtgatggctaagaatgcaaggagaccccccaatttgaatgatcctaagtatgaaaaggatcgaaggtgattagactaggttttacactttcaaaattgagtttaggaaaaaccgtactattaagaggggtttcaagtgtggttctagggtatacaaagtgctcttagtcatatccatgagtcta

SEQ ID NO: 51820 - DNA, 1501 bp, Oryza sativa
cagagaagttagtaggccaaggcccatatgtagaaaaataatccatcccacggtaggtccaaagaaaacagtcaaaaaggaaagaccagaacctatttgatcagtgtagcttttcatcttcctctttcccctcatcccgaattcccaatccagatcgaccttccttctgccacacacggccccgccttgttgctgcgcctcacgtccttgcatcacgctccctccatcggcggcagctccgccgacccctcgagcgcctcgaccacctgcacggctctcccgttcttgtcttggtcaagtggtgtaatggtcgggcaggaggaggttgcaggcatggggcaatggatccaggaggttgagcacttgtgctcgatctcgtatatcgccaccagaaaacaagattattgttaaaggtagagctaccatgaatactgattcatttgttgaacacttgagctagcatgtgatttcttggtttgatatggagatacaattgccttcgtggacattttggttgtataatatgtatttgcatctgttcgatgtattggctcgcgagctaaacgagctagctcgagctgagaagcgagccgagctgagccagcattctagctcgttaggataacgagccgagccgagccagctcgacatccactcctagatgtgcgtggttacaatacatatgtatgtacacctataggggaggaggataggtgggactgttcatgtagtgtatggtttgttttcagattaatctaatctaacggtttataatattggactcaccaatttaagtgaaagacttttagcacataatagactagttgaattatctgggcaatcatgtgcctatttgagatagaatttcctgatcaatcatgtgtcttatatatttgtaaaagatcccatttgccgtgatattaacggtttggcttaatttgtttgcgtttataatcatgcacagtgctcaacctggctatggacgacatcgttggaatattgaagggagcagctggtcttgctgccgatgccaatgcgttccgcgagttcttcaactgggccgcaccacgtgtctgggatgccgtacgttctcagcagcagcagcatctgctgcaagtggatccacgaggggtaggatcagcatcagctagagacaacagaatagcttcactgcaccagattgaggccgatcttcagaaactcgagaacgacctatggctgatccaatcaactacatccacaatgtatgacctaatcgatcgtcttaaatggcatagccacaaggatacagaagcctggcatcttcgccagatcaagtatgtagtgtatgatgccgaggacctccttgatgagtacaattactatgctctcaaggtgaaggtggacgcaagcaagaacttggggcaagatcactcgcatgaaacctttttggagttcttggacagtgtcaacttcagtaaagtgatggaaatccaaaatagacttaagcaggtttttgacc

SEQ ID NO: 51821 - DNA, 1501 bp, Oryza sativa; identical to SEQ ID NO: 48224

SEQ ID NO: 51822 - DNA, 1501 bp, Oryza sativa
ttcgttggattttattggttttgaagacttttgattgatttcgaattatatgtcaagttcactgcacagatttcagatgcaatgtcaagtttgttttgtatcagtatgaattgttcaatggatgagaatggaaaaaatgaataacaagctctcaagcagagagactgagcgagattagaaattattgcatatatatttgcattcatgctctgctgatggtctgaaatgtaaatgaaaacttccttgatgaaaatgtattgattatcaaatattttataatttatttgcttccgcaaatttctacttggttttggtaatgtatgacttttactgatctggcaaagagaaagtgaaatactttaggcaaacattttgtctgtgtatcggcgtgctatgaaaaagaaaataagtgacatgaattttgataatgtgttttctgaatcacgcttactagtatgcatcaataatatatgtcacaccttctcaattggaagctagcactagtcatcaactcatgcatctccatggacaacaaatgtttcaataaaaagcttcacctatttttaccgtaggaatatggggcatttttttcactaattaaaaacttccgtaggctagattgatagaaaattatttatttttaacactcgaagtataacgttcagccttggcatagtctgtacatagttgcgatgcaaaggctaaaagttaaactttcattgttaagaaaaatcatgaaaataggaaaaaaattatatttgcatatttgcaaccaaaagaagatgtatttcgtttaggagaaaaggtatcatgagtcatgactcaatggcgcatgtcacatcatacttacaatataattaatcatctaatcaatagtagagccaaaatagtatcattatcgaaatcctaacatccactacatgtagttaactgaacatttcaattcattatcgtatccaatgcagtgcctctagtccaaaacattttatttcttcgtctgaccaaaaatccaccaaaagcagatttctcgctgtctgaactcttccttacagatagttccatgttttggcaactattaattgcgtcattaaaacatgtagatgatggtcttaattttttaagctgtgatttcccattatctcgtagaatttcttagccactattgccaaacaaaatcgtccatcaatcttcatgttggttcttggatcgtgtacattgtattatcatgtcgtcatgtctgcgggcaaggacaaactgaaaactctttccttggcctttagagcctatggaaggacacaagacaaaaacatgccacaccatcaagaaaccgtactgacaagctgacagaaaaaagaacagtatacatgagagcatgcaagaagttctaaatgaatttgcttacttctttctcccagttggtgcacagtgttatggccagaagcaatagcatctgaacgatgagtgcacacattatccctaaccacagtccctgcaagtttgg

SEQ ID NO: 51823 - DNA, 318 bp, Oryza sativa
atgaaatagtttgcacgattaagtttgctctcttctgtttgtgtcaagacaccattttgattaacctaaatcagagttcatttcagtttacattttaataatgttcaacctaagctgctagttaatgtagttatattttgcctcagatatctacatgatgtgaatattatgactagaagagttgcaatgcccgtcctgctcctcatttattttctcagacaatgactagaagcatgactgctgttccccttgttgaatttgttgattaattcaatacagttccactaatcttgatgcgtgccactttttggttgtagg

SEQ ID NO: 51824 - DNA, 611 bp, Oryza sativa
gcatacgtaaaatggagcgactcggctattttttttataaaaaaataatatgatttttaaaatcaactttcctataaaatattttaaaaaaacatatcgtttggtagtttaagaacgtgtgcgtgaaaaacaaggaaggtaagttgagaagtataggtgccgaacccagccttaattatgcaggaacgtgctaagcaaccaccgtacatagcctctaaaattttaggtttcaattcaagctggtacgttctaatatgatttgaggatatataaactcagaccattttataagtctgtctcttccttcttcacttatctcgtttgaaataagcaaattttctgggctctaacaagtgttattagatgataatgacaaccacttcaaataccggtatcttttatgcatgacgacgaagtgaacacacgtttcaatcagcactagagattttatttttacatttacggtcatcaagtgaaatagttggtctacacctgattatgctatacatagtccaaaatgatattcaattactccttggtttaatattattttctaaacaggttttaacaccagggcctcaaatgtttagacacagccctagctagaaaca

SEQ ID NO: 51825 - DNA, 1501 bp, Oryza sativa
tgtgcaggtctgcacatgaacaaatcactgtacagcctgagctacacctgtgtcaccactggcactgctggtttattcttcgtggctatctacctgctggttagtaacaattactcctctctctctctctcttaactgacattgacttttaaatatacgtttggtcattcacttcattcaaaaattttatacgagtataaaaaatataagtgatactttacgggctccgtagcagaaaattatatattctgtcaaagaaaggacttaatgataaaataaataatagttatataaattttttaataaaatgaattgtcaaacttatatccaaaagtcggcagcgttgaacattaaaaccagaggatgtattaattagaactgaagtactcttgaatagataggtgtggctacctgctttcagttcctgactggaaaaagagactaactcaatgcatgttgatacagaaattactactatattggacacccagaatccctgatttaatttattgtgccctttggtaattaagcatgacagctgttttgacgattaataattaacatgaaatcgttttgttaggtggatgtgaaagggtacaagaggccagttcttcccatggagtggatgggcaagcatgctctgatgatctttgttctcgtagcatgcaacgttatcccagtactggttcagggattctactggaaagagcccagcaacaaccttgtaagtgatcacaaaactcctctttaattaccactagtactaatcagttgctttgttcttaatgttttccttatttttgggaatttaatttcagatacttggactgcatcataacatatatttctgttaatctttgaacagctgaaactcattggaataggaggctgatcgatgaatatatatcttccggaagttcatgagaggggataattaagctgcaagcacaacatcatcatttgcagtgttaggtagtctactgttgatttagtttttttttaaaaaaaatggtctacggaatggcatagaaatggagcaaggccaaaaaatcaataaagtcaaccagctgcagatactagattgaagtgattatgaacgaggggtcgatcgatctgatccaatcccttcagattaattggaggaaagaattttctttgaacgacgaagttctatcgatagagtaggaaaatattacaatattacaaccctaaaaggtcgtaactagaaaaacgaaaaaaaatatatcaccacccatacaccgacagcgccaaacacggatccaggagaaggctagcaccggactggccgccgctaagcgtaaccgaccgccgctaagccaacaatagaacacagccgagatcgcctaaaaccttacccttacagccaacacaaaaccccactctatccaagtatttgggatttagggagggagggtcagagagaagaatggaacttctcctcttccctaggccctctgacgtggtcaacttgcagaagcta

SEQ ID NO: 51826 - DNA, 280 bp, Oryza sativa
agcaatatataagagctttttacacatgatattttacacacttgacgcagaggattgcaatagcctacttagtggtggcgctttgcgaaatctggctaaggagggttagtagtggcggtaacattggctctggctctatgttaataacaagataccatcatcagatgtgagcacactttacacaacttgctaatttatcagctattgttaactgatcttaaacttaagaaatttctcatgcattacatcacatgttgtccttttccttactttgcaaagg

SEQ ID NO: 51827 - DNA, 1501 bp, Oryza sativa
atggatctatacggttatgattgagttgccatcttgtcaacatactttggtagatggttggtctatttgggtaatcatttatgttaaagcgaaagaggccaaagaatcataggtgtacactgataccaggaaagctggaaaagctattatagattaggtatggcatttatatgttctccattttcttcatctgaatgaaattgtgtataactgttggcagtgaaatttggcaagatagactcggatttagagttggatatcaaagaggaatcgaagaatattgaatcttgccaaatacggattgcgcatcggcgggaaacagagtcgaagtctgattgagctgatatggcaagcagtcgatatagcctgacgtagactcggtatgggccttgatttagatatctgtcattgccgtttagagacagagctcgtttaaggtaattgtatctattaattaggatatttatgtcagttttgagttagagatttggtaagagtccgctgtgaggacttgttagtattttatctttaggaaagtttgaatcgtgcccataatggacaagttttgtactcaggatataaatataaaccccaaaccattgtaataagggagacaatccaatcaatacaactttcgacgcatcgccaccctttcctttacttttcgacaagtttttgcttccagtcggggcatcggctgcgatctctcgacaagaggtaacgacctgcgctatcggggctattatgtcactttagaagtattagttcttttatcgtgaccattgctatcatatatcttagttaatctagtcttagtatttcaatttagtcatatcggctgattctcactttagagtttatgccggtatcgactaaattactttactagattagattagctaagatacccaccatcctaaaaagtggttaattacttgattgtttagactttatgcttctttgcatacttatgcatcaaccttagtcgtgcttagaatctaaaaactaacctggaattaatcataattaaggatagtattggggtttcggctgatctttcctaatataaacgatagtacatgtttcatgatctgtttacgtatatatttgccacttatatagatagattgctttatataagtacatcaagttagattgatcttgcttaaacttcatatatggtgatcgattgctatctaatatatttatatagattgatttgttcatataagtctgtattagagtattagccagtacattatctacttttgctgtaagtactgatccatcggctattgtcgatgtttgatgttgcgattccggtatttgcatagtatagggatcgttggtactaggatatatgcgagacttaggtaaaagagacgaagacgaggatttttatacaggttcgggcccctgaattgtcaggtaataaccttactcctgttggccgaagccggtagttgctcttattcaccataatcacaccagtacaatattt

SEQ ID NO: 51828 - DNA, 1501 bp, Oryza sativa
ccttcgccaagctggaggacatggtccggcggcctgcgtacacgccggtggaggagtgcttcctccatttctcggcggagagcgtgaggacgctgaaggagaaggcgaacgccgagatggccggcggcggcggcggcgccgccatatcgtcgctccagtcggtggtcgcgcacatctggcgagccgtgtgccgagcccgccgcctcgcgccggagctggagacgaggcacggcctctccgtgggactgcgagcgcgggtcaaggaggtgccacaagaatacatgggcaacacggtggtgggcgccgtcgcgagggccaccgccggcgagctcctcgagagagggctcggctgggcggcgtggctgctgaaccgcgccgtggcgtccgcgggcgacgaggcgagcgtgaggcgcacgctgccggcgtggccggagacgccgaggttcgtgacggtggcgagcctgcagaacgccggcgtggtggtgatctcgggctcgccgcggttcgacgtgttcggcaacgacttcgggtgggggaggccggtgggcgtccggagcggcgccgggaataagatggacgggaagattacggtgtacgagaggcgaggcggcggcggcggcatggcggtggagatttgcctggcaccggaggcgctcgcgaggctggtcgccgacgaggagttcatgagcgcggtgactgcgccgccgccgacacatcactaacgtcagtggcagaatgcgacacatggttaatcagtaactccctccatcgcataaaaaaaaaatttaatacggaatgtgatactccctctgttccatatatagatggtgtctttttcctatgaaagttaagttttttacgcaaaacaacgtggtattagcgtacaattgattgagttttaattactaaaaatttgaaaaatagattaatatcatattttagagtaattttcatatagaaagtttttacgcaccgtttaacagtttgaaatacgtgccacaaaaatcttaatcttcatataactcttattggagaaaataacatgaccatataaaggatttaaaagagatatgatatattctagtactacgaatttgaatactcagtctgtctagattattgactctctcacgtcatctatacagtctgatgttcgtagtccatctccagtgtgcctggaaacaaatcgagagaggcaaagaatgatatttggttggatttgtacactggagcaaccgaacaccaataaaacgcaaatttcttcggttggaacaagggggacaacaaaaacaaaaaaccaaagtagttcaagcagcattagctagcaaccacacctcagtcctgttcgtggtggggagccgaggaggaggagcagtgcccggcggccagggatcgaggcagggagccagccagccaccccaaccgaggtagccatggccgtgaagcctgctgctccccatgactgtcgccgtcggatcgagaagctccgccgctcccatgg

SEQ ID NO: 51829 - DNA, 687 bp, Oryza sativa
aatcggccgaccgacgaaagatggtttctccaccagtgtgatttttttcaattatgtaagaatgctactcgaatgataattctatggtatttttgtaattttttaatagcagtcttgcaataacgtggaattcaaaccaatggtaaatttgtaattgcgtgtgtttttgatacaggaattttgacaccactactatttagacccatcactgttctcttatttttatcagttagctcttttgtggatcttcttgtgtaaagtcaggtaagcttcctcggatgccctttatcaattcattcattcatgaatgtactcgtttgtttttcaaaaaccacacaaatcgtatacagctgtacatcgtatatggatttttccccatcaagcatcctctcgttttcttgcattttatctagatataaaaaatatattataaaaaatatgagatatatcagttcacagatacgtataattaaattggatttctaccagctgtaacaaaactctaactaagtatccgtatacatggttatgtttgttaaagctaaatttaaagctgtatattcgcggagtgatatgccatatgctttataaaaaaaaatataaatattcaatgcctaaaactcgatcttgttcatcgaacacgtacgcaccattagtcgactgagctcgagagctagtcgagaatgg

SEQ ID NO: 51830 - DNA, 1501 bp, Oryza sativa
aggcaccactttttgtaagcaaaatgttaatatattgtccaactagtaataactataatgataaccccatgataccatgctatggacaacttcatttcaaaaggtaagagtatggaataaagctgagtggtgagttaagtatatggactgaatgggacagctattagtggccccttttcttttttattttaattttcttttttgtccttttggcacaacaatggaacatcctgggtaccttttagtaatttcccagaaggttagctgagcacttgtgcgtggatgcagcgtatggccccaaaagtgagttgagccccttcttctacataaggaaagaactaactgaaatttggggctgtactcttctaaatttcagttagcgctcttcgtttaatttttgggagacgaaatttgtactctatctggaactagcgcatctgcactctctttcctgtgatcctatctaatctctattcatattgatctaacatttttttgaacaaacatgtgattgctttgctcataaaagacatcaagaagagcaagatcaagaagaggagctagctaggtagtctgatcattgggtagaaagatttgtgaaacaaattaaggacccaggtacgtgatccaattatttcccttctttactccagcttggtatgtttggagtatcagatatactacaattgtcagcagaaactgttattttccaattgtagacaaagtctgcatgttgcaatttcttgtgttcttggtcgattttatactgtactagtaagcttagaacaaaatttcaaactgtgcttgctgtcttacatgtttctttcactacgactagtcgaacttccagagaaattatgtgcctatttgagatatagttgtatgaaatacaattatacatttagatgtccaggcagactgcatgttgtagccttttgtgttgctcttcagttttgtactagacaagtaatgttagaacaagatttcaaaattgtgtgttttgtcttgcatgttgctttaaccaaaactagtcgaatttcctgagaaatcatgtgccttcaaccactagatacagtagacccggcataatttgctagactttaaaagcaaattgttttttgaatggtagatagataggtgttaggtttgccttcaaccactagatacagtaaatctagcttttccatgatgcatctctggaactcttaacagtttagcacttatgatcatgcagcagtgctcaatctggctatggacaaggtcgtcggaatattgaggggagtagctggtgttgctgctgacgccaatgcattccgtgaattcttccactgggtcacaccacacgtcttagctgccgtacgttctcaacagcagcagcagctgctgcaactggattcaggagggccagtatcagcatcaactggaaacaacagaacagctccactgcatcagattcaggatgatcttcagaaactcgagcacaacctttgggtgatccaaa

SEQ ID NO: 51831 - DNA, 1501 bp, Oryza sativa
agttatgttggggatcagggagaatcatctcggcaaactctacatcattcacttatatcataatgtttgaagtttagtaataaactttgttattatatataggagagagccaaaagaaagtgcagactaatcagaccatgggtattggctaggagatgagaatctcaagagctgaatttgtgggtgtacaattgtgtattttactggatgataccccatgcattggtgtggagatttacgtgaaagactattatatatagagggacaaactttataaaaatataacggtatcatgatgaataactttgaatcactctattaaattttgtaggatgcagttttatttcagcccacggtggcttttgttgtgtgttggtcttagtagaattgtatcagggaactatagcctacgtacataaccgaagtatcttaaaactgctgagatgaaatctgtatgcaatggctcatgtattcttgataatgatatggcgtgctttatctaaaggctcctttatagtgttaattgcagttagtggatcagacaattatataggaagaaaggattacggtgttagaaaaaagaactctttatctctgttactgagcaattgatgtggagcacttagaagttggcagtgtagattttgatgtattgcctgtcagagctcgtcagtatgcaaatattagattgaactgaaatttgccaaaagggtttatattaagctgtaaggtgagagacatcagtaaagatggccatcattcatgggctgtggatgataacgaggagcatctggctccttttctgccgatgcgtttgctctacttgttgtcagtgctctattgtcttgaaatggcgtccgttgaaacactaccacatgacaacatcatttagaaatagagtaaatttcaaaataactcaggttgtaaggcatatgcatatgtaaagagacaattgcttatgggactagagagagtacatgacaacaataagcaaaacatacaccctccgttctaacatttatctagattcatctgcataagttattttttattagacgaagggagtgcatgacaacaacatttactcatttagaggttgtgtggccgaaagatttatctatttgtcactataagaaacggtcattctccaaatgctactattaaaattatcattacatttttttacactggagtgaggagaatgttttttttttttgctactttcgcatatatgggtgtgccaacgggggaataagtacactttgactccctcaaatatacaatcaatttaatttctatccctcaatcacaatagcaaatatcttaaacccttacggccttaactattaaaactggtgcaaaataactttctcggtggttataaagttggttttcattggcatgactcgttgatctagtccaatcgctgagtcggcatgtatggacccacatgtcatcatctctctccttcccttcttcctcctccccctctctctccctt

SEQ ID NO: 51832 - DNA, 434 bp, Oryza sativa
tttaaaaaattcaccagcgtcaacatttttagaacatttttaggatggatggagggagtagttaattattccgggaatacaacccagccaagcaatccggatcgtcaatcccaaccagacggctgatgatcccccaaaccagccaccaagctcttgcttctgcccacacgatgatcgtacccattcccccccccactgacagtgggccccacgacctaggtttttcaccttcttcttcccctctcatccccttcacgtcgcgtcctgtcctcccaaccccttcttccctccgccgctgccatcaccgccttccccccttcgaatcgatcgccggccggccgccggcccggcaccgatcctcctccggtgtcccatgccccggccagatccgcgggattcggggggtgtagcggtagccttccttcccggtcgga

SEQ ID NO: 51833 - DNA, 578 bp, Oryza sativa
caattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaacttatgtcactcatatgcatgtttggaaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcagg

SEQ ID NO: 51834 - DNA, 200 bp, Oryza sativa
tattttttatttttcaaggtctgacttttaatcctctgtaattaaaccccaatgatgtaatttaaatccccttaatcaaactaggtcctggcggtattgttttatgttctcgctcagttgttctgatatagaaaccaagttttttataaccattttgcatctgaaccaagagtctgagataaaatgtgtgatgagtataa

SEQ ID NO: 51835 - DNA, 1501 bp, Oryza sativa
tttatattcctatcctctttttctggaaaccgacgtatcgacttagagcaggtgcaataaaccatcgcggaccggtgataagaaagccacgtcggttatagtgttgagttggaagggagagagaacgtgagcaggcgactatttggcttcagcacgcgctttctggatgaaagcattgatgaggatagaaggagctaaaacatcgtcgcggagtcgtcgtcctccagctcaattccgtcatggcctcgagctcagcttgctccaacttgtggcctcacctgcggacgcttcctcgcccatgaagctcgagatcctcggtggcggcagactacaggagctcgagctcgaggccattttggcgagacctgccttgaacgtggcgcagtgctgtgtgtgctggtgcaacagccgcatacaagggcaacaagcctacaacgagcttgggagcaagctttgactgttggatgttgcatgcttatgcttatgttcgtacagaaaaatcaaggaaggggatggatgaagggagaagaacatagaagaaagaaatggatggtgcatggtgcgatggtgaaagtgataaggtggagagagaatatcggtgtgctcctgaaaatattatttattctccagctcaattcggtgggccatcctttatagctaagttattatatgcaggctataagattacttggacactattgcagccggtaatcggcgatactattaaccttgctatgcagtagtatttgaaagtatttaaaagcggaattgttgcatttctttagacaaaaaaatcgaggagggggagaggaggggagaacggatgtgtatggcatggcattactcatggattaaccaataattaaccggatagccataaaagctcacacacttgttgtgaaagcaaggcggagcatcgcgaccatccgtggttctctaaaattttgaccataaaataggtgttttatgaaatttatttttttactagtacaaaacatgtcttaccctagagtttcttttaattttttgaaccttttaattttttaaattttaaaataaactcatgaaaattcattttcaatatatgaacattttggccacgccaaccaaactggtgtggtaaaacaataccgtcatgctgctccagcctccaactagtgtggcagcgttatttggccacatcgctctcgctagcacggtaggataaaacggtcacatccgctgcagcctgcaggtagtgtgctagtgttgttttgccatattagacgggattgcttgactacaaggatttagattttaaaaataagttttaaaagattttattttggataaaaattaaaaaatcaaccataaaccctcctaccaatcaaaatttttattgaaacaaacccactcaccccagtcccgtgtattccccgctcttccgccttccgcgccaccaacccgcgaaccctaaaaaccctagcgcctacgcgcaccaatccaccggagaggggaggcg

SEQ ID NO: 51836 - DNA, 1501 bp, Oryza sativa
attagtccaaggttatggaataggttttgtaattagtgtatgtttaatactctaaattagtgtccaaacatccgatgtgacagggacttggaataagtctctagaaaccaagcaggccctcagtaccattgtaatggtttactgttagccaagttgcccaaaggtggttggggaatatatcatttaataatttttccaaggctacagtgagtaaagtggggcccacaccctgacaaacattcatccaagtcaaatgtgggaacactcatgcattgatgaatatatatcagattcccaatttttcactgggcacagtacattttgcaatgcagattgccagatagtagctaattttatactgtggttgtgtttagttccacgctaaaattggaagttcgaagaaaaaagttagaagtttatgtgtgtaggaaagttttgatgtgatgaaaaagttggaagtttgaaaaaaaagttgggaaataaacaagagctatatttgttcatatttttttatggaatgttcttagcccatgaaaggagaggttggtgcatgtttgacacctaagagaaagcgatgcttccattgtcttgcctgctttaagtaaagcaaaggaaaaggcagcaaaggagagaaaaaatggattaagtcaaatcataggtagaatgaaaataaaatggatatgtaaccactacagatcttgataaatatttgataaaatgtatagtaattagaagagagttttagcacattatacactcatttggtaaataaactcatcaatcttgagatgatttatgcgtattctaaacattgtgtatagattaattgacaccaaatagtatgcatacttagtattctctctgtcgcttaagtaagggaataaagcaaaagaaaccacaacatgttctaaacaccagatcaaagtaatataataaatgaagcaactgtagagcatacaatgtgataaggtgttgtgctctaccaccacctcacaaattgtatgtctattgattgcactgcaaacattgacctaccagaaaacaaaagttgtgttttttctttccttcctggaaggtgaaaacaacaggtttgttacactcttgtagtcttgctttagcaaatcttaagaatgaaaaaagagaagaaaaaaaaagcacaggcaaagaatgttatcacaaaaagggcataattacaagtaaaagaaagttaaccattattttcctatcataattcaagttctgaataattataaaggggacaatggaaggaaaagagtgcactgggctcccatctgaatgtccttatgccaacctccattttccagctcaatcttttggagagacccttgtctctttgcctcatatttgtgccaccccgtgatgctcacttgctcagcgacagtagggcagtagtagacgacactaagcatatgattccctcacaaacccccaaaaaacatatattatttggccacatttcatttcactcgctggcatttca

SEQ ID NO: 51837 - DNA, 1501 bp, Oryza sativa
tgtaggccatgggtttgaaaaaggagaatgacaagtaaagaacgacaagtagggcattattttatacggatgtcgtgtactagtctgaaacaatttaggagtattattcaattggtttgaaaattacaaatcggctggaattgcgaattctcaaaaggccaaaggcgtttgtgcatatggtgtgtttttgttttgctataaactagcgaaatatccgtacattgcaacggataaaaacaattttaataattattttgtcataaggcaaatcatccgttttactcattgatatttaataaaaataacgtgaaaatatttagaaatacatcaataacattgattattaataatatttttcctttaataattttaacttgcattttattatgttatcacttatatataaatttatatttttctttaattttatatatgaatcgtacttaaactttataaaaaaaattgaattcacattgtttctaacattctattgttattagatttgtacttggtatataaaagtatagttgatttgaatttattaattacctaatttaaatatatatatatgattagtctaaatttattttaatatcaaaaatattaaaatattatagatatatcacaatgttttagagacgggaagacaaagtaagtttgatggtttcaatttataacttgataaagaaagaatgctaaattagattcatgccaagtggcacaatgtcttttagaaaatttataacctaataaagaaaaaaaatgtttaattagattaattgcaagtgttacagtatgtcttttagaaaattttgtggaataaaaacttcttataagaatataccttaataaaaagctattttgtgtgactatgagtagtttgtggtatagattcttcttaagaaatttatatgagtttggatgagtacaaattatgtgagcttacattttccgttctaatgcaactattctaagagtgtttggatgagattcagtaaccaaattacatctgctaaaaacaaaaatcaaaattaacaagttgaaagtaggtggaactgggcagaggcagatctaaccctgtttcggttgaaccccgaaacttttttgagggataacgcagaatagctgatgaggtgtgggtagggagggatgctcaccggcgagcgacgatgcggtggaagcaggaggacgccgggcgccacctctcctcgcaggatggggatcggcgcaagcggcggcgaggagacgaaactcgaggccgaggccggatgggatggattaggatgctcaccggtgagcgaatgcggcgggagcaggagaacgccggcgccacctctgctagcaggatgccagcgggaggcgagaagacgggagtcgagggcggcgggcgaggagacgggggacggattggggaggcggaacggaggtcgtgcagcgctctgctgccgtatactcatatgcactaggctggaatgttttcatctccccaaaaagttcatct

SEQ ID NO: 51838 - DNA, 1501 bp, Oryza sativa
tagtgctagtgtgcctttctacattttgcagtttcacagtgatggatatataataggacatgacccgatacatatagctagaagataattaattaattagtgctaatagtatatacttacggagtgaagtctgacgttgcggcaagtcgatcgaccttggcagttgtactgaataaagcatttgtgttggcgcctctaacacaagcataggtgttgatcacgcgattattggtgtgatgaacagaggacagcccagttgttggcaaggtgttgaagttcctcgacgcctgcattaggcaggataacaaatcaggacaggcaattgagccaagtttttttctttgcaagtacatgaaatatatataagatataatgtcttggcattgtttagtagtccctccgtttcaaatcactttcgttttagctgtgtcttagatcaaaacattcctaactttgacaatcaatatctaaaaattcatatagtttggcaacacgtgaataatatatattgtgaatatactccatccgtttcacaatgtaagttattatagcatttcccatattcatattgatgttaataaatctagacatattttatattgatgttaatgaatctagacatatacattaacatcaatatgaatgtgggaaatgctacaatgacttacattgtgaaacggagaaagtatttcttatggtgaatctaaaagcataaatcttaagatgttaagctagtcaatgttaggaacgttttacttacgaaaaatccaaaacgacaaataatttaaaacagaatagccatgtcatcctgtcacattatgaattagcgtcctaaactctttagtaaaaggcatagattgagatgcaagatatgaagtataagtaactactcttatattcaatttcattatctaaagaaatcacacttaactgaattgaaggatgggagtaggatgggagtggtacacgaacctcagcagcgccggggaaaagccttggtcgattcggaagacaaatgagaggctaatttacggaacacgaaacgaccggccatgtcggcgatggctatcgatctgatcggctgatctgtggtgatgtgagggttaaaattcctcaaaaacgggggacgacgcacgaactgattggattgaggccctccctataaaatggagaggcgcaatcaccttgaaccgaaaccgaagctgaatcagccacgtaagacgacagtggagatctattcctttccaatattacaacaactcggaatacaaatccgattccaaatgattgtcagcataaaaaaaataaaattcaggatatacgacgaagggggagaggagcttgttccacatcgacccggccgtacgtgctcgacgaagggtggaggtgcggcgcctcctcgcggcggccgggcggcagacccgcggcggcgcggtggcggtcgccgtggacggactgctgttcgagcacctgctgtggctgcaggcggccagaaacaagg

SEQ ID NO: 51839 - DNA, 1501 bp, Oryza sativa
tgtttgttgattaattaattgtagccttgtttaattaattaattgattgtagctttagagaagttttctctgtgtgtatgtttttttaatatatgaagaaattggtttttgtaatttgttttgactattcatttttcttggaaatatttatacacagatagatagacaaacataccagtttaaagtaattttgatgacagatctaacagtactattttcaccttgcttaagtaaaccaagtaataattgaaattgatgacaggcaacgattatttgcctacttctaaacctgaatactgaaattccaattcactttatgtatatcctgcaggcttggtaaaaaacatgaggacttttctttagataatggaaatggatacatcttcgaattttttcaacagacacgcaaccaatttgtactatttttctaaacaaaagtcattgagttgataaagaaaaggaaaaacaatattgagtgatggaacaattccccaacttttgtaaaacatgaccatttgaatcaaaatttaagtcaaatcatataaattctagcactaattctgtaggtactacgctatccaaaatgaaacaaaagtctcctggcttctaattttaagagtgtagcaccattgcgtatgatatatgaccatctgaattaaaaactaagacaaatcatatagattttttgcactaattctataggtactgtcctatccaaaacagaacaaaagtctcatgactatttttaagattgtggcaccactacgtatactatcctagttgaatgtatggaaaacaaaacacataaattttgccaaatgccaccaagtatccatgttggaatcagccacctatatatactgagacatggacacttaaaatggaatcagccacctatatatattcaattccctctacaacaaataatctctgttggatcagtaacttggtttgctgacaaccgatcaagccggccattgacccagctaattcatcaggaaaacgtcgacccaagcaaaaaaaaaaaagaaaagaaaaaaagaaaataaagaagaagaaaaaaagcaaagagcgagttagctactagctaggggaaacaacaatgtgccagtcgtttcttccccttggcttcagccataatacgtacacccagccactgatagcaccaaagcatacacaagattaatttaattaattgaactcttcacagacaaataactaattaatattaattgcctccatatcatgcgccacctggagctagcataccatctgctgcgtcagctacctgcacatcgatcttgctatctcgacctgtcatggaataatattgatcttaatttacctctgtataaatagatgtgatcatttacactcttctctccaagacattgaatcctacagcttgctaataaagctctgatactaattaagagctgtttagaagcagaattaagttgatatataagttcgagcaagctatctccaaccgcaagaccaa

SEQ ID NO: 51840 - DNA, 1501 bp, Oryza sativa
atggaagtctctacaaccacatcaaagaaaacaagctatggtaaactatagtctccacagatgaaacggttgttgcaactcgttctcacctgcaataaaaaaaataacaaaaatgagcaaataatttacatactgagttgatttttactagctaagggttaacaactcttaccaccctgaatatagccaggcccccacgaaagttaccccaggcacaccacatataaatccacagagaatcttgcgccatgtttttgaaaacacggaagtcatagcgaagctgaataaaaaccatacagccgtgaaggttgtaatggcagcaaatctgctgtactggaatgtggcggatgacgtgcctagtaaaccagaaacagttcctgtgcaagctgcgaagaaacccaaagaaatgctaccaaagaccacgcccatgacccattcaggagaatgtttcacgaggtgataggccgcatatgaccctggtagtgcacctccaatgaacggtgcgagaaaagggacatacttcgcctacaataaacatcaacaaacatggtaatttgatactatttgtagtcatgaatacaataaacaacaaatctttgtaagtaacaaactatgaatttggtataaagcatactaagggggtgtttttttacgatgaagggggtgtttagatccaggggtgtaaagttttggcatgtcacatcgggtattatatagggtgccgcatggggtgttcgggcactaataaaaaactaattacagtatccattagtaaaccgcgagacgaatttattaagcctaattaatccatcattagcacatgtttactgtagcaccacattgtcaaatcatggagcaagtaggcttacaagattcgtctcgcaaaatagtcgaaatttgtgcaattagttattttttagcctatatttaatacttcatagaagtgttcaaacgttcgatgcaacagggtgtaaaatttttgggtgggatctaaacaggccctaattctaattgtttaaagaagatgtaaaatagttgggatctggcactaacatgtgaagtagaatcaccaccagctgcttgtatcttcatccgtgcacatagaacccctgctcttgctccagtggcagcggcggatagcatgtaatcaggacgatcctgtaacagcacatcaattggaaaaagggagagaaaaggtcagtaataagggagaattgcaaatcaactaaaatcaacttttggtgcattggctgatggatgataaccagaagatgaaatcgagaagcgttgctggtaataatccacaatcacttgttattcagagggttgctaactatatgcaagaacttcagacaccttgggatcctggtggcatggcaataatttgcatcgacttgaggacaagtcgaatattaaggagaggggattgttaggaacacagttgggctgcagatgggataagttagtcatgtttcaatcctggcccacacaagcacaacta

SEQ ID NO: 51841 - DNA, 1501 bp, Oryza sativa
ctccgccttgctttcacaacaagtgtgtgagcttttatggctatccggttaattattggttaatccatgagtaatgccatgccatacacatccgttctcccctcctctccccctcctcgatttttttgtctaaagaaatgcaacaattccgcttttaaatactttcaaatactactgcatagcaaggttaatagtatcgccgattaccggctgcaatagtgtccaagtaatcttatagcctgcatataataacttagctataaaggatggcccaccgaattgagctggagaataaataatattttcaggagcacaccgatattctctctccaccttatcactttcaccatcgcaccatgcaccatccatttctttcttctatgttcttctcccttcatccatccccttccttgatttttctgtacgaacataagcataagcatgcaacatccaacagtcaaagcttgctcccaagctcgttgtaggcttgttgcccttgtatgcggctgttgcaccagcacacacagcactgcgccacgttcaaggcaggtctcgccaaaatggcctcgagctcgagctcctgtagtctgccgccaccgaggatctcgagcttcatgggcgaggaagcgtccgcaggtgaggccacaagttggagcaagctgagctcgaggccatgacggaattgagctggaggacgacgactccgcgacgatgttttagctccttctatcctcatcaatgctttcatccagaaagcgcgtgctgaagccaaatagtcgcctgctcacgttctctctcccttccaactcaacactataaccgacgtggctttcttatcaccggtccgcgatggtttattgcacctgctctaagtcgatacgtcggtttccagaaaaagaggataggaatataaatttagtacttggacccaccgcaggctgcccacgcccaaaccacttctactcgtagtgttctcacacaccactgacctgtgggtcccgcagagtcactcacaccacacgtggaccccatctatcagtgataggaactcacctttccccgcacatgcgggtccatggtagtagtctgtccccacatgtcagtgagcaaaacgtaaaggtaaaatggtaccgtcctaccgggtgcggaacgacaccacacgagcacgtcgcgtcggcaggtgggtcccatcccccgtgggccccacgtgtcatccacggtgaggcagatccgcgcgtggaaacgaagcgaggttgcgggcccacccacgggcgtcgtgggctcgtggcctctaccctttttattttatttatttatttcatcgcccaaaacacccaacttttctcacgcgcagcgattccacccccaccgccacccgcgaccacagactccacgattctctcagagagagagagagagagagagaggggactcagcgagcggtgggcgagagggggagatcgaaaccctagctagggtttgcgcgcggcggcggcgggga

SEQ ID NO: 51842 - DNA, 1501 bp, Oryza sativa
ccccagccctcgcgcgtgcaagtgaagacgacattgcaattgtagttgggacccgcgccgcactccccgcgcgcgcaagtctatgatgtgagcgctcccgaccgttgggagccacgtcagccgatggcctccgccgtcgagcttttccccaccgaccaactatgttacccagatacggggatacggatacggatacgcgatacgtcgatacggggatacaccattttccagaaaatatagatacggggatacgcccatatatatttatatataagaaaattattaattcttgaaagaaaatagccgattacaacgtagcaatcttttgtaatgatctcttgtagttgattcaggtggagactagttgagaaatagcaccagcagtaaacagatatccatcgattaaaaaaactcagtgtatttcagcatactctgacttttctacttcttctctaacacttaaacatatcaccacatcccacaacggcttcttctcactatcatttggatgaatgatgaatttgctgctagattagcaaccgcgctagctctagatgcattgacacttctagtcacaataatcatcagatctataaaatatatatatactcaagcatcgaagaggccaacaagaaaacaggaaaggggaacaagaatagataaaatcacatgcagactcaagcatcgaagaggccaacaagtcaatcgttcaatggaacttgcctaactggggaacgaaggaatcaagtcagtggctgcgacggcggcgatgttgtgccatgttggcgttgcgtccggtggtggaggcgatgaatacacccagacacagatatgcattcagcgcctgaaggcccggcatgcagctacggcgccagcggcgttgcgctcggcgtttggtggcggtgctgagttcggccttcggcatggtgggcggcggcgccgatgatgggaaagtgccgcgaggtggtcggcctcgggcgagaaaagtggaggcaacgcgttcatccttactagggatgaagccatacggacgtatcgagaacatatctgatttattttaattattcgaaaattgtgaaaatcgctgatatgtacgggatcgctgatacgtatcggatagtatccgtatcccttcacgtatccgatatggatacgacgctttctggacgtatccaggtaatgtagccgaccaacacctttctccccaatcattagcggatgccctgaaggtttggattgagatgagagtagagtggagtgaggtggaagaagattgccggttgacttgtgaggtctacgttggactcagccgccacgtcaacaaaactggaaagcaatcctaacttgagataaaagtgatccggttttaaaatattagagggttcaacgacaagaaaagggaccgtagatgaactttttggggagatgaaaacattccagcctagtgcatatgagtatacggcagcagagcgctgcacgacctccgttccgcctccccaat

SEQ ID NO: 51843 - DNA, 1501 bp, Oryza sativa
tgagtaaaacggatgatttgccttatgacaaaataattattaaaattgtttttatccgttgcaatgtacggatatttcgctagtttatagcaaaacaaaaacacaccatatgcacaaacgcctttggccttttgagaattcgcaattccagccgatttgtaattttcaaaccaattgaataatactcctaaattgtttcagactagtacacgacatccgtataaaataatgccctacttgtcgttctttacttgtcattctcctttttcaaacccatggcctacatgtcatcctctacaaggcattctctacttgtcattctcctttttcaaacccatggcctacatgtcatcctctacaaggccaaagaaaagtgagcaactcatccttccttccccttcttctcatcttcagcgaggagcggagcaaatcctccgccgcctcgcgagctcccccaccgcctgacctatctccggtcgctggaatccgagatcggcctccttctcgaatccgcccccgcctgtacagtcgccgacggccgccccagctgatggttcgccaccgccccagctgatggttcgccttcactggaatccgagctgcttgaaggtgcacctttggccttttgagaattcgcaattccagccgatttgtaattttcaaaccaattgaataatactcctaaattgtttcagactagtacacgacatccgtataaaataatgccctacttgtcattctctacttgccattctcctttttcaaacccatggcctacatgtcatcctctacaaggccaaagaaaagtgagcaactcatccttccttccccttcttctcatcttcggcgaggagcggagcaaatcctccgccgcctcgtgagctcccccaccgcctgacctatctccggtcgctggaatccgagattggcctccttctcgaatccgcccccgcctgtgcagtcaccgacggccaccccagctgatggttcgccttcactggaatccgagctgcttgaaggtgctcccgttggtataccttcttgcttggttactgttttgagggtggctcttcattggtggttgctgtagaatgttcgtgctgcttagaaattggatatgaatttactgaattaccgatccgggtagttcggcttgatggcatattaggtttggtgttatgtttatgtagatccagctactgaaaatctagttgagtgactgcgtggtgggtgtagatcataccatctcccccaatccccttttaaagaagtgacagtattcgattccaaataagcaaagcaagtagttgtcttttcctgtcagttctaatcgattcatcgaggagaaaataatctttgattttgtgacgattccagcttcagaggattatagtgtctgcttcattcggaggttcatcgtcgccaaaaataaataaaatttggccgtgtcaactctacaattaggaaggtttcggatttctcaacgtggaatgataagaaa

SEQ ID NO: 51844 - DNA, 1501 bp, Oryza sativa
taggcacaataaaaaaaatatcatcagaatttacttgtgttttttgggtatagtacctttgctgaaaagacacgataatttcctggaagaccatcatgctacagctgtatgtccttattaatttggagaaaacaagagagtagattaggctgcagtatttactatctactatattgattagaactttaacacatatagccagatttgtcatttgtgatttgatcccaagatgcatatttataactcatagaagtaattaatctatgtatggaacaccaccttatttctatttcgggagggattatgaccctatacacataactaaatcgatgcagttttagagagagagagagagagagagagagagagatcaatttggcgctagatccggcggtggctggagcagggttcactctatcggttgaggtgtttgtatcgggggtcaccgaaatctgaaaatttcggtccgaagtttctaaaattttgagcaaaatttagttgaatttgaataaatattactcaaattcatgaaaaaattaaaaaatttcggtcaaaataatatcgtatcggaagtgaccgaaatttcggtccgaaatttccaaccctgggctggagtcgtcctgcaagtagaactcgacgatctccgacaggtcggcggcggcagattcgtcgtcgtcgtaggctcgtatctcagcatccccttgtttctggccgcctgcagccacagcaggtgctcgaacagcagtccgtccacggcgaccgccaccgcgccgccgcgggtctgccgcccggccgccgcgaggaggcgccgcacctccacccttcgtcgagcacgtacggccgggtcgatgtggaacaagctcctctcccccttcgtcgtatatcctgaattttattttttttatgctgacaatcatttggaatcggatttgtattccgagttgttgtaatattggaaaggaatagatctccactgtcgtcttacgtggctgattcagcttcggtttcggttcaaggtgattgcgcctctccattttatagggagggcctcaatccaatcagttcgtgcgtcgtcccccgtttttgaggaattttaaccctcacatcaccacagatcagccgatcagatcgatagccatcgccgacatggccggtcgtttcgtgttccgtaaattagcctctcatttgtcttccgaatcgaccaaggcttttccccggcgctgctgaggttcgtgtaccactcccatcctactcccatccttcaattcagttaagtgtgatttctttagataatgaaattgaatataagagtagttacttatacttcatatcttgcatctcaatctatgccttttactaaagagtttaggacgctaattcataatgtgacaggatgacatggctattctgttttaaattatttgtcgttttggatttttcgtaagtaaaacgttcctaacattgactagcttaacatcttaagatttatgcttttagattc

SEQ ID NO: 51845 - DNA, 1038 bp, Oryza sativa
tcgaccccggtacccgtgtaccggtgtcggtagtcgttcgcttgtgcgtgtggtgaccgtgttagtgtgcacgctcggtagccacgtggtttccacgtgtgcagcccgcgcggtgtctagtggagtccgtttatcggccactcgcctcggttgacacacgggatccgcttccatcgacccgtggaccgtctctgtgtacccggtctgccgtggtcccttaggttgacatgtggggtccgcatgtcaacagcgcagccttcctgtcttttccaggctagcgcttacacatgttttatagttgcaaaacctaattataataatccgcaaatctccatataacagcattaaacttcggatgaccatgtcttggtcatacgagctccgaatcgatccgttcaagtctcctaatgtttgttataacctaaagaaccctgtgctttgtttttatgtattgttattgcttctttataggcttgtagctttgcttgtgtgcttcgcgtagcttctgtcgttccagaggttcccgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaaaaacaccccaactagtgggtactctattcatggttccactagtatgaatttaggtagatgcttcgctgattaattaggcaacattaggtggttttataactttagactttgggaattctcatatcatttggacactatggaatgtttggcttatgttggaattggacacacatctccccctctattcaaaacccccaaaatggttttaggctgggctcgaggtgcgtggttgggttttgttagtcgtacctcgggtactataaggattaa

SEQ ID NO: 51846 - DNA, 1501 bp, Oryza sativa
atttaacaaaaaagggctccaaaggccaatcgtggtaatgacatatcctactagtaaaggacacatggatcatccaatagaaaccaatttattccatcgaagtgctcaaactctctccattaccgccaccaaactcacctccaaagccactactcccatcaaatccatcattgagggcagccacatttgaagctacaatatgtgccctcatagccaaggtggaaacatcaaaaaacatgatcttatgttgttgatcccacactaacttacgttcagcaaataggagcttgcgctcttgaatctccttagttttcttccatctctcttctttcaattttgcttctttctctttggcgtcaagcaaatctttcattgcctccctgtatggtccatcttctcctccattcttcaacttctcctttgcttgcttcctacatattggtctctttttagcactcgcctgtgataaatcaagatttgtactcttgctagcatcatctccttcttcattttcttcatcaactctctcaattggtgtcgaagacttcctagaccttggcttcttgtgggattctagtgtttgaaactttggagaattcctcaacttgaaccaacaatgattaaattgaaatgccctgttctttggtgcattgaaagagtacaatgcctcagcttcaagaacctacaacaaattcaagtgttagttctcatacatacaacatcgttattaacaataacgaataacaatttaacatacaagctcttgatgttatatgccacttggatgtcgatgctcaatttgattgtagcagccctaaaacttgcttacttccttctgaatgttaccccaacggtgctcaagagagtttgcattcctatcagactctgtcgaggagtgatcctctctagcgggaggttgtgatgtcacaccctgaagttctcctcccaatcctaaaatttaatttataaatgaccctaagaaaataccggtgcaaatcaagagaaaaccctaagaaagtaatacaaataataatcgaatctggcatgtggaatttttcttgagttctacatgtcgaaattcactaacaagatttttagtggaattttcagagccctagaaataattttaaccaattaaaattgagcaagcaatattttaattccagggaaaatccttttcttcctttttctttttctttttccccctttttcttttcgagtgggccgccggcccattctccttcctcctctcccctccgctgggccggccgtaggccgaggcccagccaggccaccccgtctccctcctcccacccgggacaccgacaggtgggccccacctgtcgggcccgtctcctacctcgcgcccgtgccgccgcgcccacaaccgctgccgcgcccacgcctccgcctcctccgggccacgtcggtcacgcccgcgcatgcgccgtacctcccgcgcccactcccctctctctcccgcccgcgcccgcgcccgaga

SEQ ID NO: 51847 - DNA, 682 bp, Oryza sativa
aatccaaaaattgacctacccaaacaaaactatgaaatatgtaccaaactttgatagagaaatagaagttccattgacactgacatttttctcttgcacccacccttgttcatatgtgcgactacaaatgaatccaactattgttcataaaaattgtgaattatcagacgtctcccccaaatccttttcatcaaaccactcaccccatagaaattttagaagctctgataaacaatagtaattcatgattaagaataacacctagtatcaatctgcaacaggggcaaccaatcaatcatgaagcaggcacaaacaaggacgggaaaaacacacatttccaaccataaataaattaatcctcaaaataccgcacaaatcggatcaaccaaacagtccaaaccgccattccaccgaccaaacgcagcaaaaatccaaccaaacaaaacggatctgccaccaccctaaccccaatcctacaatcacccccctagaaacaattccaatcatcctcactctcaaacaagaatcaacaaacaatccatccaccactcaccttgggattggacccagccaagaagaactctcgtcaagaacacatgctgtcctacgccatctctccctccctctctctctctgtggcacgtatatgctcgcgggggggaggggatccgggcggggaata

SEQ ID NO: 51848 - DNA, 1501 bp, Oryza sativa
atgcttgacagaaaattttgtaccccggaaggaagtgatttaacatgtgttttatgctcgacaggggaaagagagactcttcatcatcttttcttttcctgttcattcagtactgaatgttgggctcaatttggcattgtttggaatctctccctgtcttttgaaaatatgttgacacatgctaagaattcctatcaatcctcacacttcctggagaaggttctttatgtagcatggaatatttggaagcaacgcaatagtttcatttttttataatgttcaaccctctgtagcttcctggatgacattcttcaagaatgatctatcccttcttgtttatcatttaagattagatgagatatcagctttctgttcctggataaatcacttgtattttctgtatatattttccttaataaaattatttaactgtgggggcttcccctacagtgctttcctaaaaaaggcttgttgagatcgttgcataaatctatcatatcgatatttgttaatgctaaattttggtgctacaaagttctaacagggttggatgtatttggtttgaaaccttaacaaatgttggtagtgtttttaagagctttacccggatggacacacgacggatggcgccgggtcggtgtgggagtagctggtggagtatcctgtgatcagcgccgtgattgtacaatatatgcatattgtaccggaccgggtcctatacatactacttcctttcctttcatagttgagttatttttaaacagagaatacgtacacatgctagaattgaataatccactcgaaatcctttgacccccgaaagaaataccaataattattacttaaaagtaaacttgttttagaataacaagataaaaaatgattatccttgcaaaaagaaatagttacatatctcaggtcatctacaatagtcatattcgtcgctgaaacgacaattaattaattaactaatagtaggaataagcaagggatcaaggtcatgttccttttcatcgatgcataagcacttgtctccgtacctgaagtggataatcatttttggtaaaatttgctacaggacatccaaaaaagtgtaattagcttgaggatatcgtaaaaacgtgtatttgctttagggcatcgaaaaaattagtaattggctgctggacacccacgacattattttattatttttttaaggattaggaaagagaaacaatgattaaagacaagattgcccctttggctcaaatgactctgggccccacatgtaaccctctctctctccttctttctagacgggccaggtggcagagcagcgatccgcggccgcggcgctggccgcgttcgccgggtggggggttggggtgggtacgtgcagcctctttcccctccgacattggcggcggcggcgacaacgacgacgacggcgacgggagcgggtaggtgtagtagaggaccatggccgagttccggcagcgcggccaggtcccggaggata

SEQ ID NO: 51849 - DNA, 1501 bp, Oryza sativa
ctcttgcccgacgacggcgtcgaccgcctcagcctcctccccgacgtgctctccgccggatcgtctcctgcctccccgtcaaggacgccgcacgcactgccgcgctctccacccgctggcgcaaggtttggcgctccacctcgctcgtccttgtcgacgccgaacaccttcccgtcggcatgtccgactccgatacctgcgccgcgcgcgaggatgcccacgccgtcacctcacctccagcttcatggaccagtaccagggcctgctcgtgagctcgttccaggtcctcgccgtcaagggcatccaggagctcatcctcgtcaatcgcccgttcccacccgttcctggctccaggtccacgtcccagctccgctctggccgccgcgtccggtacagcttcgtcccgcctctcgaaccggcacttctcgacggcgcgctcgactactccatggacggcgctcggggacgaagagaagaaagaagaaagagcaaagagagaagagagaaagaatgagggaagcataaggaagaataaagaaaaagaaaaaaaattcgaagggtagaatagtagtttctctctccaattccatcagatataataaaataatcctgcgggtgtcccgtacttaattagcagttttttggtgccctataacatacacgcgtttttacggtgtcccctaactaattacatgtttttttttatatcttgtagcaaattttaccttataataaacacacatgtcatccgcacgcctgacctttcatcagcaatactttcctcaggagaagggtgcaccgtgagatagatcgctatgctcaaattgattaccatcatggtgaacatgcagacctgcacacagtacatatatataatcaatcacaatattgaacgtagtctcagtcgatgcatatttatatagagaggtagactacctctgttttctgttgatttttaaaataatctttaaccatgcatattattaaaaaatattaatatgttaaatataagtcctacttaaattctttttaatgataaaacatgtcacaataaaataaataacatttatgtatattttaaaaggatgaatggtcaaatattatgtaaaaattcaactacgtcttctactaaaaattgagagtattaatttgattatgaagtaaattacacttgtggtttataaacttgtgagttgagtgtaatttaatacataaagttttaaatcgcttatttcggtgtataaacttatctagtgtgtgcaaatcaaagccaaaaaaacatgtcgtaactaattttactaagttgaacattgactaagatgttatgttagctgacatgtcaagatgatattatctaaatatgcatatgtttaattaaacataaaataagtaatgtcaattatacatatttttaatacatataaagggagtatgcaatggataaaaaataatataagaacaaaataactatgcatggaatgtataaaggttaattatttgc

SEQ ID NO: 51850 - DNA, 1501 bp, Oryza sativa
tttatatgtgtcgtcagtagagaggcacagacgaaaattgagtacagaatcatcttcaaataatagtagagattaaaaccgattcaaatacggatgacgtagcaaaattctggcgagaacaagttgatactgctaaagttggcagatctgttcaagagaaatttcaaggtatttgcaaattacaagaaaggtggtgttagagatctggctgatgagattgctgctgcaggaccaaatttcttattttaattgaataatagtagtagcatgtcttaatgtatactaaataaaagggattttttatgttactcgaggatgtatctcaagctaccactcattttagtgtaaatttttgatacctcatgatacttctccagtgtaaagtaccaaaacgtatcgtaaattaacactaaaatatggcatctctcggtacctagtcttgtacggtaaaactaaataaaatgcccattttgaggatggtgacatatatatattataaaaggtttcagagtaatgtatatgagaagttgtgtttatgacttattagctcacgataatacctgtgaacattttgtgtctagccaatacaaagcattatattctcttttttaaaactatatatccctagatttttgtaccatcaacaaactttggagaaaggagcgtacaaaaaggtagagctataaacagtacgatggacagttagcatttgaaatgttgaacgcctttgttaatctagacacactaaaacgataataatatttacaccaccaaaaatcaatgattaaaaaatattttcctaatatatttatcttgggttgaattactacctttttctataaacttggtcgaatttgaaacagtttgccttttatcaaagtcaaaacgacttatggtctaaaacgaaaacggagggagtaatagttagggtctttaaaaacaattctttcagcggcaagacacaaactaatggttacgaggtaactctaaagataatacaaagatagacatgcatcgcaggtaaaaagggttattgaaactaagagtaagacacttatgacaacattgatataatcaattagtacgagagatggtattacatgtgacaaaaaaattcaccaagggccattacatggtggaaaggagcaccacgtaataaaggtacttactatgggtacaacacacaataaaccataaaagtggtggtgcagttaattaaaatgttggcagagcacaccggtcagcttgtcattcattttatgatctcttttttttccctcttgcaaggtataaaagtagaaatattccctcatgaaattcagtttagttttatttcctcatgagaattcagtttagttttatttctctagtgtgagggttatttctgaaaatttgaatgttgcgcctagcttttcctttcttcggttggtaatataccatcattttcatgccatgtcactggcaatcacatcaagcaatttttatcggaacacaaaagaac

SEQ ID NO: 51851 - DNA, 1501 bp, Oryza sativa
attgagggtgcatcggcggtagatgagaagatggtgcgtaccgttggagaaggtggcgttgatctgtcattctgcaacaatggcaactcaggcagtcctgatgatgagggaatcacggaggagaagaggatcgagatggagttaccggtgcacgggagcgaatcattaggggatgccaatgcgtgttcttaggttgcaagaggagatcgccgaccggagtttgggcgtgaatcgagggggtcacgcggtgtccggcgaggaggtgccaatcacggagatggcgtgattcgcttgggcctcggggagtgccgacagttgcagaccagtgaggccttttgtggcagtgaccccggcgaggcacaaagtgccagcaggctggcgccaccaccggtggctcatgacccatggcaaggaggtaggaggcgcagcttcatttgtagtgtgccggcagcttcggatccgtaggtgcgaggccggaggtgcaacggcgtacatagcgcaatgaggagttggggctcgatgggttgggatgggtaatcgatcggtgatttcatgttagcactgtaagacagaagacaccctcatcctttttcagccgttagataaatagatgggattgctgaggaatgggatgatgatgttttgtgtatatttccctgggtgcacctagcaaaagtacaactgctgctttttatattagaataaagtgctcgtgcgttgcaaaggaaaaaactaaagttatgataatgattatggtaattttatagtttcatgggaattatatgggatactcccagacataaacaatgtatcaaatctatacctaattctaattcaatatcatgacaaataaataattacattttttggtgactccatttagctagaaatatttagtatgaagaatgaaaaactatattaaatctcaccaatttttaatggctcgaaatggagcttaaactaagtttgttaattgagaaatagtttaaatcggctaagaaaaaataaacataattagacctataattagaaggatgcctatctctcttccacaccgtggcatgttaagtgcacagggcccatgtgcaaggccacggttcaagtcggcgtaggtgtgctgagagccgtcagatttgatcgaacggttaggatcactcgtgatttactaaaacattgccctattgaaaccctaaccatagattcattccccttctctcccactgcgagcggtgccgcacaacccctccgcgagcgacggcggtggcgcccttccccaccgcgagtagcggtggtgccctcccccactgcgagcgacagcggccacggtgccctccctcagcatgagcagtggcgatggcggcgacggcatcctcccgcagcttccatgggtggatcaggcggcgtcggtggcttcccgcgggcggatccgatgggcacagtggtgtcggcggcttccgcgggcagatcaggcgacaatgaagattaagataagatttgtgca

SEQ ID NO: 51852 - DNA, 1501 bp, Oryza sativa
cctatcagatccacacatagccaagtcacagaccagttatgttttcctatgtggaggaacgacaatttcctgaaaatcgtcaaagcaaagtctcgtagcaacttcgacgaaccactcggaaaacattgcactatacgaaggctctcgtgaatgtgtatggcttcgtaggatgattcgccacattcagcaatcatgtgaattgaacaccacccagacccctacaattatctatgaagataatgcagcgtgtgtcgcacaagtacaaatgggttaagtgaaaagcaatctcaccaagcatatcaaccccaagtccttttatgctcatgaactgcataagacaaacaaaatcgaagtattgcatactaagtctcgttaaaatctcaaagatttattcactatatcattactggcaaccccttttgaaagatgcattcgagggatcgggatgatgggacttagagaagtgcaaaattcatggagagaatttcactcactcgtcaaacttagtccagaatgagaaagtgcctaataaagaataattgggtgggtcgtactctttttcccatagataagttttcccgcggtttcttatcaatgtttttaactaggcaatccgtgcaacacacaaaacatatgttatgtactctttctccaatttttcccactgggtttttgagccgttttaatgaagcataagcaatatgtggtggctggtgaaagcccaagagggagtgttgagaaacatgggcttttggcccatgaaggccagcccaacacactaatgggccttacactaattggctatataaagggaagagagaggcttttgtacgtagtgaaaagaacgtgaacgagaatactcagtccctcctcatatattgtgtctccatttgttagtacacttactcaacccatttggtgtaataatcaacacccaacttgtcacaacagtattagttgtagaatgcgagggaagcattccagtgcatgtccgcattgggtagtttcatcaaccaacttgtgtgcataaagaaaatatttaatacctgattccaagcagtagaaggaagagcacgaaatgaataaggcgaagatcaacatcagaaatatatgtagagagatcgcattaatccaaaaaaaagaatagctttgaagcatctcgggatgggtaaaagacagaaatatgttaccatgcttgctgtttccacgagatttccagcatgtccggtcagctaaaaattgccatcagcatctcactttctcaattggagaattgcattacaatagtctgttagagtagagataagtttcaagattagattggttatcttcttatcttttgtgttgcttatcctatgtaacaaactccctgtaactctcgccgcgttttgccggctcaatcaatatattcgtgcggcctcccacgggaggtgataacgcttcctaatcaatctagttcttccacatggtatcagagcctactcctcaaactcatctagat

SEQ ID NO: 51853 - DNA, 1501 bp, Oryza sativa
aacactccacaaatatacaagttcaagttcaacttctacaaattgtaatgaaaaatacaaattaaacaacagctagttaatgtatattcagagttaaatttgtttttttcgttacgagatgtcgaagttgaatttttatttgcatgtttgtagagtgatatatcacatgttaatatatcttctcaatttttttcataaccacttgagtgacatgcaatcaacgagggaatatttccttgagggatccaaatccacttccctatatatggatgtattctcaacttgcgggttgcatttgttactacagatgcatgctatatcaaagttcctgtgctattcatcatgttgcacgataacaattagcgtatcactgtaaatctgtaatgatgcacaagttggggaatgttatccaattccaatatgtgcgctagtacttgcctagtgagatgactgttattttccaatgtactggagactcgaccttacaagtgtcgttaccaatcacttgcctccatctcaaacgtcttagtagggacaagctagctaggagaaatttcacatgacttgcataaaagattactactgacatgacatgagcaaacaattaattttcaaaagttacgaaaagcaatatagaggcttaggaggaacgaaagctatgaaccacaaataaattcatcttaaggcactgctgcagatttagctgcctccgattgatgcttcaccaaaaaacaatatcaacagcagtgcaaaattagaatttttgtatttttgtggtaacggaaaccatcaaaggggaaaaaacgtacaatgcttatgttgtatgttaagagaagtttgtgtggtgccaaatgacagtcctagcctgatggttatcgagaaagcagaatatgtgcaggtagcagagcaaaatatttgtggtagtccaactagaatacaatttgcatgccatgcctcatccaagaagccgggcaacgagaggcagcaaaaggcttttctgtggtgatgcaaaatgaagaggttatgtagtagctgagctgatgaagcaactggtcgctagctgccggccgggagacgaatgtgaggcaaggaaagaaaagaaaaaacagagagaaagagttgatcagaaatgggtgaattctgtggtgaggaaaggtcaaggaactgaagccaagagatccttcctacctacactaatacaatatactcctaactcgctcacagactccgatccaggtccaagtcatgctatgctgtggatcggccggccgagattgcgccacgtgtgcagaacccaatcttcagcgtgtggcctgtggaggatctggaagctgatccacagggacgagtgtgtgcctctcacagcctccaacttccatggcgacgtccaattctattgtattatttaaggcctaccgcagctcggcctctacactttgagcagcagcggccggccatcatcagtgatcctctacaatcatcgactttcagcaaattaaga

SEQ ID NO: 51854 - DNA, 1501 bp, Oryza sativa
tctcagggctttgaaaaaaaaagagtaaggtgaataaaatatcattctacttatacttttaattgattaactaattcaaaaaagggcacctaaagtcatcagaacatctctgtatttcgtaattggcacctaaaggtaaagtaattggcaacaatattagtagacagatgatttgctacccgaagcaaaataatatattgcaagtcaattatcggtcttgaagtctaattgtctagactatccagatcaagacaaatatccagatcaactatacggtgatcatttactccaaatcaagacaaatatccagatctactcttggtaatcacatactacaaatccttgcaaaataatccggagagcaaacctaccagctgttagacgaggaggcttgctggggacaaactgccgcagatccactcacctcgaggctagacctggcgccgccggagatgggagccaccggatctggaacacccagcctcgggatggctggatccgtgaccattgagaatggggcatatggatctgaagaccctgaacttgggttggctggcaccgccggggaagagatggctcatcgatggcacaaggcggcggcgtggtctccattcgtcaaagcaccggcgccggcgctggatctactcgcgagtggcgatggggactgcagaaggaggagaggggtggcggcggcggctcgagggattgggacgtgagggatgaaaaactaggttttcttgtgtgggctgctggacttctatacgatggatttaggcccacctgtcagtggtaattttctatgagtcctagcacaaccgacagaactatagcgatgttctgtgggttggctgcaaaacgcacagaaaatatcacggcccacaggatagctctaaagtctggtagtgaatatagtatagctacttgggcttacagaatttgtgtctaagggtgtgtttagttccaaagttttttttcaaacttccaactttccatcacatcaaacctttcatttacacacgacttttcagtcacatcgtctccaatttcaaccaaattctaaactttggttggaagtaaacacagcctaattggtgatcaatttaactagtactcgtaataaatcaatgcagggaatatgcaggcacggtctggaagagtcgggcacacactcgatcgcttggacactagcaaagctgcaatcgttcgccttgcattgccagtagctataaatctcgctccatcagcaagccagctctcatcaaccgggtgtccctgatcgagctgagctgagctgagccagcttaattgcacaatttaatttcttcttgcacctagctcattcgtcgatcactcactcagttagtacctagctagcaagcaagatcggtaacgcagctagctagttagtacaactgcaagaagctaattaaaatactatcttgtgcatacatacatacatacatacccaccagctgatcgatggcagcgacatcgacgacga

SEQ ID NO: 51855 - DNA, 1501 bp, Oryza sativa
cacaattgttggtccggccctcactggtccgcacttgttcactctatggctgtggatggtgttgagggtattggagacagttgaagctcacagtggataccatttcccatggagcccatcaaatttcttgccactgtatggagggtaagtaatctagatattgtaagtgtgatataaaatggtatggggactctattggtgtcctgaatgccgtcttttcctatgaccagctccgactttcatgactatcatcaccgtgtgctctacaccaaatcaggaaactacgcctctacttttgtttacatggactggtgagaaatcattgactttgctatgtgtaatcatgcatgtttacctgactctttacatgaggagccttcctgtttgtgataggctgtttggcacggacaaggattaccgcaatgccaaggctatcgaggagaaagacgggaagcatttgtaaattgtgggggctactctctttctctttgtccaaatcatcgaaacaagggtttgacatctcgcagtggtgatagcattgtgttcatgggaggaaataggtgtcctagccacaggtatctatctcctgagatgatcctacagtttagattttctttccccaaattcactatactatcatcatgagacctttgtgtttctggaggccaccatgatgtaatttgtcataagcttaatttgatgcgtgctattttgtggtttgcttggacgggggtacatgccatgacagaagtgaactattcgaatcagaaagttgtcagattagtgagttaacgttgagatgaggtttactggttaaagtgctgcgtgttactttggtgcttttgttggttttatcatctttttctcgttcttatcgatctcgaagtcgaagtttgtttgtttgtttgtttgtttgtttatattttataactgctggctttatgtatactgcgtagcctgatgaagggttaattaatagcagtcaagtttacgtgtcaattggacacagtgttagcattaccctggcgcgtcgatcagaccaaggaattgggcgctgtgaccggcttacggccatgccatgcctctatccgaaccgaacaactcccgcctcggccagcaatgggtgtgtttggttgggctgtggcttttaaaaaagcagctgtcgactgtgatttttttgaaaagtagctttgaaaaagtagctgtgaggatttttttgaaaattagctttgaaaatgagcatgctggcggctgacgacgacgacttcgcacgcgcgacctgctagctcggctggaggaggagtggcggtggcggctcggcgaggaggtagaggcagacgcgggcggcggcggaggcagtcgcgggcggcggtggaggcagtcgcgggcggcaaggctgaggccactgcgcacgcgtgctcgccattgctggagctccaccatggccacctcccatgcccgccgatgacgaccgaacaacgacgacttcgcacgtgtgggc

SEQ ID NO: 51856 - DNA, 1501 bp, Oryza sativa
ggaggcggcgggtctgtagggaggcgcgggggtactggagttggcgggcggcataggcgggagcagctgccttcttctgatttctgaacaagtagctagagatcaaactagatccatccatccggcgagccagccaacgcatgcatatgtatgataacttggtctttgatctagtaatatccatgttgtctaattagctatccactactccatatttaaccaactgacaatggaattagcttgtagtacaagatgatgcatgggaagaacagaagaattcagtgagcgagctaattgttatatctaccggactacccctatatactcgtctttgctaccttattggccaattgtgtctagcagtatgcacacacatgcacgttgctgattaatttggtttattactttgtgaagcaacactgacaatccgtcagttgcaatagatgcctgtaaacattaattgggacgttgctgacctgcttatatatatgtaggaaattgtagttgatgatctatctagtgccatataatttcactgtgtttaaacaactttgtgtgttctttcatcattatgcctcatcttttttgttctcctccgctaccctctctgtttgtgtaatcctgcattccttgcatcaacagactggagttctcccacctctttatttttcttggtttttcatttatagtttccttcggtgttccctaccaaaacaagagaaggatcccaacgatgcgggtctactgcgctgctgatgaaggttagtctaatggtaactggagattggcaaattgtaggagcggtcaaatgttttattttacagtttttttattcttgagtgaaatttcttatacccaggctcagatcttgaggtggttataaacttttgatgtatcttacatgagggactactatttcaattcttttttttaataagtagaagtatttatgtcctttctaggctgtacattgcacaccacatttactttcaaggtacaatagtgtgtctaagttttgagctttcacacactgcgaatggctgtgcataatgcctgcaaaatgtgctgcagaagttcataatgagtcatcacagaactcagtttagcaaaatgtacataggctacatggaatattatggcgcaaatttcccaatccatgtatctcgtacttaagtaaaggactaagtctaagcaattcattgtgggattaggagattgcagattgggctttattttaatggaagacaaacttgtgtttttttttctgagtaaaactatagaactgatcgatatgagtgcattttgtgctttatttgattttaagaagaggaagtcaatgacttgggagtcaatgtggcactatccatgctaaaattttacaaaagtaagttcattcttactgttttcatcttgtatttatgtgcagcaatcattggccttgcgcccttgccttttgatatcaactatatctctatagcttgctctcctttatgtgaacagg

SEQ ID NO: 51857 - DNA, 665 bp, Oryza sativa
tcctgcgccccggttgggtagtgggggaggcaacgaatttgggtggaatttacgacctggagcgcttggctagggaacgaaatcgacgagatactagtagggagtagaagggatttcgatcggagattgggggaagaaacgggaaggaaatgctgttgctttttctgtttctcttttggttgtggatggttgcgtaacgctccactcgcaaaagtggccgctttttcggcaactaggattttagggactttgccataatatttagtattttgtaacgttcgcggtttgcccgccgctaattttgagagatatattttcactttaaaaatatttagtaggatttttaacaaagaaatgtaaaatacataaacaaaattttaaaatatatgtatggtacatgaattatgccacccaaaacctgccacagccaacaattccacccataaacataaataacaaaaaatatcgatctaaaacatacattccctccgtctcatgttccctccgtctcaaaatacaagattctaggatcggacgggatatttctgagacaacgtatctagacaggcttcatacactccctatccagatacgttacattaggaaaacgtatcatcggtatttgattcttatattttcggacgaatgtagtattttttttaatg

SEQ ID NO: 51858 - DNA, 975 bp, Oryza sativa
cgcttttttcattgaatgaacagatatagctgaagtcaagaaaagaattattgctaaaataatataatagtatggaataatatgaaatacatgtaccctataattagtactccctccgtcccaaaatgttagcatttttagcatagttgcaaattaaacatttttaattttgactattaatagcaaaaaaataaaaaagatcaataatgtaaaattgatgttactagatttatcattaaagaaactatcataatatgtaaattttttttatttgaaacatcttacttttatagatattattggtcaaaataatatctcggagaccgtgtcagagtccaaaaaatacttatcttttagaacggagggagtagttcttttgtgttccgataaaaattgcttgatgtgattgccagtgacatggcatgaaaatgatggtatattaccaaccgaagaaaggaaaagctaggcgcaacattcaaattttcagaaataaccctcacactagagaaataaaactaaactgaattctcatgaggaaataaaactaaactgaatttcatgagggaatatttctacttttataccttgcaagagggaaaaaaaagagatcataaaatgaatgacaagctgaccggtgtgctctgccaacattttaattaactgcaccaccacttttatggtttattgtgtgttgtacccatagtaagtacctttattacgtggtgctcctttccaccatgtaatggcccttggtgaatttttttgtcacatgtaataccatctctcgtactaattgattatatcaatgttgtcataagtgtcttactcttagtttcaataaccctttttacctgcgatgcatgtctatctttgtattatctttagagttacctcgtaaccattagtttgtgtcttgccgctgaaagaattgtttttaaagaccctaactattactccctccgttttcgttttaga

SEQ ID NO: 51859 - DNA, 1501 bp, Oryza sativa
ccggatgtttcttgtttctctagtttgtccgttgtttttgaggaaggagatgttgcttctctggatggttgcgatcaagaacatgacgaagtacttgatcatctctcgaccatgtccagttcgtctcatcaacctgattctgtacatctggtcagtaattcgttatcagctagtatgaaggttgaggagatgaattcggtatctcctttccatgacgccaaatctttgctacttcctccgtttcacaatgtaagtcattctagcatttcccacatttatattgatgctaatgaatctagataggtatatatgtctaagattcattagcatcaatatgaatgtagaaaatgctagaatgacttacattgtgaaatagagggagtaattcaaaacttttgggaagagatcggcttcctgatatctgcttctcggtggtgggaacataaaagttcgggttcagtggttgggactacatgtcccggtgcgccaactacttcaaatacggatgagctgtgtacgaaagatatttctcgggggtcttcaccaaagttgcaaaactccgatcgccgccgccgtggatgggtgatgcatccatggaagccactacctcatccacaaccggtgcaatcggcagtgcttggagaatattgccttttgcaaaacatatacaaagtgctcacgcgcgtagacatgagatagagtaggtggtttcaccggcttggcgttcgcgtgagggcgtgccaggcatcggtgaaacaagttcagcacgatccaattcggtgacaattctttccaacaaaccatccacaaaatctggcactccttctcttcagttgggcccgattggtgatgggtactatggaaagtctttagcctgttttcgtctaaacagatgcgctatctctctactgaaaaacacagcataggggaagatctcatacacggaaatggcggctagaacgtgtgaagaaacgacgactagagggcagcggcgagaggatggtgcggtaaggcattagcagtttcatccgcgaaaccagcacggcccaaatcggcaccacccacgtcaatttcagcgaccgcacaattttccgagagctggggcagcaacgccggcagatcggggtttggtggtcgctggcaaggaggagctgctcacggacatcagtccttctggaaggttccccatggaagcaattcaggggcactttgtttccgggatcagggagagcagccacggacagcacaacaagctgcactgctgcaacccaccgcgccagtggcagcaaagcaggaatagacgcagcaggcagagggtgctcaagcgatagctaaagcaaaaattaaaaaataaaaaaaataaaaggggtgcctcgttgtcactggggcaaaactaagtggccacagggcacaggtttgcaacaaaaaggaaccacatctagctgaaaagtgcccggtactcaagctggccattagttttgcagcaagagggaatcacatc

SEQ ID NO: 51860 - DNA, 421 bp, Oryza sativa
cccccctccgccctgtcgccgatttggacgcgagcgccgagcgccagctcgcgccttgaccgcccaaagtcggtttccaaaccgacattgccgcccttaaagccccgagtgccctccctctcttctcctctcgttgtcccatcgcctccactccattgttgtcgcccctctgtttcgccgtcgccgttcgtcgttgcgcgcgtcggaggagccggcacgagcgaggacgcggaaggggactccgggcgctcgtctccttcctcttccccggcccgaggccggagagtttactcccgcgccgtcggcctctcgtcactgcgccccgacccgcacggtagtgcctctctccgttcttcctccccgctccatctccccccccttagttttcggtggtagcacgagtagcctccccgtagctagc

SEQ ID NO: 51861 - DNA, 1501 bp, Oryza sativa
tgatgattccaaaataaaaatggctgcttagtttgcaatataatagatagatcttttcttttgacaggatgttattaaatcttgatggttttttttttttgaactaggagagcatattaaatcttgatggtacctgagaaaaagtccactaaactagttacaaatattcaaatttgttgtatgatagtcaattgttggtcaatagcttcatctgttaggctgcgttcgttccttgggcacggttaattaagtattttaacataacctttgaggaacattgggccaaaggttccctgcaaatttctatacgtgtttccttacaaattctagtactttacatattcctgggttgtgttttctttgattactggcaggtttgaaatactgctagtttggtttatcatgcattccatgtgctgagatagtttgataattacagactgatgtagtaggtgcagttttatctgtcttttgcatttcagaagcatagaactgttttttttcttatatatactggggctaattttactaaacaggtatttggtctagtaatttcacgctgcaacactaaacaagcttgtatagctgtgtttcagatagaagtttgtgaaaagattagcaatttgttggagaagttaggtacaatatcaattttaagctagtagagttagggggtgtttagatcccacccaaaaattttacaccctgtcacatcgaatgtttgaacacctgcatgaagtattaaatatatataggctaaaaaaataactaattgcacagattgcgactaatttgcgagacgaatcttttaagcctaattactccatgatttgacaatgttgtgctacagtaaatatttgctaatgacggattaattgggcttaataaattcgtctcgcagtttactgacggattctgtaattagtttttttattagtgcccaaacaccccatgcgacatcctatataatatccgatgtgacacgccaaaactttacaccctggatctaaacaccccccctatattctgtaaaaagggatgtgcatttcattcatctttctgacatgttaggtaggagtaattcagtaacaagatagcagttagagaatctccaacaacctttctaaaatagactctccgaacatccatatagccagctagctatcctgtcgggtcccaaaactaacaacttggatccgactgagattaatgtatcaatccctggatcagtaaaaatcgatacatacaatataactggttcttcattgcatacgttaaagtcttacaatactaagggttttacaataataggtattcacccatctaattagtacacagcggaagtttctatacattctgactagtgaggtataacctttagggattttctaagttatcagggtctttgtagtaatagtcataagggtcctcctcttgacccagatatgaaaaaggaggttataagagcaaggatgagtattcacaatactcagcaagttat

SEQ ID NO: 51862 - DNA, 1501 bp, Oryza sativa
gtgtttaatgcaggcttcaaggaaaggctgttgtttttgcaattgtttttatttgaactcctttttgtaaacaactaagtgagtgcttctcaaacgacacggatgagacagtgcgtctcgtccagtcggagtatgtgcaatgtatcagtctttagaaatgacataagatcggcacccggccaatagcttttcaaacagccacccgggccaacaactttcaaacggccacccgggcctagctgatcccatcagctgcaaattttccaaacatcgatcccctttccacaacagcaatttcacaagcagtagtcaaacaaaactacgctaggaatcacctcacatctgcccatgaccgtgggcacgactgttcgaacagtttgttaacctctgcagagggggtacactttacccacacgacattacaaacccgggtcacccagcccgtggggatcaaccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactccgccaggggtgtcccattccacccatgtggtcgtacttgacttatgtttggatgaaattccaaggaatcggtccttaagtgcgagagcgggaaaccgtactcccggtacgttccccggtccgcggttttggaaattcatttagttcgcaagcaccgacccaggtgtcgggttttccaagccttttgtaaacccaagttttacccaagttgtttttcagattttaagtttgaaggcgtccgtcgatactcgcacagggtgcacgaatatcgagacgcaactagatggttacaaggggacatgatataacaattaacaaagggaggatcaatgcaacaaattaggtaggtccgctgatctgcctagcagacgggacgacagattaagtgcgatcctatcaatgcataatatttttcaagcaacataattaaatttcaaatataggctcgagatgttcagaggtggcttgccttcctcgagatctggagcttgatcctcgaaatcctcgcactacgggtcttcgggctccgaaactacacgcgaaatgggacaactcaacaaacggcgaaaataaagctctattaatgacctctaagcgtgccattagatagatctcgagatttgaggaattttggaagttgaacgtagtcaaacggacttacggttgggaagatattgaatttctaagattattggatttttggtctaaaggaaaaggatttaattaaatcctttttggaaaagaaaaagaaaagaaaagaaaagagggagggattatagacttttcctcgggcggctagggcgtggcccaagggaaaaggagcggaccggccgagctaaa

SEQ ID NO: 51863 - DNA, 1501 bp, Oryza sativa
tttaggttttagcaagtactgtacgctcttcaagttgtggcaactactttgattgcagctacagtacaccccccgatcgagagcgagaccgagggttacgtggtgggcccagcgcggcagccacactgtaggagtgacagtgctaggctacagctactgtgctgggcgtagtagttgttccgctcactgtgcagatgagctcatgcgctcatcgatccccctcctctcctcctcctcctctctgtcctctgccatcccccccacccgtcacgtgaggcgacgccgccgacctgatggctcgacatgccccccgtcccggtcgacgcgacgtgcactgtgaccggccggaagaacgccccccctgccagccggcgacacgcacgcgtccggccatggctgcctagctagcgtatcgctcccccagctaccggcctcgccgtgtggcccggcgccccggcgtgcgtacgcgtcgggtacgtaggaaacacggcggcagcgtcgaggcgaggacggggaagcggctggaccggcgggccgggggaagagaggcagccatcctgtactctcctacgtacagccaccttacctgttgcgtcaacgagagcttgggcgttgctcgctacagccgctggctagcttagcttatagctagtctccgcttagcctgtgggcataaaagcacccggcaccagcgtccgctcgacacgtcgcgattccgcctctgtgcgcgctgctgcccgggccgcaccgtgtgatacgtacacaacctcgggttcgacgcccccgccggcccggtcgcttccctcgcctcgctgttaacgtcgctgttacaagcttgcgaattgcgattgtgcgagcgctcgcggcggtattaatttttgctatacctggggcgatggaaacgtaacgtactactactacgtgacctagggtgagagacgagacgagacgagaatatgagatgagatccaaattcaatctgcctctctaccccacgaaagaaaagattcttctcttcgtcgacgacccggcctctcgctctcgttgcctttctttcgcgctcagtctctctcggccaattaagctgtagatcggccaccaccaccaccaccaccaccaccatccacagggcgctgcaagctgggccaggcctctctctatctctctctcttgagaggagagattaagtagggcatagagagaaaaaagctactcctaattaagccacagcttgagcagatcagctgcaggccggccggtgtgcgtgtgtgacagtaggagagagagctagcgagagagagcaaggaatcggaattgatttcatgcactgatcgatccatccatcatgcagatgctgcatggatgagaagagctagcagctaagctttgctgaagaaaattcttcagaggtttgtgttgatttgctggtctgctagagatcgatctagagagagagagaggaagggaagactgaagagagatctcgagcgggagatcgaga

SEQ ID NO: 51864 - DNA, 273 bp, Oryza sativa
atgatggttgctttcatgccaatattgattgatgattcctaatgttgctaaataactcatctcaagagtttactgactaaatatggcaagccaatacactggtgtttcctttatacaataaataaaagcattaatagttgcatagcatactttaaagtcaaacggaaaaaggtatgttcctcttcaggcatttttcaatgccgaggtgagaagggtgaagatcttaggcaaaacatcaccgtgctagagttgataatgtaaatgaattcaggg

SEQ ID NO: 51865 - DNA, 1501 bp, Oryza sativa
agataaaattttgttaaatactttacttgattctatagttcctagatttttctgggatttatttgagccaagaaagtatttttaataaatggaattgcatttcatgaataatttaaattgaaaaaggtttttaaaagtcttcttttggctttgggccgaaagtcggcccaaaaaccctctctctctctccccggcccagtcggcccagtccgccgagccgccgctctcctctctctctcgctgtcgctgacaggccgccgccggccgaaaccctagcgcaagccgccgccgtctctttccaaatccggccgctcctttcccgatccggtgaaatcgattgaggggaaataatctccgagatctcctctaccttttctcttttggaatcaccggctaaaatcgcttggaaagtgtttgattcgaggtcgattcggatcggtctctctctctccaagctctacctttccatctcgccgccggtcgccgtgggcctccgtcgccgctcgctagcccctttgaaagcacccccgagctctcctctatccgccgccacctttgccttagcccgccgtcgcgtctagcgccgcctccgcgtagccctagtcgccgccgtcgttgctgtcggttcagccgcgccgcgccgccgttgcagccgtcgtcgttggtcgccgtcgccaccatcgggatcgcgaggtcgtcgccgtccccgtccaccgcttcgccgccgccgaagaccgccggagcaccgccgtcaccgtcgacccgaagaccgccgccgcttcttcctcgtcgccggcgccgtccgttgctcttccgccgtggttttggtcaccggtgagttcgccgcgtcgccctctacccgttggtgccctccgctcgcgtcttcgcgccgtcgttcgccggcgagcaagtgctcccgagccgccgagccgtcgccggtgatgacgtcatcgctgacgtagtcgctgatgtcatcgtcgtcgtccgtccgtgagccgcggtggatccgatcgatctcggccgtccgttttggatagggttgatctcggccgtccgttcccgtgaaccgctgccgtgcacccggtccaccgcaaaccctagccgctgacgcaataatcctcttttccttttcaaaaataattcattattgcgtcataattcaattaaaatccatataagtgttttaatccgatttaatctttgaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattgtgatctacatgtttgtttactttatatgtattgtttaattggtttttattagtctttttctttattttgcgtgttagc

SEQ ID NO: 51866 - DNA, 1501 bp, Oryza sativa
aatatgagagacctttgcttgaggtgtgtgagtgaagtgagaagaggagctctttaaataggctgccaatgacggttgtggcagttggaatggtcggaattgccctccaaccgtcgttggggagtgattcatgccgtccaaaaaaaaccatgcatccaacggtgccaggggggttcggccgaaccacctcctggttcagccgaactaggggccagcccaacctagcccaaattcaataggtggcctcctccattgctctctttcgcggacttgtgaattttggcccaattcatcgtgtcaaatcagagttcttggcccattcatacataagtctgattctcgacatcgtccgattgatttattgtctgatttgatgtcgattctccttcactttatacttattctctgcaaaaggttagagaaccaaatactagtggaatattattattctaacaaggatatgcattgcaagcataactagttgtcctggatgtcgccttatctccaagtcgactcccgatccatcaccggcaatactctcccgaggcattatgtcacctacacatgaatcaaccaaagaaaccatattccaagaccaagctatctccaacttgactcattgttagcaaacaacaatattacatacgcatagtatccatttagaagccataaacacatattaatcatggatatccaataaaacaactcgaaaccgaaaccgacacagagtcggcctatcagaccgcgggctggccggtctgactgtgcaacacacgccggtctgaccggcaaccactgcccggtcagaccggacccgacaagcagcagcacctgttaacacctataaaatccaatcatctccaaaaccacttcgccaatgatctccaaatattaaaaccaataatcacatatgctaattattcatcacagaataagaataaaaaatactttgattttacaatctcccccttgattaacacattgacaaacccatcaaaaatgttttgttgtttggaaaaataaaaacaaaagtggtaaaaagcatacttcgtgcaaacgcacacatcgtgctcaaaatccaaaagaaaacttctctcacttttaaaaataaagaaattcccccttgacccaaaaaaacacttagtgcaaacgcacacatcgtgctcaaaattcaaaagaaaacttctctcacttttaaaaacaaagaaattcccccttgaccgaaaacatgcacaatctcttctcttctcccccttttgacaatgatttgatcaagcataggaattaagttcattaatgttctagagcttagcatatatatagcacatcaagttatgtgttgcaataaaaagaagatgaacccatcatatcatagcaagcatgcactaaagtttaaacataaatcaaagatataacaattaagatcaaatcgacaataagaattcatgatttcatgtgatttataatgcaacatctttgcaagcacataggttgaagaata

SEQ ID NO: 51867 - DNA, 1501 bp, Oryza sativa
ctcagatttttttggctaatatcaactttgaaagattattgtcttatttttgagaaagtacctctcttttgtgataatactagtgctataaacattgctaagaatcctgtacagcactcacggacaaagcacattgatattcgcatttactttttgagggatcatgttgagaagggaggagagaatccattatatgccactgactttgtcacacgtctacgatttgccgctgattttatcacgttctacaatatgccatcgacttttgcttaacttctacgatttaccatcgccgtccagttagcctccgttagtactgtacaaatttgtcgaaatgaccaaaatacccctaggacaaaaatttccaaaatttggataaaataatcgaaatatcatatggagggtgagctcggcgtcgccatgtcgaggccatgcgtcgaacacagccgacgccgatcactctctgtctctcccgcattcttgagcggtatgggtgagagggtatggtacgataataatggcaaaactgtcattttgtgtggtttctctcctatcaattgggtggcttctagtgtcctgtagcaaattatcgattttttttgagaattaatattatttttatggaaaatcgcaaaattagtggccatatgtggaaaatcgcaaaaataggtccctatcgaacgggggaggaacgacaggggccttatcgaactgccagccttcgattggtacctgtcgaactgcaaccattcgacaggccggcctatcgaaccggggttgttcgactgggcccaccacccggtgccgcacggcctgtcgaacatggggagttcgactggtcccgccgcctcccctgtcgaacaataggcgttcgataggtccctttatatcggcagcccgaacccaactttctctaaaccgattgaggaggaccacatcgccatcgtcgccattcagtcgccactgctgtcgctgtgcgcgccggagggagtgaggggagggtgtgggcagctagtgacaagtccggggcggcgccggcctggagggcagtgaaggcgacggcttgaagtggcgacattgaggtataaatttgtaatccctaagtatgaggcttacgattttttaatcttatagaagaagacttgtgatttgttaattgtttatcattctccaatgtgactacatatcatatgatatgttaacatttgtcagtgttaaatgtgagtagagatattaaattagtcgtatgctaaaattagttaagttagtaaatggtagtacatatatttaatgtttgatgtgtttaaataggtagaggttaatacaactgggtatgatgattaaattagttattctttaatattagttgtaacttattagaaggtagtgtactgttagttataatatcgtaattatcgacggcttaaattattaaacgtaagggtaagatatgtgtcggtcagtaccgtataataagacaatttataatgttttatcagga

SEQ ID NO: 51868 - DNA, 1501 bp, Oryza sativa
atcgtccagagtgtaggtgtggagaccgttgccaggtgataaggtctgttcgacaacaaactttaggacagagatgcttcgtgtgtcctaacattgtcgatgaagatttcgtcgtaagttccactaatttttcactcattcccattacttctgccatgtacctactgtttacacccaaatttggcacctatggatgaaatagaggaaaattgccaaagtttggaaagtttcgggtttccttcacagggccggtcagaccgcaggtatatgggcggtctgaccggctagtagggccggtctgaccgcaggtatgtgggcggtcagaccgtcagggtccgagtccgagcctattttcgtcgggtctcgggtttccttactcgggaaggcatgtttcgtgtttccattggtttctatcccgagttgaatgtggaggagggtctgtagaaggcaagaccaacccctatataagggacaaggccggttcattgtaaaacccctgaatacaatctacttgaatcgttcttttaccatgttttctattttaccctagtttagtccatttttgtcggtttgcaccgtaaaccgtccgccgccgctgcgagagtgcgacacctctttgtaggtttgtcctgaaaacctttcgttttgcccacgagacgggtagttatcctcatatcaatctaaatcggcctagaggctgattttgatctctaaatcggctccgctagccaatttagcttttctttttgcaaaacccatcttgatttggccctttggctagatcgaggtggttggcgactctgtatcatcgcaaggcgtttaggtgttgcgatcgtgcttgtcgacttgtcaaaaaagttgccaacacgatttttggcaactccgctggggaacgatctaatcggctatatcacggccgaatttcgtttaatcaagtagctaccgtttcgtcaaatccaagttttggctaaacggccgaaattaatctagtatcgccggattaatctaatcggctccgaggttatttggtcgtcaccgaatccatgtgaacgtttgccgtgtgtactgaagatcatcatcagggagcagcggccgactcggcaacctcctttccttttgtttcacacggcaacagaggaaaagatcaggctactagagccgatctgccgagagacaagcagcaggagcattgtttccttttattactgtatacgtgcatagataaaaaaaaagatcaggctataccagagccgatctacagagagacaaatcaaagtttatttgttgattttggtgaaattgattagtgcacgtattactcatatcgagagaaaaattaaagaccgtatattaatttactcggtcaacaatttcagctatgagctatatggccggatttaatcaaggattttcttcatcaactatgacgagcgggaacaggttcaataatattgctacacaatacattagaaccgatcaaggcgtcgcgagaggaaacgtg

SEQ ID NO: 51869 - DNA, 1501 bp, Oryza sativa
gatctaatctccaaaccaggagctaagcaaattattaccagatataacacctataattattgtgagaggtgtgagactaatcacgaaaaacattgctcaacccgcccataaccgcgggcacggctattcgaatagttttactctggccagaggtgtaccactgtacccacaagacacagctccacaacatgtcaccatgtgcctcagtactaccacggtacctcggaaaggagctgtgacattaccccttgcataacacaacccaccacagtgcaccgttcccggatcatagtcacccccttataaacaaggcatggactccccagcgacccccatgggcttatctccgccacttcttagtttggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgatgaaaacgacaagctaacacgcaaaataaagaaaaagactaataaaaaccaattaaacaatacatataaagtaaacaaacatgtagatcacaattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagaggattattgcgtcagcggctagggtttgcggtggaccgggtgcacggcagcggttcacgggaacggacggccgagatcaaccctatccaaaacggacggccgagatcgatcggatccaccgcggctcacggacggacgacgacgatgacatcagcga

SEQ ID NO: 51870 - DNA, 1501 bp, Oryza sativa
gagagcaatggaggaggccacctattgaatttgggctaggttgggctggcccctagttcggctgaaccaggaggtggttcggccgaacccccctggcaccgttggatgcatggttttttttggacggcatgaatcactccccaacgacggttggagggcaattccgaccattccaactgccacaaccgtcattggcagcctatttaaagagctcctcttctcacttcactcacacacctcaagcaaaggtctctcatattctctcatgtttagtttattatctagctagtggaataagaatagagtagaaatcggtgtccagaagcatttggaagagttcgggtatggctatagtagctcttctcttcacttttttaagctttctactatattagggtactcttctttatacatttatggtattgaaatactttccgagtatatgaatgccaactttacattatgttcatgctatactgaatatactgctagcttatctgggagatgctttggtgcgggtataatttttgcatatgcaattactctatgtcatgacgatgatattagaatagtatctggtagtttaggcgtggtgtctagattacgagatatcattatttggggttatatgctgcggatgagaggtgggccgctgatggtgacagctcagtacgggtattcctccgtgcgtgtatatagtcctaagttaatttccttgggagggtactcctctgtatttagccccggctgtatggtcatgacgggctatcataagaaactcgacagttaggggtggtttctcgaagtaccaggagggcatcggatagagggtattagctagtatgtcagataactaggatgtatgtatactatgtatactagaagtataggaatagattctctttctcttttctttccacttagcttagatattttatatgagaatgagtagcttcctgcttgtgtgtcactctacccttggattatattaacccctgctaagggtacgattattataaataatatataaattattagtcaggttctcactaccatgatctttccacgggattaaataaatacgacacccttggaatacactcggtgaaatgctacaatggtatatccgtgcgcttgcggatgaactctgtaaccataatataccaggagtatttttgcgccattgcttggaattatatttcaagtaatgtcgttaagaaatatcaacaagcattttctggcgccgttggcggggaagattcataatagagattactagaactaacactttatatttacctctatataatcactgccctttgcaggctaaccttggttgttttcacttttgttgtggaaacagggtagtgtttcaatttgccagaaaactttaaggaaaatccagaagctttcttccggagcatcaagccacgagtcgtcgctccacagaaaactctcccgacaaagaaaccagccataccagcactaccaaccttcaaga

SEQ ID NO: 51871 - DNA, 1501 bp, Oryza sativa
agcgcgcgcgggcggcggagggcagtgctagggctgacacgttgaggcgtcggggccagctggggtctccaccgtcggctccggtggacggcgaggcacgtttgggccagccggggtctccaccgtcggcttctccgccagccaccgaatccccttcgtccacgctcccaacatcgccaccagctccgtctccgcccatcgggtcattggcctcggcatcacctctaacgacgacgacggcctcacgggtggctcgaccgcgtgcggctgcgaagcaaggcgacttggttgacggcggcggcggtggcggcgactgcttgcgaggtgcggcgaggcgacgacggcgatggctggagggtggttcgaccgtgcgcggttggtccatgcgatggctgcgaggcacagtgaggcgacaacggcggctccttgctcgaccgcgcatggcgtagctgctccgcacagggcctgacgcgacgagatgacatggtcgaagggtaaattagtccgaggatatttctttctactccaaactaacaccgttatcttaaaatataacggaagtgctatgtatcgaaggaaaattggtcctccgtgcttctggtcgaagtgaaaaatttgttgtgctattttttggtaattttttttcggtcccccgttgagcattctcgcactatcgcgaataggggcttcgttgtaattggatataggcccctctcccgcgccgcctccgcctccccctcgccccgtccccgtcgccgagcgccgccgccgccccctcaaaccctagccgccgccacccgttcgctctccctctgtcgcgccgccgcctccgcctccccctcgcgccgtcctcgtcgccgagtgccgccaccaccccctcgcgcctttgccacctcctccgctgccgccatcgccggtcactcttccacctgcacgcccgccggtccccaccccgacgacatcgacctccacgcccaccggccgcccaaccccgacgaactcgtctcctgcgtccctcaagcccgcaccggcggcgctcgcctcggtggcacagggggaggaggacgacgaagagaagacggaggtggatgacggcggtggcggcggcggctgcgcgcggacgccggatttggggtgcccctactactacgctccaccgaagacggtgacgacgacgccgccgccgcctcctcctgcggcgtcggcggttggagggtgggatttctttaacccgttttacggggcgcccctctgccgccatcgccgccgccgtgtccacctccgccgtcgtctcggagcgccgttgccgtcggcgaggcgagcagccatctccgccgctgcctccccctccccctcgtgcgccgctgccgtctcatcgccgtcttcgagcgcctccgcctcagggccggcccagcagtgcggccgcactaggccctcaaactcacaggtcccccacctagctccgtaagaatcgtaaagagcgatgccagagccgcttatt

SEQ ID NO: 51872 - DNA, 1501 bp, Oryza sativa
tacaccctatcacatcgaatatttgggcatatatatggagtattaaatataaacgaaaaaaataactaattacacaatttacgtgtaaattgcgagacaaatcttttaagcctaattgcgttatgatttcgcagtttaaagacgtattctgtaatttgtttgtgtgtccatatatccgatgtgacacgccaaaattttacaaaactacgtctaaacacagccctagtagtagatccagcctgtgactgcgacttgtggccgctggttgcagttgccgtcacaagttcacaagtcagaacacacctgcggctgcgtacgctgagctcgttgatagatttgggctagccccaacgttgacaacatccaccgttccggtggagttagccggacgccttaaaatagaatagccccggacgcggcaacgacgcgcagaatcttggccggtgtggtgttgcagccaggagccagagccctcaaccccgcaggcgcgcagcagcagtggcgcgcgcgcgcggggcatccgtctcaggcggctcagggcaggtcgggcgagagggagaggagatcgacgcgcggcgtcccctcagccggaggaaaggtaagagaagctctctctgtctcccgttgcctcccttgctttcttcgcacgaagagcagtggcatactggcatatggccgtgggactgtatcgagagcagctgttcttgatgtgtgctagtaccttatttgctgtttcgaccaccctagtcaatccctgcatcgtctcgcaaatttcttctacggtttgatgccctttttatggagaagaagagagaactggagaaatattatctaaacgaatgaggatagagataggtggggggacttggtcgacaaagaaatggacagatcgaggggagatccgatcagggtagtagagatcctcaatagtcaatacctgcacccttcccgtgaccaaagggcaactggtcaaaaaggtcaggctgccttgctttgattttggccttaaccagatcatcttgcctgctgctgctagcgtataataatgctcaagtcaaataacacattagctgattagggtttaggatgatggtaactcacctggggaaatggagcagaatggtttcacgtcctgctgctcaattagagttgctcatgaccagccgtgcacctctttccgatagaattcagtttataggaggcatatgcaggtgactggaattttctggcgtagcacacctgcaattggagcaatcagatattgtaggattctagcatgtaataattcacaaaaaaataatgcttagaagaatgcagcccctcggttctctgtgcaatcctgtgatatccagcaaatattgccttagttttacataacttttgagcttacaaatcctttctttccatcccacttatttgtcaaattgcacaacgttcatgccattttctgaattttaggtttttggctgtgaccgtaacagatccaggctaatccaatgga

SEQ ID NO: 51873 - DNA, 1501 bp, Oryza sativa
tttggcataagggatataatgctcttattttttttataaggaatgtgagggtgtggcccgcatctcaattcgagtccgttaatttttttcatataaagttgacctggatctagaaaaatattccatttcaaggattattctgtcccacctgttatcgaaccgaacaccctgaaaatagatttgtccccacatgactatctcatccctttcaaccaaatacattataacttattgacggttctgcagctctggctcgtttcggaaaagagctatgatggaggctcgggctcagctaatttggcttacaagctgagctgagctttttgtcctcacctagttctgcccatggggaatctaacattatcaatcatacaccatatcttaaagagatgctgctatgatacgtcaagaagtcaagttttaaggtagaatatatggtagttgggaaaatagaatcattacataaatgttagaaaatagggatgccaacgcgacatgcttgcaggctttgaggcccagtaaacctaattgtacttttttttcatccatttttattatatacttgttgatgaaaattaacttagaatatgggctcttatgtaagatagcatcgcctgcatccttacaaagagacagatagatccaatcgtacaattaaatcagtaattttataagagaatgaaataacattctagctagtgtatccaagaatgcacagtgaagtccgtatttaagtcccatccaaaacgatgtgatgttagatctgatccaaaatatttaataatgtagctcaagttttgcatagcccctgagaaccagacaagccaatgttaaaattcctactgtgcatagggagggcaatcaatcatcctactgcatgagtaggtccctgcttcctgttcaaaatactttctccgttctacgaagactacatttttagaacaaagctaacaaactaatggtgagagaagaaaaatcaaatgaacactcattaatacgaaaataaattatcgtcaaatgataacctaggaataattttgagttacagattaattataggtaagaaagaacaaagttaaagcgatcgaaaatgaagtctatttaaggaccagtttagtatggctctagctatagctccactcattctatagctggagtccaaccaaatagtttctacacctaaaatagaaatatagttggctagagcgttatcacaaaataaactagagaggtggagttgagttcagaccgctacacaacttcactttaaactttaactcctaaagttaaattttaagagatgaagatctactaaacaggctttaatacggaggaaatgcattcatccacaaaggtcaaaagcagcagaaagagaacgaatgcctttgctgcattcaacccaaagcagagctgcaggggtgccaactgccaatcaggcaatcatccactctgggagcgacaggcgacgccattgatgggcacaccccctcgccggggccga

SEQ ID NO: 51874 - DNA, 834 bp, Oryza sativa
aattctctatagtatcgtccatttcataggattttcaaaggattggatagatttcgatcctctgtctcaatgggctttatagaagatgttcctatagaattgaaatcctctaacattattatgttttcctcccggtagagcatctccatcagtcttgttaaatttgcctctctatttactcatttgccagccctcaaccatttgaagagccctccaacccatttggagagtacagtttagttttccttgcaacagtctctcctatatactctcaaaactgacggtggaacaagtatgtcagtctcacattagcaatagtcttcccatcgagcaccggtggcgattcggttggctagctccggcggctcgtagagctgccgacccaagcgggcaagctcttgcgtctaaccggcggtcgggaggtcgcgactcgtcaggctggctccggcagtaggaagaggcggcgacccggcggtagggaggccgcgactcagcgagctagctccggctgcgtgggacaaatactcaaaaatcttagaattatatcgagttgtgtgtgaattagattgcgaataggcccttggtaaaaatgaaaaaaaatatgggggttttcagtttttacaagcccatttggtcaatactgggctacccgttgttggcccgaccgccggaggctcactcgcagcggtcgatcatggcggggatgtagaagagccggcgggtgacggcgctagacgattaatatcggcgtcggcggcaggagaaagcgtcgaccctcctccccagaatcagaggtgcactcccccttcgtatcgtgatcaatcgcttaaaaaa

SEQ ID NO: 51875 - DNA, 1501 bp, Oryza sativa
gtgtaccacttgcctaggaagacttggcccattttatttccagtaactttagccctgaattttttacactgatatactttatttggcaggttggagttagaagccatgttgcaaaagggtgtcaaatttgagattgaggcgttatctgcatgttccatttcctttttatcagaagagtacattcccaagaagatcaaacaaggaagacatatataagattggttgtacctgtatctatccagaaattttcatgtggcaaaagtcttattttgtttttgtcatgctaactgtagtcacatgtatggcactctggtagtttaacccccagcaagtattttgtagcaattgtttatatatgacggtgatttggtgctgtctcaagaactgaaaaccacaaatttacagcaactgaaattttactattactatctctgctactaagagcatctccaaggtatgtctaaaattaggctcctaaaaacctgtattgggagtatcacaaaagatattgggctcaaaaatcacccacatctccaacagtatcccaatacctgattccaaaagaactttaaaatctgccatatcatcactggtgggttctcttaaactgatttttctccaattgggagtgcgtggaggtgcccaaaattagctcctattgggttggattttggatgtgcctaaatattgggacctcctttgggaacctgttggagggttggttttacccttaattcccaaaatttaacttttaggaacaagattaggcctctcttggagatgctctaacaataccacctaaagagttgtgcagctttatttggggtttattgcatttctaacagaaaccttttataagtgaatacctctatagtctgcaattatgcatgtcttttctcattttctgccagatcgtcatcctgtggaagctgagattaactatcccgatcttacctgagacttagtctccagccatcatcagccttttttccttgcagagttgcagttatggagttaagaagaacgggcaacaaaacaaaggaaaggttgcttaaattccaggtgaaatctacacccacacaagttatatcatttgcacataacaagccgaaagcattgcattgactgaaaagtagcttatcgagtttcatatatagtctccagccatcatcagccttttttccttgcagagttgcagttatggagttaagaagaacgggcaacaaaactaaggaaaggttgcttaaattccaggtgaaatctacacccacacaacctatcatttgcacataacaagccgaaaacattgcaatgactgaaaagtagcttatcgaatttcatatatgcaggtgtgtgagctcggtgttacttcacaaatacttgtctcttacacatgttcaggagctgatccactatgttagatgtaggaggtaaggaccactcatttcttttgttacttactgaattacccgtgggcaattagatagagtataggtgataa

SEQ ID NO: 51876 - DNA, 1501 bp, Oryza sativa
atagcaaaatcatccaaaccaacagatctggacatgcaagaaaagaacggcggcggcgactcctgcttctgctcctcttcttcgtggcggcggcggctgccgcgctcgccgcggcggcctgtgtcgcgtggcttcgccgctcccctgggtccggcggcgctgctcgaggtccccctcggcaaggtcgccacggtggaggcgtgccccgctcgagcctttcccctcctccgccggccgctcgtccgctcccgccaccggctgcttgtccgctcctgccgccggccgtccgttggcgccacatcgtccactcccaccgctcccgagtccgcgcgggaggagaagcgagcggcgcggtcaacggcaaggcgcacggcggcggcgtccccggcgtccgccgcgagggaggagagcacgacgagggaggagaagggaggagaaggcgaggcgaaggggaggagaagccgagaaggcgatttgctgagggtgggggtaggtgaggaaaaataatttgtgtgcgctacccgtgtccttgcgtagggtgccgcccactgcgggcttcgtttcttttatctgtgtctctatccaactaagccacacatatatgggtacttgcactgtggggtgggtgttttggactaactttttaggctaggggtacgggccccatagcttgcactgtgagaggccttactacaccgcgatgcgcgatcttgttctggctggcagcttttttgcctctggtgctctacatgataatggttgaaagcgatagcatttctttcggagactattctcactcaattgaaaattaactatatctatcaatatatttatcaattcatctgtcagtattgacaacaatctgaccatttcttttgacgtcgtgttgttattgacaccgaacatttgaattgataaatatagtttcttctatatagataaatttgtttatatatctttatctaataaaaaatacataagaatttcggtttaaccgtcgccgatgatggccgtctagcgagcttccctagcattctgaggctgtgttcgtcatttgttgttcccagccagaacagtccgtacgaaaaatggagcgacatattagcgcatgatcaattaagtattagctttttttttcaaaaatatattaatttgattttttaaacaactttcgtataaaaactttttgaaaaaaacgcacagtttaaccgtttgaaaaacggacgtgcggaaaacgagggagatgggttgggaaaagtgggtgccgaacacaccctgaggctgtgttcggatgtacgtattaccaacccagtgcacacggaaaacagagcggtccattactgcgtgattaattaagtatttgctattttttttaaaaaaaatggatcaatatgatttttaagcaactttcatatagaattttttttaaaaaaaatagatcaatatgatttttaagcaactttcatatagattttttttaaaaaaaattacaccgtttaac

SEQ ID NO: 51877 - DNA, 1501 bp, Oryza sativa
aaaataatttctatgattttatctatcaatctaactatttaacgtcatatttaaaacgttgaggtatttttagaaaagaaataagaattatactacctccgtctcaaaataagtgcagccgtggatatccgtgcccaatatttaattatccgttttatttgaaaaaattgtgaaaaatttaaaaatatttagtcatgcataaaatactattcatgttttatcatctaatagcaatgaaaatactaatcataacaaaatttttaaataagacgaacggtgaaacgttgaacatgaatagtgtaaaactgcacttattttatgacggagggagtatcatttacccagaaaagatgttcagttgttcgataattttctagacagttttcatctagtgcgcgtactcacctgacgtgacggtgagtttggtgttctcatctcactttgtacatacacacggctggatgagtcactcacccaaccgatgaaagtgaaactagcggtgcgtaatcatgctcagcctttttttgtgacgtcgacccggggacaaaaaatgggtcaagtagggagaatgacagtaaacacctggcagtaattaatgaggtgattataatgtcaaacctaatctgctaatcatagttcagagatttcggagcagcctttcagagttggggggtcgttgcacggatgggcgaagcaggcaggctgcggttggaaacctggaccatgcatgccgtgcgcccacaagccgcaagtctcgtgcaccagcacgttctctcgtgcagtacgtatatatcctagttataggttgtgtttcagcgtaaagttttaattttgattgaaattagagatgatatgactgaaaagttatctgtgtatgacaggttgatgtgatggaaaaggactgaagtttggatccaaactatgaatctaaacacagccataatgtggcttgtacctgtggatgggtcccagctgcagctgccgatccatgcggccaatgagaataatgggatcagcttgcggttgacgagagtccaatgttcgaacacgtcatctacacagtagtgtgcatgcaattactctcacagtgctaacgaagaacatcatgtgacctttttgatacgcacagaaaaccctaataattggttccatggccttttgataggcacaactaacattaaataattgattagcagtacagctttacaagtgatgtttctaaaattttcaatgttgtgtagtacaatgcattagccaatttaccaataacttaagttgacagagataaaacagatgatgacataaagaaaagaagcgttttggcacgtatatgcatgttggtatacatgccgcacaggcgacccaagcactaagagcatcaccaacaggctacctatatgattcctaaaactaattgagggattttagtctaaatcagttccaacagatcccctaccctcctactcgagttttggagttctcttcccccggttgctcgctc

SEQ ID NO: 51878 - DNA, 1501 bp, Oryza sativa
ttgttttctcagaatgtcaaaaacatagagttgtcgctaagtaggctatcacctcagtagcagactagattggctcaaaaccatggacttcaggaaaagtgagcaactcagagcatataattcaggaagtgttaggtctacgcacatgattacttcctccatctttaaaaaaacgtatttctaactatgaacttgatagacatttatacatatacatagttagagttgatttttttttacgaaggatgtatgttttttaaataaacatgtcataagtccgagggacctatcgttgtcactattttcgtatcttgtaggctggctatgctcattactctgcttgcgccaatggtttgttagttgcagacaaaacatgagaacgacattgctaggatatctgaattgttttgcctgttcctttggatgcgaggacacttgtccgctgttttctgcaaacgattttgctaaacgtatgcatcgcgtcgcaactcgcaagaggcaaggccagtaggcctcatccaagctatccacggttccgtaatctggcagttgtttcttcacgtgccgggtatatgaatagataattatacttattgctttcaaggtccatgcttcaaatatcagcacccaattaaattttcttattggtttcatccatgcatacaaatcaaagacttcatgttgttcattaaattattttctcttttcaaaagcagtttgctcgaccaaacatcatgtcaacattttagtacggtaaaagtggctaaaagctagataatctatccctttttctttgtataggtatagtcgtatagaaagaattcacaaacaggaggtaaaactagcaaagtgtagtaactattgcataaaaagttacacgaaacgagcacaaagtacatatcccagaaaaaggcatggtatggatgtatggtcaaccacgaaatgatgcacatagcttgcacagttgcaccctttaccacctaatccacctcttagaggatttgaatcatgtaagatcaatatgtgttttgattcttattctgtgatgaacaattggcatttgtaattattggttttgatatttagagattattgttcaagaggttttagagataattgattttcaggtgatgaataccggtcagaccgggcggtggttgccggtcagaccggcttgtgttagcagtcagaccggccagcccacggtctgaccggccgacgctgtgtcggtttcggtttcgggttgtttctttgaatatccgtgattgtttcatggttatggcttctagatgaatactatatgtatgtaatactgttgtttgctactaatgagtcaagttggtgatagcttggtctcggaatatggtttctttgtttatttcatgtgtaggtgacttgatgcctcgggagagtatttgcggtgatggaccgggagtcggcttggggttaagacgacgtccgtggtggtcagagatcatgtggaaacttaggctagagttga

SEQ ID NO: 51879 - DNA, 1501 bp, Oryza sativa
tcggacttaaaatgacgcacccttcgccaacaggtaaatggtatgtatctgcatatttgttttccacaattgaaatttttgcatcaatacatgtttgaatttcaaaattgcatttaggatctttgaattttgaggaaattcttcaaatgaaattttcagagcaaaccaaaataaaattttcaatgaaaattgtttgtttcacgaccacactgaccgttggaacccaacgaccgaaagtggggccggttgggcccaccaggggatcggccgaaccccctggttcggccgaaccggccaggctaacggtcaggtgcctctttctttgaggcaacggctagtgagcccaacaggtcagtttatccgttgagggtgcactagttaagccaaccggccgggagagggaactccaccccatttcaacacatttacattccctctccaaagtttgctctcaagttcattcaagctttgatagtttccctcaaattcaaaaacttagttgcatatatacaagttgcttaggtgaaactaatcggcgggtgaaactcgtgctatttctaacccccgccgagttagtccgttcttgctccattgtgcagaatgaagaggcgactgtctcgtctgttcaaggggtccggctcttcgtcaagtcatcatgacgagtctagtgctcgttcatcagccgatgtctcgatggaggatgccgacgctccgcgacgtctcctgaacgacaccgacctcgaccttgtcgatgatcatgaaagacaagcttactacatgctgagtgaccgggagtatgctcacacgcgaaagtactcaccagagctgctgaaaaagataggtctgtatgttgattttcgtgctatttggaaagctgttggttggcagagatttgctgtggtagatgagcctggttctcgtttgcttactttgcaatttctgtgcactttgaaaaaaatagaagatggaatttcctttcgctttttccataaggaatacacacttacatggaaggattaagtactcttcttggttttcactattcctgtaaaatcgatctccagaaagaaatttctgggttcaagaaaaataggttttgggaagacatttctggtgctccaatatgcaagaaacctaggacgaatgatatccctaatcctacacttaggctcatgcacaaatggattgctatgactctgtttcctagaggtgatcttagacccattaggggggatgaattaattattatgtttgccatggttagaaagatcaaagtttctcctgtgaaatgtatgataagacaatggttagaaagtataagattttctgctcctgttgagtgcacttctctgattactcggatagcaaaagggctaggggtcgttagtaaccagattgctttcatctcaaccgctcgtccttgtattgatgagaaatatctagtgcaatggcacattcttaaacatggagtagatggatctttgatatactttttccccga

SEQ ID NO: 51880 - DNA, 1501 bp, Oryza sativa
ggaaaaggcatggttatgaaaatatatatatatatgaaggagggaaaggcatggttatgaaaaaaaggagggaaaggcatggttatgaaaacaaggagggaaaggcagttagaccgacggcatcgcgtcagtcagaccggcggcgactttagacggctgcagcttcttcggggcggttagaccggacgatctactccggttagaccaacgacttccaggtggtcagaccggctactctactttggtcagacctcgatccgtcaaattaaagggtaactttaatttcttctaaaagttttgtttttttggttacactaaccattcacccccctcttattggcttagttctttctagtcgatcctacaggacgtgctgataccggtagaggtgcttatcaagtatcaacgtgggaatacgaggaggcgatcaggttgttgtaacaaccctcccaccagaaccgcgcagcccagtccatctgatgggtgggcccacttacacattgcacctcacttgtagtttcatccttacttcgtgtaaaaagattaacccaggagtagtatggttgaagggacaaactcttataagttggttccatccttactaacccaacaatgtggtactccctccatctacttttgatagtcatatttccaaatctgaaaaatttatttttgataggcatatttcaatccaacaacctatcatcttaatgactttctcggatttaatgtgtaactcttcattcttctacacaagattggctacatgggcatcgagaaatgtaaatattaatgaatcgcttgtttacgagaaataactagtagcatatttaaatggatgataagtagaattacttatccttggtctatgtgccaagatgaaatatgactattaaaagtagatgaagggagtaataaacatgacacagcactcatgaaccacattaccacacacaggtcacgtcctaattggtctaggatgtcacagttgttatcgactacttcctctacaccgacatgcggctacgtcagactggtcttctctaactcttatttcactgcttagcacgtcggatggtgacgatccatgatcccttactcacatggttcctggtttacgtggtagaaaaattttgttttatgctattgtagcctacctgtaaccttataaaggctctacacactttgtctttacgtgctttagattttcaagcttagggcatattttgggaagctttagatttagagagaacctcatgagaatctagttggtaataatcttgataagccggaaaaccaacatgtagtttctagtttattttgcggattctacaactatagtttctcataatttggacgagactagactgcttgaccttgctccaagactctacaaggaatctacgccccggcgttgattttggtaattaaatacaagcgctaattgtggaccgctatttcatatttaatttaagtgagataatttgagttaggaatttca

SEQ ID NO: 51881 - DNA, 157 bp, Oryza sativa
gaaaagttgaaaatttgtgtgtaggaaagttttgatgtgatgaaaaagttaaaaatttaaaggaaaagttgagaactaaatcagaccttagcacactgaagttggtaatttgtcaacaaagcgatgtggcgagacagggagaaaaaaatgggatgca

SEQ ID NO: 51882 - DNA, 1501 bp, Oryza sativa
tgaatcctgcgtcaatgcattccctgtattgctcttcgacaagggcataggtagtaagcttaccctttttcttctttgatatcaacctgacaataaaattagataagattttaacatgcaaataataatatcatattaaagctactagcataattcattaccctactgcaaccaaaatgttcagaagttcttcattttccttgttgcgtctaactccaagctggtataaacgcatccacagttcatctgtacttaaaaaaaaaacattttggttacatggtttcttcattaacggtgaaaaggacaaaattgactcactcactctcataaactggcattcctctgatcaatgacagagcaaagaaggaaaaggaaactgcccagtcttcccaagtgtctgaagcctccaaatccaaatcatcttgaggtgagctgtctttaccaaaaaaccactcctgagccttcctaaagggagcggacactgctatggcaccaagtctatctgctgtctgatctagctttgccttgaattcctcatcatctaagacactgtgtgcgaattttttggcaaattcgtcggcgtcaacgatataggccattttaaccccaacacaatagagcgcgaacagcacaagatacacagatgcagtaacactgagtgaaattacagctgttgtgacttttccagtgcgctccatagatctaattaacatgaaaaaacaagaagaaaaacagaacggaaatcaagaacatcccaactaattaagcctcaaagaaacaagatcggtcaagcattaaaaggaaggaattttttttacctcttaaggctttggaaagaggaagtggagaccttgacagcattcatttgagcagcacttagttgttggagttcggtaaggatctcttcaagctgggaatccaccgacctggtccattcctccaatcttcgcttgccgtcgcctccggggatgccgcctcctgagctccggccaccacctccgccgctagagccggacatcccgcgcctggcgccgagcccgagcgagccgactctgccgccgtaggagaaggcggttggcggcggccagaggcgggcggcggcgaggttgccgggctgcagcagcctcgccgccccttggtggtggtgcacgcggacgccggcgaacacgatgtccgcagccgccctcctcctcccggcgagcagcgcggtggcgactcggggaatcgccattcgtaggcggcggcggtggcggtggcctagggtttcctagctcgctaccttttgtcctacgctgtcgtcttatggatgatactaaaccctccctcctccacccgcttcccctgtcactgttaattactatcatcatgcatgtaataaaactgcttaggctgacttcttatcacctagctcttggctaattcctcttttatcgatcgttttcgaactaacagtgtgcatcgtgcaaatatatagtactcgctccgtttcacaatgtaagtc

SEQ ID NO: 51883 - DNA, 1501 bp, Oryza sativa
aactggagactcatctttcttttctccgcgtgcaaaaaaacacgaagaaacaccagttcaacatggtcccaggctcccagcccatcgttccatttgagtttttcttcttgggcttcccggagaggtctgaaatcctcgtgggcttcctcaaattaggcctagagaatcacacgctcgtctcaactatctctactcagggtttacgattccgagatggccttccgtttcaggctctatcggaataacggttttcataaaatcaagtggaaagccgatagattccgaacaaattttataaactaattttttttgtggggttataaactaaaatttgaatataaattccctgagtttaccaataagttcgtgaaaaactggtcggccttaacaaaattccgagcgaaatcatcgaaatgtcaatcggtaacttgaaaagaggtaaactgaaagtgttttcctttttttaatttgttattcttttctttcctactgtaaattttagtaaatacacgaaatacattattttttttgaaaatttatatcccaatagattctatgagtatcatactatttataatattttatttatttattttccttttttatcaattcaaatttgaatttggatgaaactcgtcgaaatatcatacgggttctattttcgagcctcgttgaaacctcgaaatttcgtggaattcaaccagttttcgtcggaattatgaaccccgtctctactactccctccatctcaatttgatcatatatttacgaacaacatcaacatcaagactagaaaacatcattacttctgaaaatacaccttatcgatttaaggtgttgtattatacatgcaaatgggcatgcaaatatgcaattgaatacatacgaggcatgcagcaatcggggtagttaaagattggggcgatctgctcgcaccagagaattttggacggcgtggacgcacgcgcgtctatccacgtcccccgcgcgttggaaggctggtgtttttcgggcgctctccttactcgtccgcagcgtcgtccgatcagcatctcgcgaccagagagcgctggagctggtaagtttgcaaaaaaaaaaaaaccctcccttaccttaataatctttcttaagtccctcaatgtaagttcgttgtcttatgtattcttatgtaaaggccctcgggcgctctccttactcgtccgcagcgccgtccgatcagcatctcgcgaccagagagcgctggagctggtaagtttgcaaaaaaaaaccctcccttaccttgataatctttcttaagttcctcaatgtaagttcgttgtcttatgtattattatgtaaaggccctcaagatatatcttacgtgaaagagacaacatttcaagtataggacagcgctctgaaaaagagaaaataagggagttttctgaaaaaaaaaaagaacacccaatcccccgaaaccctagccactactgttccccaatcccttctcttcctttccctt

SEQ ID NO: 51884 - DNA, 1501 bp, Oryza sativa
actcacgtgtgtcagggttatggataccacatacctacctaatacctaatagtagttgattaaatctcggcaggacccaccatatactatgtcttatactgacactgacctcggatatggatgaagttccggataaggaaagacaaccagagttctatatggaaacgacaagaactactcggattgtattcatattggtttccctagttttacttggacaaagggacacttatgggtataaatacaagaccctctaagaggagaggggacacggaacaatagatcaagacataagatcaatatacaagccaacatacgccaagacaagacgctaggtatcgacttcagagataggcatgactagtcccctacgatgcctatggctaccgtcaggagagatatagagttgtctctgatctatgcggattcgaggaggaaggttaccatgttgtcgactacgagtcaatactacagaccgccaggtcgacaacagttagataggctaccccaaatattatactggtatgattatggtgaataagagcaataccggcttcggccaacaggatgtagggttattacctgacaattcaggggcccgaacctgtataaaaatcctcgtcgttatctcttttacctaagtctcgtatacatcttagtaccaacgatccccatactatgtaaataccggaaccgcgacatcaaacgtcgaccgacaacgtggtacagtataaaaaagtttttaaatatttttaggtctgatcaaaccatcgaatccaatcaatacagggcctactctaccaaagttctggcctttgggaagcatttccccatttttttagcacttaccacgagtggaaaaggacggacttctgcgcgaggaagaagaaccggatgacgttgtacggctttcctctctcggtttcccgacgcgaccgcctccgccgccatcgccgcctctcctcacctcgccgcgccgcgccgccccgcctcggccgcgcgcgtcccctcttccccgcctaagccccgcatcccgctcacccaccccacgcaccaacccccgcctcgcctcgccgtcgtcgtcgccgtcgccccctcgcctcgccgcctctgcgtggtggtgaggtagtaatcgctgttgcttcggtttccctttggttgggaggtgggaggaggaagacgaagagagggagagagagagggagatattatcttgggctgccttgccgtgcagtgtggctcgctgtcccactcaggtgcggcgctattccaatccgtgcttatccccggcagaatccaatccccctcgcggcttttctccaaaagcgctccgccttctcgcctatttcgctcgctgccgcggccatgattccccgctgatacctccgcgcgcccatttggttcctcctcgccgaatcccccttcgcagccggtggttctagttgaggaggaggaggaggggatttggttgggggcgagggggaggagggggttgtggaga

SEQ ID NO: 51885 - DNA, 869 bp, Oryza sativa
acgaacgaggacgaacgttaacgtgaaatgcaatatatatatatatatacatgtatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaatgtaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgaattagattgttaaaacataaatgtctcgtgacttagcagatgtttcttgtatcaacaga

SEQ ID NO: 51886 - DNA, 1501 bp, Oryza sativa
gatccgctgctgtggcacggccgctgccgccgctgtggtgtgccgcagctgcctcctccaggcagccgccggccacaggagctcgccgcctccccctccgccggatctagtggaggggagggcgcagcagccgccgccgccgcctcaggcagccaccggccgcgggagctcgccgcctcccttcccgctggatctggcggaggggagggcgcagccgccgccgccactgcctcaggcagtcgcccgccgcgggagctcgcccgctgcctcaggtgccggttttaactgaaccggcacagataaatgtgattctaggtctttttcagagattaaagataaacgaaaatgactctgatgatcctcttttagtaatgtgtagttggagaggagatggttgttggatttaagattgggtgaaaattaaataagaagtggtctgatggaggaagcagtactctaaaatctcttatatttatggataaattttgaacccaaatccattatatatgtttgtgcaaagaaggaatacttattagcctcgacatgatacttattcatttcacgcacggatattattaatatttattttgtttgttgcatgtcaccatgatatatggtacgcagtaaagactttttttgtccattaaggtggtcaagtgtacatgataacagacttgaaagtttcatctgtagcattttattgccaacttccaatgataattcagtcaacttcttaaacatttacattttcaagcattgagagtgtttccaaagaaagtatatttatgtggtaaggtgttggtttggagtttggaccattatttattggcaacaaaattgattgctatcatagtaaaagtttcttataaactttatattgacctcatccttttccttatgcagatatcgttgtcttaacatctcacttagctaggactgattgaagaaacacagtaaagtggtggaatgagaaatatccatgaaattatactctaaactgcgtaagtttaattaatatcatttaatccttataagtattgggagcagtttatttgaattttaagcatatgcatatatagttgaaacaattcgaatcacactatatatatggagtgacaagaaggggataaagttgggttttttttttaatcacgagcaagagtactgtttcatctattttactggaagaaataaatttctattcgtaccttgatttgtttatatatatctagatttaattttgcaatgcattgagtgatacacgatgacataatttatattctcaacatttttcaaaatcttcatggttatttagaaggcatgcaaataatcaataatctttgccccataatgcttcacgaccattttatgataatttgaagctaaactgcattacaaataatgaattgagtggaggaacatgccatgaaacttgcccataaataaattagggaatataagaaaattgccacatttgtcaaaatagcatgacattattttg

SEQ ID NO: 51887 - DNA, 1501 bp, Oryza sativa
gtggttttagtaatggaaaccactagttttttggtgtgttgttgaggttttacacttttactagtgcaaggactttcatctttgtagtggccggtgggttagttctgtggcagattggcatttgctgtgtccttgacatgtgaaaaatctgattttggtttgtgagctgacttttggtctggtgatttggtgtatatgtggaaacttatagaactaggacgtgtatgtaagtgctcgaggtatttgtttatgtggtagttttcgccttcaaagttcaaacgtgactacaagtacttcctccgtttcatattacaagactttctagcattgcccacatttatatagatgttaatgatatgggcaatgctagaaagtcttataatatgaaacggagggagtactttatatactatgtatattgttttgtcttgaagccaatttgttgagaataaaatttaactatttatcttgtcctaaaatttgacgttgcatgtgaactattcaaaatcagacaccagggaatacgacaaactttgcttatctggtaaactttaggtattgggtattagaaggcaggtgttctttttttttcaaaaaaaaaatcatattagggaattagggatcttcttgttggattttatggtttgagcttcgcacaatctgtgtgaatggtttgagcaattcagagttgacgatggtggtctgcactggtccctgtttaccctgaaattttgtctaaaggaattatttttgttgtctgcagagtcaacagctttggggaattccgaatgtacatatggtggacacttgttttggagagctttgaggttgccatgttgctcgacccatggattttggttgtctcaaacctggattttgtttgttttggggcaaactaatgaatcagtacgtttcgtttattttgggaagcaaactggagtaatttatcagtactacctgtatgtatgaactacttgtccgctggagcctggaatatcacatggggtaaacgactttgatttgttagttccattctgtcatcgatcactgttggatcgattggtaaaaggccttattgcagcaaacctagcgtttcagtttgtttgcattctgactgtcactggaatgatcccactgtctcatttatgtttatgttttgttcgtatggcttattaacaaatagacaataatttatgagtaaaacttttatatgtatatcttcagctattgaaaagcaaatgctataaaatgaaccacaaaacaaatttcaaaattaagttttggcttataagcacaagggaaaggatgggacggtcctgaatacctacctgaacgcctgatccacaatgcaatcaaatcagaagacgaaaaccctaaccagttggcgcttaaaagtattcatctatctattacttatattttcaggcttgtaacacatcctacatcatttcagcaacaaaattacagctccagttcagttattctttttcatttatctagg

SEQ ID NO: 51888 - DNA, 811 bp, Oryza sativa
aaacataaataatactttatgcgtgacttatttttttctaaatttttcaaataaaacggataatgagatgaatggagtaagactgtgagagcgagcaaagaatataatccaagcaaaaataatgctgaattacaattttgcatgattgttctaatagctggatttccatttatgccaattcgggaaatgttcattctggttattgcagctattatagagttagaagtaatattccttatggtgttggaatatgatacattaaagtgttattaattaccatttcggtggttcgatattccttgagccaggagtattgattcccatgtgttattgtcctaccatcatattcattgtaccaatatatcaaccattcaaccgcggcacgacaagagtttccggataaatatattcaagatatgctagaacattatagccagctaaagttgaaacataataataactaatatcgcgaagaccccgtcaagattcaacagtaattttatacgcggtgtggaggccatcgatcgcgcacacctaaccaaattgcttcaaaagatgaagcagctagcatgacagcccccacaccaaagcaagatgctgtgggtaaattatgggttactctatccacatcacaccgcgtgaaaagacaactttgcccctgcctcctctgatgtaaagagagaaaagaataaaaaggaaatgtggaaagatctcatgcctctttcacagggcaggagaaaaataaatttgacaagtggcactgaccgtacacaggagaggccagaaaaaaaaacttaaagatgatgggtca

SEQ ID NO: 51889 - DNA, 328 bp, Oryza sativa
tcctgcagcccaccagaagtaacgaacacagccttagccatgatactcatgaggagatggagattcaaactcaagttgcttgggcgagagttcgctgtctagacctttagacctgcagctggttgacattgatatggcatataaacatattatattataggtttccggttctgcatttgaagcagacgacataacagttggaccactagacctatgagttaggagagttcgtccggttcaacatccggtctaggttttccaacatccgattctgcagtcaggaattataaggatatcatcgtgataatactggacacaaaatggcaca

SEQ ID NO: 51890 - DNA, 1349 bp, Oryza sativa
ttgttgcatatgcattgttcggtaacaaaggcaatggtggcttcagaattttagttgggtgatatcctattccatagtttgaaattgtataatgtcaaaattatgtctattttatcacaattttcgttggatgaatgatgggggtacttttataccaaaattggagggtgattcaagaccaccctcaaaatctctagaaccaccattgattaagggtatggctggttagatgatatccacatttttccacattatttcttttgcaatgtatgggtgctaccaagagagacatgctagttcgggtccgaatcctcatggacccagattatctcacctatttcttttctatcatttttaggcattaagtttctcctcagtagtccaaccaaatttaagagaacggcagttagctcagctggcagggtgctactaggagcgatgtgttgcctaaagtttgaatccttatggatttagattatctaatctatttcttctatattatttttggatgctaagttcctccttagtactataaccaattattttttgcaatgcgtggtatatgcatgtcatatattttgtggctaaaatttattagccacacttgtagcaacttgtgacagagagaagggaatccgtcgttgatgtggcatgccacagttaaagtatgtaccaaaaggacaaaaggttagcctagctcggttgatcaaacttgtctggtacaaatgtgataaagttgacactcgacctaacaagccctaattcattaattggttttggttgtagtttagtaatcccttcttttctagaaagttaagaccattaactgtgcttagaagaaaccacgtcatcgatttcttttctcaccataggattgattattgatggcatatattgccatcacatcaccttgcccctgtccatttcctctcctttccgtttctgcttgagaaattacaggaaaactaacacaattaattaggccacaaggagctttaacgagcctcttagcatcccttcatgagcctcttaattaacatcccttcaacattcataacagaccacaaataccttccaccatcctctgaactcatgattcacagtaaatatgcaacattttttaggattaaataactagatgactatttcttttgaagaataacgaagacgctgcaattcagttcctaatgttgcatgccctattttatttttcgactatattggttcggttgaagttttacttacaagtgtttgctcaatatttgtaagtatcaaccatcatatcattctctctctttttatatggtattttcatttcttcaaagtattgatataaaatcccgcagcaa

SEQ ID NO: 51891 - DNA, 354 bp, Oryza sativa
agaagcacagcttaaaaagctattagtattttttaattccctccgatcggttattatttgaaatgccctccgatccttaggtttaagcaggtggacgatctgcctatacaaaatgccaagtgggcccatatgtgaaaattcattttcatatatggatggcttaagagatcacatgctccgtttaaatggtgctattacacaaattaatcagtaagtaatgtaaattgatctcgtccatgagcaacatctaattaatcttcaagatcttgatcaaaatttcagtcccggccggcaacataattattttgtgacgtcgcagagatcgatcgatcagattaattgatcatagagaca

SEQ ID NO: 51892 - DNA, 1501 bp, Oryza sativa
ggtgaatggcggtgacttcgtgctgcacggcgctggttgatcgtgtcgcgaaggtcgacgggacgtcggtgaggtggagagcgaggccgttcgactcggctctccctgtgacgttcgggaggcgagtgaacagatcgttcgtcgtgacccctgctcctgcgactagatcctgtgccgatgatgctgaggcttggctgatgataatcatgagatcggaagtgggggactcggctaccagtcggggtgcgggtgcttgtggagttggctggaaccgaggcagcgatcatggtcttcgtctggttcaagatgttgacaacatgatcggcttggttgagtgcgtcttccttgaggagggtgtcgaggagagtgattgctgcaaccgcgttctgctggggggtgcgaaagactgctgtcccatcgacgtcttgttgcccaatgagctctctcgctctccgcccagattccaaggcgtgttgtcgtcgatcttcagcctcctttgcaatccgttcgtgatcctgttgctcacgctgtagtcgttctcgctcttgtcgctgtcgctcttcctccagttggcgacgttcagcttcttgccgtgcgcgatcttggtccgcttctcgggcttggcgctgttcctccgtttcattgtcagccatgaatacgccgaagtagaggggcgtgtagttatcctcatagctatcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctggatcggatcggggccgaagccggagctcgcctagatcttcgagtggaagatgtcttgactgtgaagacaacggccaaatcatcaggaagtttcatcaggattgggggataggacccgtcgtcttgatctggtcgcggaagagtagattggatctcatccgagtggtttgaagctgactcgggagagatgatcttggagtaggcctcggccgagttcgggataccgaatggcacagggacctggtctctccccgactggtttaaatccgagtcaaggagagagatcttgccgaagtcgttggtgatgaagttgaggctgccgaactggaacgcatgcccgggagggaaggcgaagtcgtcgatgccagaaacgaaacccatcgcacttagtcggcgagaacttgacgctacccctacctagcgcgccaactgtcgaaacaagatttcggcaataataaaagggggtggctatcaagttaggaaagtggatgggtttagagacaagggattttatacaagttcaggccttcttattcaaaaagtaataccctactcctgtccggggatgattccgccgagtgtattattgattgtatgattgggagaaaaaagaatcgtcccgagaggaacccggaccc

SEQ ID NO: 51893 - DNA, 1501 bp, Oryza sativa
attgggatgttatttggttgagacccacatgaaaaaaatcgattttcgaatacgagcctgtcgaaacaagattttggcaataataaaagggggtggctatcaagttaggaaagtggatgggtttagagacaagggattttatacaggttcaggccttcttattcaagaagtaataccctactcctgtccggggatgattccgccgagtgtgttattgattgtatgattgggagaaaaaagaatcgtcccgagaggaacccggacccctccttatataggggaagggatccgtattacaaagtacagcccatatcctaacggaacatgggattacagatagaatacaatcgtaaccgactaggatcccgggtattttcttgatatacaagtttagaatccaacccgaatcctcataaagatgttctatctatatttagtaccgtatatccgactaaagtataaccgtcatgcagatatggggtaaccataatctccacattagcccccgagaccttcgcagttgaccaaaataatcttctcgaaacaaaaaacaataatccgagtgcttcaattcaacttgctccggcttgccgagtactaaaaaactgtgaagggcgaaaacatggtgcatcgagtagatgcacctaattaggtgtagccccccgactatgtgattagttgaaaaactaaacagatagtcaagaaccaagtggttttatagcgaagcacgcatggtacttagtaagatacccagccaactgcttctcaatctgaatatatcaaggacaaaaaatacgagaagggccgagtgataaacactcaaaaggtccaaaaatagatatatttggtaggaatccgagtaagaaactcttataatgatccaccaaatatgataaagatcatggtaattaagaagttcattagcctaggctataactcttaccataattaaaataagcatataacatgctaaaagaatgaccattaataaaccagtcatctcaaatgaacccaacagcttttgtagcctaaaaagcttacaaaaatggtataacacctttctgtcgggcaccttttcatgtgcatcataataattctaaagaattattgaatcacgttaaaaaggattttaacagcatcgggctgcgccattgtgagcacatattgccaaagcaaaaagcacctaagtccgtagggatcacaacgggccacgctgaaaacataattgggctgaaatactgtacaggcctaggcccattagtactcccgataccctaaaaataccgaagtccaaacgtcgcttcgtcttccccgccgagactctcgccattccccactccgtgctacagtacagaaccgcgccaacaaagctagggttcatcaatccgctccaatccatcctcaaaaacttcctgaaatttctccccgcatccaccgctccgattccccatccctttccagccgtatctcgaactaaatcaaatcatctagttcacattca

SEQ ID NO: 51894 - DNA, 1501 bp, Oryza sativa
gagcaaaataattggtgccgaatccctggaaacagtcttgacgacagggacgtacccggaataaaagagaaaaatatgagcaaaaaggctcaagaaaagaaaaagttaaaaaattctcttggttattatgtgctaaagtttatttgagaaagagtgataaatgcaataggtatatgtgtttagtgtttattcttcaacctatgtgcttgttaagatgttccattataaatcgtatgaaatcatgaattttgattgttgattcaggcttaattgtaaaatctttggttcatggttatactttaatgcatgcttgttatattatagataggtttatcttctttttattgcaacacatgacttgatatgctatatgtatgctaagctcttgaacattaatgaacataattcctatgcttgatgaaatcattgtcaaaatggggagaagtaatgtgaaattttttggacttttgggagaagcaagatgaatttttggagttgatgagaagagcatgttgtttttgggttcaattgggaatttctttcttttaaaaagggggagaagttttcttttggatttttgagcacgatgtgtatgtttgtacgaagtatgctttttaccacttttgtttttatttttccaaacaccaaaatatttttatgagtttgccaatgtgttcatcaacggggagattgtaaaatcaaaggtgtttttgattattattctgtgatgaacaattgggtattggagattattggttttgttatttggaatttattcacgaagtggttttggagatgattggaatttacaggtgaatttataggataatgctgttatttcatgtgaccggtcagaccgggcagtgtgtgccggttagaccggcggtgatcgcgtggtcggaccggccagctcgcggtcttaccggccgacgctgtgtcggttttggtttcgggttgtttgtttggatatccgtgattatttcatgattatgacttctagatggatactatacgtatgtaatactgttgtttgctactaatgagtcaagttggagatagtttggtctcggaatatggtttctttgtttatttcatgtgtaggtgactcgatgtctcgggagagtatttgcggtgatggaccaggagtcggcttggggataagacgacgtccgtggtggtcagagatcatgcgggatactaaggctagagttgatgcacgtggttgatggagattccatatggcatacgatggaggtattttgtacgtatgggatgcggagtcgaatttggaaggagtccaaatttggtacgattggttatgtaaagtttctttcttgtatcctgaggtgtttaggactcttagtatgagtttcgttcatggctttaggctacctatctcgggtataaatagaggtggagcgtgaggcttcccggtatcgcttttgagagaaattgagttgagttttgagtttcgagtttagtcaaaatttttgtaaggagt

SEQ ID NO: 51895 - DNA, 1501 bp, Oryza sativa
atatggtccagctcattgctttgaatgtggtggtcttgatcacattcattcgcattgtcctaagcttgggagaggcaagaaggaagacaatggtgaagagaagaccaaggacaacaaacccaagagcatgtttgttggtatttcttacgaccacagataaatccgcaagcgcacggaatactgctgtagcgcttaaccttcgggtgaccccaaaaggacatcgaactcaaggaacgtgtgtaatctacctaaggttaagactatccaaggacaacaactgatggtaggcaggctaggctagagaggactttctatgtgttttaattatctaagctaagttaacggtaatttcctctctgttgcttcaggcaccgacccctgctggtctgctagcgtggttccggctataggtctatgatatatccgaacgtggaggattactaggacgggattcagggctgtcaccacctgccgtctacctctgacaaatccgtgggatacacaacaaacaaaggtaatctctaacctagacaccacatctaagttattaattactactctaatacttgtacaggaacttccttctctatccggagtcctagtactagagcacttagtatgaatactaaacaatgaacccgcaaagatagaaatatatcttactcagactaagtaattaaataacataagaaaggagcagagtgtaccgacagctctgctactcctccagaattcctgctaggaagctacactcatcgaggtagaagtcggatgagcgccaaactttcgggcactcctccagagcttcctctcactctctaccttattctaatgtacacaagatacaatagagcctcttgtaattcagctcaaagttgtgtgttggaaatgagagtgagctcgtccttttataggcaggtatgacggttacagcctttgtgaaataaccaaaccacctcggaaccgccatcaggaagtaatcagggccgtccacgtcgaatctcgcgatcaatgacctcaaaagtggttcggctgaacccgggagggctccattcggcccgtttttcctcgtggacactaattttgaggccctcagcccattggcatgatggttgggcccatttggagttgtctaattgacttatggggcctccaatccatgtaaatgtatcctgaatgcgtggaggtgcagtttgtcgcttgacggatgtgttttcttctcaaaatacatgcatacatgtatttcaccaacactagtggaaatgattagtaataatccgtaccactaagttggatactatgttttagttcataatatgcaggtattgacggtcaaatattatgattttaggaccatcgacagtgttcaaagggaagaagactaaggagaatctcaagaagatgtttgatcaagtctatgccgcttttgagccattaagtgatgtagatggtgagagtgaagatgaagagaagggaaagaacatctccggtgtttgcttta

SEQ ID NO: 51896 - DNA, 1501 bp, Oryza sativa
ctagtgagaagctcgagaagaatgactccaaagctatatacatcgttgctggctgtgagctggtactcgagtagatagtccggatcaatatagcctggtgtaccttttggcacaacttgggttttctcatcgattgttgaacaaccaaagtcggacaccttcgcaaccaatccctctgcgagaagaatgttggctggcttcacatcgccgtggagtattggacgtggcagcgagtagagatgtgcaaatgcatctgcggattctgcagcgatccttagacgtgttcctagtgtgacatgaaacctcttgctcctctggagatccaacagctcttgtagtgttttgttttgcacaaactcatagacaagcataggtgcctcaaactgaaggcaacaacccaacagcctgacgatgttggtatggttgacgcgacaaaggatgaccaattcctgcacaaagtccatttttttgctctcattaatctccttgcacctctttattgccatggtagtgccatctatcactgctctgtaaacagttccctgtcctccttccccaataatgtgtgccttgttgaagttatttgttgcaatcttgatccgctctctctcatagagggtgaaccccgcattgccctctaccttcatcatttctagaaggagctgacctccgtgttgttgaaaaaactcatcagcctgtcttaatagagcttgtttttttattctctgtttgtacttgatcaccccccatccaaggaaaccaaagaggccaaccaatgcacccgcaacaactcctgaacgaacaaattggaagttgtaatcaatttatggtctaagcaagtatgttaacatcagtattgttttacgtttatgtaagccataaccaaatcaagtagatcaagagttttgtttacatttccacacgaaacacatcagaagtcaaacaaaaactagttatattgcaatggaattcaagacgttggaagcctcaactatattgaaagtatatgtacgtgatgagatagagttggtataggtgcgtaccaattgctattcgtactccggatgttaagatgattttttggcatgctccttcaacaaaggcatttcctcgggtacccttagggcatgtacagtcgaaatgccctggtatatttttgcagtttccataacaagggtatttcttcggttctttgcattcatcaatatctacacaaataattacatatagggaaattattgcatgaatagaagaaatttataatgaaaaaagttagcaatttagcattttttttggcatatgaattgaactccgaagaaaagaagacacaaatatatattaaataaacaatacagaatgataggtagatatatagtaagctcttgggtgctatcgcttcctcgccgattaaagttacacgaggatgcatttacaacattatggagatgtatttactagtaatgacgtctttgtaatcctggcaagtatttacaactttttg

SEQ ID NO: 51897 - DNA, 1501 bp, Oryza sativa
gtttttatgatttttgaggtgaaaatttcaaatcttttagttggaagttttcatgcttttaagatgaaagtttgcatactttgatttgaatgttttctggctttaagatgaatgtttttgtggttttaagatgaaagcttgattcgagataaaagttctctgattttttatttgaaagttttctaatccgaagatgaaagttttggactcgggatgaaagttttcagacttcgatttgaaattttcatgttaagacgaaagtttcatatattttcaggttgtgttgtgtgtttagttcgcgccaaaattgaaattttggttgaaattagaacgatataacggaaaaattagaagtttgtatgtgtagtaaagttttgatgtgatggaaaaattagaagtttgaaaaaaaagtttggaactaaactcagccaaacttccaatctctgatttttagttggaaatcaccaattgaaagtcttgacttcggagtccgatttcccctgatggagcacagcgttaaacgtctggaaaaagtctacaaaaagtagaatggacttataaaaaatatgttgcctaggcgtcttcttcaacggtcacggagcaaaaatgggtactgtagtccgtagacatcttcggtctacgcatcgtgcttctatgcagatgtcttgtttaagaaaaagaaatcaatttccgtttccggtacaggtagataggcgtacgctacgcgtcttttgtccaataataatacgatgttctcctaactgacttccatcgttccatgattagcgttaagctcaagcaaacgcaacgaactacagtagctagtagtactattgtgttccaaaatgtagtaaaatatacagaagccaaattagcagttaggaaacatagagtcgaaatgtcaaattcctacatgtccttagccgcgtcgcgccggttgaacgcacagttttcaacttgacaagaatgttaggggcatataaatttggtttattgttagcataaatcttatcaaagttcggtctatagttattttactccctacgtcaaaatatctggacacattactagctattccctccgtcccaaaaatatataagcatttttagaatagtaaaaagtcaaacatttttaactttaactattaatagcaaaaaaataaaaaaagatcaataacgtaaaattgatgttacaaaatttatcattaaacaaactatcataatatgcaactccttttatttaaaacattttacttttatagttattgttggtcaaagtagtatctcagagaccgtatcggagtctaaaaaatacttatattttgggacggatgtagtattatgcatgtaggtaaaagaatgtgaaatgattgtttgattttgagagttgcgagaaacgtctagtggtattccggctagcttcacaaaatggtggcctagatggcttgggttcgaagctcacccattctaattatttgaaaggcaaattttgctacaggaca

SEQ ID NO: 51898 - DNA, 1501 bp, Oryza sativa
tacgggcccacgttactgcctaactcggtcataaacattgctgttgcccaaaatgcagtaaaaagttcgggactcattgggttctcgtactacctccgtttctaaatatttaacgctgttgatttttttaaatatgtttgaccatttatcttatttaaaaaaaattaagtaattattacttatttttctatcatttgatttattgttaaatatactttcatgtatacatatagttttacatatttcacaaatttttttaataagacgaacggtcaaacatgtgctaaaaagccaatagtgtcaagcatttagaaatggagggagtattttctaataattcaaaacggtttattgagaaatacaaattaataggtaaaacttttacatatttattcgtaatgacttaaacaccaacataaaaagaaattatattaaaaatataaaatcatcttctatatatttattcgtaatgacctatttgttcccgctcttcttttgtgtggttgaatgatataaattaagtccgaccaatatttaagagagttaaattggactttttccttatctgtgaaatctgcatctatctcatctcgagcacagttggttctgctgatcaacaccgcatcagatcagatgcaggtggtctaaattgctgagacagacagagagggaaacagacaaatagtgcacaagaaacagcaagtgaggtgtgattactcgatggttggtcctcaatttcttgatctaacgttccaaccggtgcaacaagaagtgaaacgctatttattactggagtagcaacattcagagacttttccttattatggagtaatattacatatggcctttaaataagttggccgggcctgtttaaatcacactaatcacctggaatattataagtacagtatttttaaaaatcgcgaaagtgaaacacgcccagcagaagaacctcggtatcttcttcagatgttttttttttttttttttttttgaggaaactatcttcttcagatgttcacccttgtcttttcaacacctgccaccactatctgccgacgtatttttgcataaacacgagaaagtctccagaagaccagaggatgagcagaaacacgagaaaaggtcaaaggcggaggtcagcatatcgctcatcagttctactccgtagtccgtagatgaacaaacatgcagattaatactcgtattagatagcagagagactctttccatcacgccaagcctgggagcaatttaattccgcgtaattttcgatttcttttctaaacctgaccgcgtcagtcagtgtagaccggtcgctgtttcagattaattagcctctggttcttgacctgaatgtgcgtggaattgcagagaactgcaagttttgtttgctacaagtagtaggtgtagacttgtagtagctgtgttctccggctgattcggccgccggcgatggccgctggtgagctcgtgacaagatcgtccatggctgctgctt

SEQ ID NO: 51899 - DNA, 1501 bp, Oryza sativa
cactgtggtgagttgtgttgtgtgagaggtattgtcacagttcctttccaaggtactgtggtggtactgaggcgcatggtgacatgttgtggagttgtgtcttgtgggtacagtggtacatctctgatcagagtaaaactattcgaatagtcgtgcccgcggttatgggtgagtttaacaatgtttttcgtgattagtctcacacttctcattaatgataatattgtgttaattaatttgactcctggtttggaatggtatattcctggtatggagatttgatttgtacaaccggggttggttgttcagatgaggttgggcctatgcaacacgggtgtgttgtatagtgtttatttaatactgattaattattcaactgttttattattctttaaaatgtttattaaatgctgtttatgcaaatgagctttcctatgccattctttgttatcctgtgcacttgcatatttgctgtgtggcttgttgagtatgtcatatgctcattcttgcaatattcattcatcagaggaggagtatatcaatgaaggtgatgatctggaggattaggcgttgttcaggtcaagttgcttgtggagtggagtcaccatagctgttcagtctttgttttattttccgccgcttagaattttattctatgagaggaactatccacctctgtaataatttattttgcgaatattaattagctgtttgatagtactctattatcaatttgttattgtgtgcctcggctgattcttggacgagggttaaacgcacatataagtgtttggaattttggatagaaattccgggcgtgacactaatgatgtatgcttagcatattacatttatagctttgttggtatacaatatagtctccaacaaggtttatggtggaaaatgatgagagagaaaaatttgttgagggaaaattaggttaaaagaatgtggataaatatgttgtaaaagagatggcaaaggaaaaggccgaggaaaactaagttaaaataatagtaaaaacttagttaatttaataaatggttagagaaaagtacaatacattgaaggtatggttagaaatttaaaaataatgaaaaaatgaataatatgtgcgatttttgtataattattttatgattatttgtataaaagaatgggaaactaagttaattgaaaaatagttaaatagctataaataagtacattaaattaaaaatgacaaaggaaaaaactaatatagaaaattaagatgaaagaatacaaacctaagttaatttaaaaatcgttagaatagttagaaataagtacaatatagtcttccgtctcggcgccatctttgtcgctcttgcgataggcgccttcttccatgtcatcccaaattcatttaaaatatgtaacgtcggttttgagtttaaggatgatgttttaaattattgtatgattatttatttagtttacttttgtagattttatttttacgatttatatgcatttcagg

SEQ ID NO: 51900 - DNA, 1501 bp, Oryza sativa
taataaggacgaaacgagtatacgtactagctagtagcgtttagtatccacatcatctgcttacctgtgttttgtcgtactcttctttcgtcacttatttacaggctggcgcaagcgcggtccaaatccgtccagaggtaaggccctctttagttaccacataaaaaatttacgtcttattatatcgaacgtttaagtatccctgtataaaatattaaatatagaattaaaaaataactaattgcacagattgcgactaatttacgagacgaatcttttaagcctaattactacatgatttgacaatgtggtacttgctaatgatggattaattaggattaattaggcttaataaattcgtctcgcggtttagtgacggatgttgtagttagtgtttttatcagtgtccaaacaacccatgcgacaccctatataatacccaacgtggcacaccaaaattttacaccgctgatgagggctgaccggttaccttaaatctgcgggactcccgactgcattgtcacgtaggaaggctgtaagcattgtctctcgtttctctccagctggtcaagccgatcgatcagtactggtagtatcgttgtcacccttgcgcgccgatcgatcgacgccggcggcgatggccgatgtttctttgatcagttgcgctgtcggcatcatcttcttctccgccgtttgctacctgcctacggctcctgtcgccgccttgtccttcaactacaccaacttcaattcaaacaacccgagcatcgaatatgaaggcaacgcctctttcagcgtcgggtatatcgacatcagcttgaacgaagccaacggcatgggcaacagcgccggacgggtgtcctacaagcagccggtgcagctctgggagtgggacgccgccaccggcgaggtggccagcttcaccacaaccttctccttcaacatcacgccgagcgataggaacaacaggggcgacgggatggccttattcctcggcagctacccatcgaagttaccagaccgcgccggtggccacaacctcggcctaaccaaccaaacaatcggcaacgtctcgaccggtgacaagaggaagacaagaggaagcccagcccagacgatccatgcgagatcggcggcccacgagcaagtatgtgtcgagtgagtggacccggtagctgtcgaccgggccactgtcagagagggagcgagatcttttggcacatcgctatataagatcggcaaagtagagagagaaggaatcgaacattgtagaaacaactaaattcccaattcaattcaaatctctctctctctctctgttctattgcttcctctgttcttcctctgtttctcttctcaattcacgaattcctcttcgaattcccatggtttcgtcatcgtcttggcgtgaattccacaagtgccgtgacatttggtatcagagcagcgatcctggagaaaccaaggtacacttctcgtttgcaatcgcaggttgaggcaa

SEQ ID NO: 51901 - DNA, 1501 bp, Oryza sativa
aaaaccgggactaaaaaccatttttactcccggtttaaaaatgcaacgggaagaattgatctttactaccaatcgggactaaagatggtttgccgattgtcaggatgtgtcaggtcccccggatctttaatcccggttggtaacaccaacctggacaaaagatgggatatttagtttcagtttgtgttaccaaccgggactaaaaatcttggccatttttagacccggttggtaacaacaactgggactaaaattaccctccatatatgtcatcttcttcttcctctagcccgagaaggcatcaaaattttcttgagttttgaggggaggtgctaccaaaatttttggttttttgttttggtgataatatacaacttggaggtgtcaaaaaggttagcaacttcatcctcctctcttttgttgttagcatttggatttagagatatattttgtatactattttgcctctagaaatttggattgggtgatgatgagagagaaagtttgtgtaaggatgaagtaatgtagaaaattaatctaaaagaatataaaacttaattaagttaatttaaattaagtaaaacacattaattatttgtttacaactttaatgtggaattaaaacatgattaatttgtgctattattattataattattgttcgaataattatatataactgttgtatgcttgtttaatttgatagaaaactaagttaatttaaaatcaaaaataattacaatacattaaatatttgttaattaaaacatgaataatatgtggtattaatttataatcaaattagtttatttagaatttgaaaaaaatcttgtgataaaagagatgaggaagtaaaatatagaagattaatctaaaagaatagaaaactaagtcaatttaaattaaattaagtacaacacattttgtccaggggagatacccgtagatgtcacaccctaaaaattcaaaatatataaattgttgtttaaatggaatttttagaaataatttttaaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcctcttttggctttgggccgaaagtcggcccaaaaccctctctctctcctcggcccaagtcggcccagtccgccggccgctctcctctctctctcccgctgactggtgggccccacctgtcagggtcgtcgtcttcgtcgcgccgtcgccgcccgaaaccctagcgcgccgccgccgccgtttccttccaaatccggccgctcctttccttctccggccgaattgatagaggggaaatgatcttctcgatctcctcttccttttctcttttggaaacatcggctaattcgt

SEQ ID NO: 51902 - DNA, 1501 bp, Oryza sativa
gctatgcaacccacgaagacatgtttttatcccacataaactaaactggcaatatgaatattaaatcatgtgtagtgtaaactgacaagacatacacagaaagccaaaatatctctcaacagcttaccttctgcagcttccttgcgggccatatttgccttcatcaaatcagccgatgcttcagcagcctcaattccagctaagccagtgcagtagctatttcggatagtctgcttgcagcatttgtagccccactgatgatctttccaccatgagccccatacggttgtatggttattaatgaaaacatcctcttcatatttgctcttgggaagggctacatcctgtatgaaatgaactttgagaatccatgaactaatacatgcaaaagacaatagataatgtgaacaactgaaaagtattaaagtaatgacccagaaatggatagagctaataggaaaaactggtataagagctccacaaaacctacactcgtgtggagagttctacattcatgtgctgttccacatttcttaagtttcttgcagttgtaatgaatggtctctataacttgcaactgcctaagtgcttagaacaaaccttaagcttcttgtcatctgatgcgatatggaactagttagctaaacagcgttctcagaaacagattattatgtgtagttagctaaacagcacatcttatatggtgtagagttctatagtgacaggttacggaaatagactattaaaggaagaactatgacaacattacactggcaaagaacaaaaaaaaaacacttgagatttgaaggatgacagaagattaggttgaaaccactacatcctagcatcctaggaagaaataactattgagcaagaagctatagaagtgtaatcgacagtaactagtattgtataccaacctgtcctttgattattcgaccagttcggtcatattcaatctctttttcactttgtccaagaagaagctcccgagggattggttcttcagatgcagcattcccatacttctccataatcttatctttgttttcagatttcaatttctcctttttgatcttaaaactcttgaatagaagttcagcttgagatggggcagcttgcatgtgaatatcctgtcccttatcaaaagcttcccacgcatgtatgttgagttgcttgaactccagagcttgtccgctaagtcgattttggttatcaccctgtgaaaaacaacacatcagaatactgaacctagtagtctttgcaagataagaaatcaatatgggccataacacagtgtaaagcattaaacttgtagggtgtctcatacttaccacatagaatttatcattggggtctgcatctggcaatggatcttcacgcatggagcgggtttttggatcatagtatgcagagttcacatcaaggttcagaagatactttgcagtgtcttccctaatacgcaaattcctcacagttccagtgcttccaccacctgttg

SEQ ID NO: 51903 - DNA, 1501 bp, Oryza sativa
tgtcaaaatggggaataacaagagaccgccatggatttccttgacgatacgtttaactcccaacatatcggagtagaagatctaccatgcatgaagttaaactagataattaaatttcagtcattaattttgcggtacacttaatgctacattattttacatgttagtgtactcttattcctcacaatgaatgcctctaaagtgtggaagaacactaaatatatcataaacctacaaatgacacaaggaagccaacaatatagcatatgatctatcgatcatctggcgaatcctgtactcagaacggcctttttctcgaggttgtaaaccccgctggtctggctcccattgtaccaaatggacactgtgcttcctcctgtatccgtaaagctcagatcctcaagaactaatggcgactgtgggcatcgctgcacttcatctgctagggcaagccgccgaagctcctccgccacgaccgtcattgctggtcttgttgtacctggaacaactaagcattgactcgctagcatcgctgcacgatagatcaccctcatgctagcttcatcaactatgtcaatgtcaaggagctcacggagtgtatcatgtgctatagcctcctgaaacattgatgtcaagctcctcctttcttttgatagtggcttcttacctgttagaagctcaagaaggataactccaaagctatatacgtcattcttggatgtgagctggtactcgagtagatagtccggatcaatataccccggagtgcctttgggcacagcctgattttcctcatcaattgttgagcacccaaagtcagacacctttgcgatcaatccctcggcaagtaggatattagctggcttcacatcgccatgtagtataggatgcggtaggcaatggagatgcgcaagtgcttcagcggattccgcggcaatcctcaaccgagttcctagtgtgacatggaacctcctgcttctctggaggtcaagcagctcttgcaatgttttgttttgcacaaactcatatacgatcatgggccccttgaactgcaggcaacagccaagcaactttactatgttgggatggttgacacgacaaagtataaccaactcctggacaaagtccctcttcatgctctcgtcaatttccttgcattgttttatcgcaacagcaactccgtctaaatctgccttgtaaactgttccctgtcctccttcccctatgatgtgtgtcttgctgaaattacccgtggcagtctcaatttgcactctgtcgaagagagtgaacccgacattgccctctactttcatcatttctaacaggagctggcctccatgctgctgaaaatactcatcagtttgtctttgtaaattttgccttctgatacttcttttatgctggatcacttctcttatgaggaagctagctagggcaaggaaaacaaaagcagagattcctgtcgatgtgaagattaattagttgttagtatgtacgagaa

SEQ ID NO: 51904 - DNA, 1501 bp, Oryza sativa
atgtataaagtttttacataaaatatattatttagtattttgaaaaatgtactaacggaaaatgacgaaaaatctgtacagaagaattaattccacgttctaccaacctgtcaacgttacagttcagtacaaactataaaatctataaaatcacatgacacttcgacaagtagttaggagctttgcaagttttctcattggattagaaacaatcatccaatttccccttgatgttttcataaataagttgatataattgtcaatgataatcatatgcacatttcgatagtgggggagaagaacatgaagattgttagagtttgtgccgaatataggtacaaaatcggttgcagtttaaaacttatagttgcactagacataaaaatagagtaaaagtcgaactctactctgggaacaagcatggcattcaatctgagtgatttcctcaaagaacaattgatttgtcctatttggtggatcctttttcttctcaagagatagatgatttggtaaagtggacgcctgttgataaagctcctgaccctgatggttttaatgggtatttcttgaagaattaaatgttggcccattgttgcccaagatttttatagtctataaattcttctttcatttctttagtaccaaagaagataaacccagaatcagctaataattttagacccatttccttaagaatataagtctcaaacttctaactaaggctttagctgatagattacaaggagtgatcactgatttaattcaccaaaatcaatatggttttattaaaggcagaacaatacaagattgtttagcatgggcttttgaataaattcatcaatgtcagcaatcaaagagagaaattgttattataaaccttgattttgagaaatcttttgactcaattgagcatgaagcaatcttgatgatattgagacatataggttttcctgctaaatgcttaaactaggtagaaatgatttttaactcagcaaatacttcagttcttttaaatggtgtacctggaatatccttcaaatgcaaaagaagggtcagacaaggggacccgttgtctccacttttgtttgttctaggggctgagttgcttcaatagagttttaatttctaagcctattcagcctgatgaagaaagtgactttccaataattcagtatgctgatgatactattatacttaggaaggctgatcagaaggattttttttttgtctcaaagacttagtttgtacaagctttaatagttattggacattttatatctgattttatagttgaggggcaacgtatgatactcgaccaacagttaatggatccaaagtgaacgtttcccttagaagagggcctaataaggtctatacatgcgcttcagctttttatgcggccgaagggctttgggcctagtgggaggatttttctttgccaactctgtgacagtgagtatgattttcatacttaaaccgcaatactagatacaacgggttc

SEQ ID NO: 51905 - DNA, 1501 bp, Oryza sativa
ggtcacacgatagtatagacccaaaaattttcatgtttacgcttgtcgtggcagatgtctgggcctacttgtcatggccgtcacgctgaaccctgttggattggagcaaaattatagttgcctgaagaggacaaggcggtagttgctccggcgagaagcctgctcggcgtcgcgggtgtcgtcttctccaccatgaacgtgtggcgcctagaccaggtggcgctcgggcggagctgcacgggggtgttcctaggcaacgtggtgtagagccatggcgaactcgtgaaggatgctggtgcaggggctcacgtcgcacggcaagccgccgtatgtccggccaccgccgagctcgctgggtctcccggcccacggcaagtcggcgtcgcatcctcagcaggtgcgagttaatctctgggtgtcgcagtgtgcacgtagtctgacagagtttggcacctggagttttttgttctgaatgcttcatcgcttttccccttttttttcaacgaaaagtccatccatttatcccaagatcgatcaatggcaaaccaattaggagggcctatgtcccaagataatcattcttgcaaagttcttttatgcttggaatactgcttccttttttcccgagttagttagaggcagagtgtgtccattgtccacagaacatctgtttcatcacacacaaatgcaaattgacacataggccctcctaaagaccaagattaaaaagggggcacgcaaaacaagaaagatattaacctgtgattaattaagttttaattattacaaattgaaaaatagatttatctaatattttaaaacaatttttatgtataaagtttttacataaaatatattatttagtattttgaaaaatgtactaacggaaaatgacgaaaaatctgtacagaagaattaattccacgttctaccaacctgtcaacgttacagttcagtacaaactataaaatctataaaatcacatgacacttcgacaagtagttaggagctttgcaagttttctcattggattagaaacaatcatccaatttccccttgatgttttcataaataagttgatataattgtcaatgataatcatatgcacatttcgatagtgggggagaagaacatgaagattgttagagtttgtgccgaatataggtacaaaatcggttgcagtttaaaacttatagttgcactagacataaaaatagagtaaaagtcgaactctactctgggaacaagcatggcattcaatctgagtgatttcctcaaagaacaattgatttgtcctatttggtggatcctttttcttctcaagagatagatgatttggtaaagtggacgcctgttgataaagctcctgaccctgatggttttaatgggtatttcttgaagaattaaatgttggcccattgttgcccaagatttttatagtctataaattcttctttcatttctttagtaccaaagaagataaacccagaatcagctaata

SEQ ID NO: 51906 - DNA, 455 bp, Oryza sativa
taattgagtgatcggtatcgattattaaacactgcaatagattaggtaattccgttcattatataaagcaatacgtattgccttaataataagaaaatgttagggtcggttatctctctctctctctctctaataaaacactctctaaatagtacaacattacacatgttctcaggcaactctagtactagtgttttcgtcaagttcggtccacggaggctgactaaaattttggcccacgaaaagtaattctcaatcccacctttccccgggcatgcagcaacaaatatgatttttgagtattcgactttcttttgagggttaattcaatcctgccattaaaatttgctaatccattacaaaattgctaatttgacaaaatgttattactattcgcgatatctcaacaacaatgacatacaacggtgctggctccggagacctctcgtcgcaga

SEQ ID NO: 51907 - DNA, 1501 bp, Oryza sativa
ctgtcgctgacggacgccatcggggcggcgtggacgttcctcatcttcggcgggctgtccgtggcggcactcgcgttcgtgctcgtctgcgtgccggagaccaagggcctccccatcgaggaggtggagaagatgctcgagggaagggagctccgcctcaggttctgggccaagcgccgccaccaccacggcggcgacggcgacggcggcggagaaaagaccggcggcgtgtgacacgacacgaggcctgtttatttagcgttttgatgactgattcgttgcaaatgaacgaaggagtgtggatttggtccgatcacgcacaaacatgtagtcataaatatttaagtttattaaggtaaaatttagataaacttttgaaactttgatcactgatttcatatcagatcaagtttataaaatcgatggcgtttgcgtttggtgatttgtgaacggagccccattgactggcctaataaatcaaagcaaaagccaacatttaaatttttactctgattttgaagttgattttaagatatttttaatataatttacttttagcgttaacatttaagtcgctacgaacaaatatataaaagtttgacttatgaagtaatttttactccctccattacgtaatataaggcacaaccactttttaaagatgtttcataatataagacatgcatatatacatgaaattaactatgacattttctccattaaattcttacctttttaaatcatttattctcacattctctaattctattggatgcatgtataatagtatttattaggatgatccaaactataagatgataataattattttttggtctttgggttaaaggtggttgtgccttatattttagaattgagaaagtattttctaataaaccgttccacttattaggtaatatatattggattttgtcttatcatccacaacacaagtactctgtattactattattatctcacttataatataataacttttagctacaaatctgaataactatttgcccagattaataactagaaatgcttatattttgagacggaggaaataaatttttaatttttttaaaaaaaactatattagaataagttttgtaaaaatttataaatttattttgttatgatagtgggccggggggagcgacagaggcttcatgatttgggcctctttaggcccataaagtattcagctaaaactggtggcgccaaaagccagcttttgcgcgcgaactccgccgtctccctccctcctcaacctgcacgcaacccctccgccgccgcccttctcccctcgtccccccgtgcgccgccgccgccgaccgctgcaaccagatcggccgacgcgtcctcctccttccgccgccccactctccaccaacctcaccgccgattcctcacccaatcctccattcctgacctagggagaagcttcctcttcctcttctcttcccccgcctgttccttcccttgttggttcgga

SEQ ID NO: 51908 - DNA, 1501 bp, Oryza sativa
agaggagaataaggaaaaaaaaaggcaaaaactgaatgaagaaaaagaaggaagaagaaaattggagcagctccacccagatatgctaagcggatattttcgtgatgtttttttttctccacacatgctccacagcttgatctcgttatttatcttggttagcaaatgcaacatgtccgtttcgttcgcaccatatctcccatgctaccagttttgtctgatttaattgcattagttttgtttttcccaccttaagatgtttgccttatccaccagcatgagtactagccatttgttttgtttattataaagaaattaaggtatctaaagtactaaagtggcacatacgtaaacacattttaagtatgctccagaaatgcttgaaagatctgcccaactttggagatgatttggatttccatttgcacggaatttcgcatcgaccatgatgaggaaggaattgataggcagtgacatgcattcacgtagctgtctcactcgcgctttggtatcttgaactcccatccactaagatgaaaagataggcgccatctagatcaaatgagtcaaaagaaagtttaatcatacactgccctaaagattcgaccaatccattttaaactcgtccaaatttgataaagtttgaccactcggccctgtagtcaatgttaaaactgtaggcaaacaacaaacagcagcgacagaaaataatgcagggaacatgcacatgaacaaacacagttcggtacagagtttctttcatcatttcgatcacgcaattcacatttgctacttggaggcacatcaaatttggcataaggaaatggatagaaaacaacttcatcccacttatccatccgctgacacctgcacaaacaaaccagttttcagttacagagttcacatttgaggggatgccccttcatttcttacatgtcatttaaacaattatagaaaaaatagaaaaaaaattgataagattgatatgtcatactaatatcacttcacgaacatacaagtttgaatttaacctctacaagtaaaaaaacaaatatgacttgacagattaaaatccatttccacagttcagtcactgaagcttgacttgaaaatgaacatcagtcaacagggacaaaaaaaaaattacggaccaaataatgcctgttattatcctactaaaaatcgtcttcgttgtcaccatcagagaggatcaccacgaccacaagtcattggagtcaaagtaaacactgacaaggcgagatcacgccaatcccataatccggaatcttctccttttcgatcaatcagtctctttctctttgtcatctgtgaccatatgacacaagcagacaatgcagtgggggactctgctactgctagtactacacctctatgcagaattgcagatatacttatactagtcagaggccaacttgtgctcctcatttctaagcattgggatgcaaaggataaggggggagagattagattagagagatag

SEQ ID NO: 51909 - DNA, 1501 bp, Oryza sativa
cgtactcataaagaaaatcgtttaggataatatttaagtcaaaccttgagaatataaatcatgaataatttttaaattgttgaatttgaaaatataaaaaatatatgaatagatttgtcttgaaaaatactttcataaaagtatacatatatcacttttcaataaatatttttatagaaacaaaaagtcaaagttgtgttttggagaccgtgtcactgtccaaaacgattccctttatgagtacgaagggagtatatatttcgctgtccagtgtggtgcatgcatagattttacattgctagaaaaatttaatgtggtacatttgataccctgcatgacagaaattatggttaattaattatccgattcttttaaagattcctatcagctgaatattctaattaactaactccccaaaataggggcgatgtgcatgcttttttcgtttctagaagaatatatattcatgatggttgtatgtatacataatgctccatgtgttttgagtgatattgccactagtacagtacggggtatactgtacagtataggagcagtagtatactactctactagtatagctgtacttggagacggctggaggaggcgacatcacgtacggacggccactgtgtgaagcgccgacagcccgacagcataacggcggggccctctccgtctcatctccgccgtcgtttgactcccccgggcccaccaacgcaacctccctcccggggggcaggtgggccccggtgatgacctcctagtcgatggatcatggatcgtcgacacgttacatcacgcgtaaccgtctgatcgtaccgcgtactactacccttcttgccatgcgttccaacctcatcggacggatgggagcatgcatagatgcatgcaggtaaatgcatgtctcgttttgcttttttttttcacaataaaagcaaacaataaaggaactaaagaatactccattcatcctaaaatataagagatttggttggatgggacacatcttaatccagattcatagaactaggatgtgtcacatcgacacatccaacctaaattcctggtattttgggaccgagggagtatattaaagatgatcagtgatttattataggacaaaatagtttttttcctaagtatagaactggatacatagagagagagttatatatgtccgtatgccttggacgatcgacacacatattataactggcggaacaaattacgatatcgttgtattgagcttaattcagaaagcggcccttattagatcaaatattattttgattttcgaaaattttagctcgaggttttaaaccttttctacctgcaagttaatttcgtcttaaaatctaaaaatattgtacttagatcaggatttttcaatcgaatctatgaatgtttctagcctaactcattagttttcaattgatgcaagatcgacttgcagaacaccatggagtgggagagtgtggatctcacgcatgtggctcaa

SEQ ID NO: 51910 - DNA, 1501 bp, Oryza sativa
atgccgccatcgctgaagccgcgcaggcaagcctcaacgtctgcacctaggcctttagcggctgcagctactgtgtgctgtggatggtacccttccattacagtgaggtcttccagatcagctatcacggtggttccttggtgtgcccatgggcagcacaccaactgtttgatgaaatgcatgatcgaggtgcactcctgttactgtttgaatccttattattatctcatatttactctatttttcactgtatgttgtgatttgaagctctgcctatgtaaactaaaattgaattgttccttggtctcgaatacttcatatagtgcaaacaaatatttcatttttgcagggtagaacaccctattattttagtgtatagatttactatgagatacttcactttttaatgactattggagtcacgtcagtatgttaatagtgatatagatatgctaacatgtccaattttacttgatattcccaacacaatagctttgtttcttgactgagatttatttgtctcctctttctactgcagtcaaaagtttgcagataaattcatatttcgtaatcgatcagcaatcctggacagtgtttcaagggacatgtggactcggctgcagtatatctatttgtttaatctttagttgcatataaaatccttttgagatttatttattttaacccacagaaaaaggagatttatttattttaagatatgtccctttattgttcaactgcaactgatttggtagtccatacataacaagatgtaacagatgtgccattaagaattatctgagtccgttctatcaaatgtaaagtaaggtgacttgcccttcccagtattaccttattactgttatttgccttcttttattgataaaaaggtcatgtgaatcatggagtggaatattaaaaagccactgcatatagcattgctttatctggatgagttatcatcaagcatcatcatcatcctgttatttctaatcagcgttgcacatctattttatcaagctcctctgttactttctagctacatgaagtggagttagtaatatattgctctatgaagtgaaagtttctttttgctcaaaaaactactcctataatacaatgcctaaatatgccaattttctaccactactgaatctgaagttcaactgatgtgcttcatttccatgttagcctttatatggttagcccaccagtattaagattaacaaattgcttgttatatttgtgagaactgaaaccgcttcttttgaaatgggctctaattgttgaagtctattttttttcatggtttgagatgaattcttaaatgaccaggaaacaaaatattgatatctttggaattacttgctttgatttttaaatacaatttgtcttgtaactttatttgttttttgttagtgttgaacgattgcaaacaaatggtgcatcacaagttgctggtcaggttcctcaggagtataactttgtcatgtttctgaaa

SEQ ID NO: 51911 - DNA, 1501 bp, Oryza sativa
cataatattcataggtactataaaatttggtaccaaaaggttcaagtatcatgatattgatctccatgacaccaagataccaagatacttgtactatgacatttggtacctaatggttcaattatcattatacctaatatcaccatgatatcttaagatatcatgatatatatttgatacatttatgatatttaggtatcatccatatctatatctatatactactcgtacctgtttaatggtaccatcatacatgataccttcatgatacccaaagaaatcatggtatttaggtatcatccgatatttttatatttattgaagttatcataatacctgaaactttcataatatctgatgatactacctctatattttaatagataacgccattaatttttaggcagacgttggacccttcatcttattcaaaaattttagggctaattggatccataccattaaaaatatgttggttttgaaatatgacactagtattcacgtatcgggaaccatgccattataattttacacgtattcaagatatgccactaccctttggatgcatttacaaaaatctggaccaaactacccttttccccttattccttctcccttcttcccctttcttcttccgcctctcctccatggcgtgacctgactggcgatggtggccaccacagtcacacctcctcctttctctagcactctttcgttcgtgtctccctccaccttagcccgccgccggcctcctcatgcgcgtcatctccctccacctcgacccgccgccggtctcctcttgtgcatcagcgcgtcctagatccagtcgcctctcctcgccgtgtgaggagctctgggcaatggcgatgaccaaagaattaaagagcggccacttctctctggcaagctcctgcacctccctccctccctccctcaccgcacccgcagcttctccggttcagcagctgcctccaccacctcgacgcccgatgcagcgaggacggccttcgtgaagagcctcggcagatggcggacctgcggtgttctgtccggcgctccgagctcccgcgacggatgtcgcaggcgaagagaggtagaagatgagtgaagagagagagatagaagatgaggggatttttcgtccaatacatgcaaaatacgtatcttagtggcaccattgagattacgaacaagcagcagtggcattgttacaaatacacaaatagtaatggtatattttaaaaccggcaattttttagtggcacgtatctaattaacccaaaatttttaatatgtgagtgtgtacgttctatgaatctgtcacaagtcatgacgccgcgagccgcgtccagctacaaaccactcaacccaaacgcatccaaaacccctcgctgagctgccatgcatgcactccccctcctcccactataaattatcaccacctcattcccgccatgtctcaccaccaccaccaccaacactgcaacacaacacaccacca

SEQ ID NO: 51912 - DNA, 1501 bp, Oryza sativa
ttattagtgtccgacggggtatattagaaaccgagggttctcaatttgacgggaaaataaacctctcggtgagaataagaataaccgacggtatacgctcgggaaatgtgtcggcaagaaagaaccatgcgtggtctctggaaaaaaagaccgaccgtaaccctcgggtacatggttaccgagggtaccctcggcaatatgataaattaccgaccacatgtgcgtgttgccgagggtaaccactcagtaatatgtatggccgacagttttataggtggccgaccttaaacccccttggtaaaagttaggaatcttgtagtagcatcttgaaaaactaaatcggtatatcttaaattacctagatgcatatcgataaatatgtagactactataatgaaaataatttagtttagatgtataatgcaaaagatactagctagttcgatctggagaaaaagatgtacatgaggaaagcataagaacattcacaatacgattctattatcagattatagaagaaaaataaattgttatcagattatatatattatgaaactagtaaataacactaataccatatacttcctccatcctaatctccctgcatcttctaatataagggattttgacattttacttacactgtttgaccattcgtcttataaaaaaattagaattattatttattttatttgtgaattactttattatctaaagtactttaagtataacttttcatttttacatttgcacaaatttataaaatatactccctccatcccataatataagggattttggagggatgtgacatcctagtacattatatctggacaggctctccatatagatgtattttactggttgtgtcacatccctctaaatattcttatattatgggacataggaagtaagatattttagttgaaagaaatatatcttagtattatgaatcttacgcaaacactaggatatatcttatcgaaccaaaatctcttatattttgaagtaatatacttaggctgtgttcaccattgcttgttcccaaggaacagtgcgcaacgggaaacggagtggtccattagcgcgtgattaattaagtattagtttttttttcaaaaatggattaatttgatttttttaaacaactttcgtataaaaacttttcgcaaaaaacacaccatttagcagtgtagaaaacatgtgtgaggaaaacgagcttgggaaaaggggcatccgaacacacgctgtgtttagatttcaacctttttccttcaaacatccaacttttctgtcacatcaaatgtttagacaaatgtatggagcattaaatgtggaagaaaaaaccaattacacagcttgcatgtaaattgcgagacgaattttttgagcctgattacgccatgattagccataagtgctacggtaacccacatttcctaatgatggattaattaggttcaaaatattcgtctcgtagtttatagttcaaatctataat

SEQ ID NO: 51913 - DNA, 1501 bp, Oryza sativa
ggtttatggttacatgctggcattttgatgcgaatttgcaaggaaattcaagaaaattagtccttgtctcttgcatagatattgggaataacagaataagaggtcatcttcctgcctattatctcccacaaatccaccatgaaagaagggcaagatagcttcatcttctcgtacccttggctttccatgacgccttccatcttcttggaggtggccaagaactcgatgcacgcctccttgagcttctggcaatggtgctgatccgccattgccagcgtcgccgcgacggtgtccacggcgatgctcttgcagagcatgagctcgcagatcagcttcagcctctcgacgtcgtaccggtcggcggcctcgagaaggtgcatgatcatctgcgccttgtcgtcgtcgtcgtcgtcgaggtcgtccatggcggcggtcgtgtcggtgtagatgaagtggaggagagcccggaacaccgccggctcgacgctgtcgatggcgacgcggccggcgttcgcgtccgtggactccttcattggcccgtagagcgccgccttgaacaccggcgaacgcatggcgagcaccgcccggtgcgcggcgaactcctcgccccgcacgacgagcgtcacgtcggcggtgcccttgtcgccgaggagcccggcgaggtggccgaggatgttcgacggcggatggtcgagctccggcgcgtcgccggcggtgacgacggggtccaggacgacgttgacgacgcactcgatggtgaggcggtcgtcgcggacgaaccccatctcctccagctcgcgccgccgcatgaacctcaggtgcccccacgccgggaacgcctgggagaacacgcgcgacgtcgagccgtccatgggccagcgcacggaccgcggctcgccggtggccgggtggatcagcctgaggtcgtagaacgcgcgcgccaccgcgccgcctccgccgccgccagcggcggcggcggcgttcttgagctcgaggtagaccgagacgaagtccatgtcggcggccgtgacgccctccgggtagaacacgacggcccagtcgaacccgccgacggtgaaggtccccgacgccacgcggtggccgggcgcggcgcccttggtggcgccgtacccggcgacgcggaacctgtgccgcccctccaccgtcgccgtcgtgctcgtcgacgtcgtgcactccgtcgccatcgtgtgaactcttgttacgcgcactaatccgaatccaccgctaattttgtataaatttcgtgcaaatttacaaatcaagtccgaaacaaaatccatctctgttcccttcccttgaacgtgtcggaccgaaactatgaagttgggccgcctaagtgggccgagatgtcagtcgggagaggaagagtttgatgggccgatgccgcggggaatatctcggtaaatattccaaaataaagaggcaattaatgaaaagattttttttcgaggtagtaatttaatgcaaagattttttttgg

SEQ ID NO: 51914 - DNA, 1501 bp, Oryza sativa
cctaaaataaatgtcaaatttagttttaaaatttaaatttatctccttccgttgaaaggacggccatatttggtgaactctggctgctgcagtttttttaaaaaaatcttcaactatagatttctacatttaaaaataaattaataagtagaaaatccagttttttttaggtcctcaccctctacctactcacttgagcttctcccacacgggccgatgttttctgaattgattatcggagtttgttgggaatctgtcgtcaccggaaaacctgttttttttcttgctgctgtccgcagcatcttgcattgcatctctcatctttctttttcttgcatttatgagcttgtataatgcacaagcatcgattttagctgtgtttagattcaaagtttggatccaaacttcagtccttttccatcacatcaacatgtcatacacacacaattttttagtcacaccatctccaatttcaaccaaaatctaaactttggatccaactaaacacaggccctatttggatccggagggttattaaatagccctctggaatctcgttatttaagagtattaaacgtagattactgacaaaacctattccataaccactaggctattttgcgagacgaatctaacgagatatattaatccatgatttgctacagtaatcagctgctaatcatgaattaatatacataattagattcgtctcacaaaatagccaagggattatggaatcagttttatcgataatctacgtttaataatcttaaatagcaagatttcgaagggctatttaataacccgaagaatctaaacaaggccacagcctttgtttacatgtggtcatgtcgacaatctcgaaaagcagcagcggaaggcaggtcggcgtcgaatccaatctgcattttctgacgaggagacaccctcctgacagatgtaattgatgatcccaatcaaatggtgattaacagttgtttatgagtagatgtcctttttaacttaaccaaagagttagggcaaatcttatagaaggggtggctgccatatctattttatctatttaaaataagagatgatatatactctcttcgtcccataatataagagattgtagggaatctggacaaactgtctctctataatcattgtactataatgtgtcacatccatccaaaatcccttatattatgggacagagggagtacaatacatcacatctacaactacctctagcatactaacccaaataattttattttatttgtttgtctaatctactcttcctttcatctccttttccttcgggtttgtgtggaggttgcccctcgcatgaggggtggctcaccttctctttgatcacttatttcttccacctcatcattcaatcttatgtggcatgtttaggggcaatacatctagcattatagcacttgcccttactctactattcttccttaaatacggagtagtataagggctcctggaatcgtaggaatga

SEQ ID NO: 51915 - DNA, 1501 bp, Oryza sativa
agaggaggggggaggggaggagggtcgttgggggtatgtggtctcttggaccgagtccagtcgaggagtagttgttgtatagagagagaagtacaggagagagttgcaaatgcaaaactctctctctctctgggccagtttggtataactccaactcctaaatataactccaggagttaagtttggagtggagttgtggagctgcctaaacccagctccacaactctagtacattttgtgagagagctccacccaactccactcccagttttggtggagctgaaactgtttggctgagctctggagctgtgccaaacagggcctctctctctctgagcttccttcatgtctctctctctcctccctcgctttctctttctatcactctcctcttcttcttggcagtgatggtcctggtggagccagcacggtgtttcacggtgatcgatcaagttttatactatatattaataatatttattagtaaaaagggtagcggtggcagcggcggagcctggatggtcgccctacccctacctgctcggtggcggcctccgtcagtgctttctgatcacatcgtttggcagtagttatactctgcggtttgttgtggtataccatgaatcgatggatttgattctagaactcgtacatacgaattctatcaatgtatatgtgggagcatataaatgtaaaatctacttaaccgcatgatcaatatttaacgcatatcttactgctgtgaagtacaactaatatgaattcaacttagaataattccatttggaagaaatttagagaccaagcaaacatgagacggtttttatcaagcatcaaaatgatgatttagcatgtaagtatgttgagttttataatataataaattatggttataattgctatatttatacattaaactttagatatttggtgggttggcgtggtattcttgcatgttaagttttaagatactaataattactatatttgtatgttgagttttagatgtttagaagctgtaactatatatagaagatatagatatattggttatgttagtaaaacttttataaatatgtccttagcttttaaagacaataagtaaaataaagtataataacaataccctaaaataaatgtcaaatttagttttaaaatttaaatttatctccttccgttgaaaggacggccatatttggtgaactctggctgctgcagtttttttaaaaaaatcttcaactatagatttctacatttaaaaataaattaataagtagaaaatccagttttttttaggtcctcaccctctacctactcacttgagcttctcccacacgggccgatgttttctgaattgattatcggagtttgttgggaatctgtcgtcaccggaaaacctgttttttttcttgctgctgtccgcagcatcttgcattgcatctctcatctttctttttcttgcatttatgagcttgtataatgcacaagcatcgattttagc

SEQ ID NO: 51916 - DNA, 386 bp, Oryza sativa
tacatgtgagaaaaagtcaacggcgtcatctattaaaaaacggagggattatatgatttgtaacagtataactctgccatgctgccaccttcaaacagaagtcaaatgtagaccaaacaaaatttgaaaacaacccccaggctcattcatgggaaatcaagttggtactgaaagtttgttaatgacaacctaagcatgcctgatctgacaaaacaacatgagcatgtcaaaccggttgcctgaaaatgcgtagcaggtgaggctgcacaagaacaacgcctgatttgatactgcttaacaatacacgtgtacccaacagttggcacgaaatggtgatgagcattccatagataacaaaacacagggatatttgtagtctatagttc

SEQ ID NO: 51917 - DNA, 1501 bp, Oryza sativa
atgaactctcttcttcaaaggttgtccgtcaacatcacctggattatctcgtctaatcttgtattgtagtgctttgcaaaacgggcatgcttctaggtttcgtactcctcaccgcgatagaggatacaatcgttcggacatgcgtatatcttctgtacttctagtcatagagggcagactgctttcttagcttcgtacgttgtttcgtgcaattcattcccctctagaagaatgttctttacgagttacaataactcgccaaatgccttgtcactcacaccatttttggccttccattgcaagaactccaacgtggtactcaactttttgtggccctgttcgcaacctgggtacaacgatgttttgtagcccgctaacatgcgctctagtttctgcacctccttttcattcgcagtcctcctttacgtcccgcaacatctgaccaagatcatctacaccgtcattatcttcaacagccccgtccgcctcgcccgttgtgttttcttcaaatccaccgtactaagcccagtctagaatgttatcgtcttctactttatcttcttccactgcaacccctagctctccgtgcgaggtccaacaattatagctacgcatgaacccccactgaaacaggtgggcatgaatagttcatactatggaatactccttctagtttttgcacttgtcgcatgaacaagacataaaaccgttatgcttgttagtattggccacattcaaaaaataatgcacgccgttaataaactgtttcgaccgcctgtctgcgtacatccattgctgatccatcaacctgaaatgcatataaatcgtaaaaataaaatctacaaaagtaaactaaataaataatcatacaataatttaaaacatcatccttaaactcaaaaccgacgttacatattttaaatgaatttgggatgacatggaagaaggcgcctatcgcaagagcgacaaagatggcgccgagacggaagactatattgtacttatttctaactattctaacgatttttaaattaacttaggtttgtattctttcatcttaattttctatattagttttttcctttgtcatttttaatttaatgtacttatttatagctatttaactatttttcaattaacttagtttcccattcttttatacaaataatcataaaataattatacaaaaatcgcacatattattcattttttcattatttttaaatttctaaccataccttcaatgtattgtacttttctctaaccatttattaaattaactaagtttttactattattttaacttagttttcctcggccttttcctttgccatctcttttacaacatatttatccacattcttttaacctaattttccctcaacaaatttttctctctcatcattttccaccataaaccttgttggagactatattgtataccaacaaagctataaatgtaatatgctaagcatacatcattagtgtcacgcccggaatt

SEQ ID NO: 51918 - DNA, 1501 bp, Oryza sativa
ggcataatagggtttcatttgcaaaagcagcatttagcaaacatttgagaatttaataaaacagttaagtattaattaaacaatattaatccaacgctatacaacataccctgttgtataggcccaaccattctgaacaaccaacccggctgcacagttctatctctaaaccaggaatataccattccaaaccaggagctaatcaaattattaccaattatagcaccatttaatatggtgaaaagtgtgagactaatcacgaaagacattgttagacccgcctataaccgcgggcacctattcgaatagttttactctgatcagaggtgtaccactgtacccacaagacacagccccacatcatgtcaccatgtgcctcaataccaccacggtacctcggaaaggagttgtgacaataccccttgcataacacaatccattacagcgcacctttcctggatcataatcacccccttataaacaaggcatggactccccagcgacccccgtggacttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccacaattatcaggttttagttggcacattaattaattaaccaatcacgattgaccatcgtgaactatcattaagccatcattaaataatagtgagtcataagttatcccaatagtgtgctaatgtttctaagcttgggtaagcaattatgtctaatatctagttgaaccagtaaatataaagctcaactagtcaagttttaataacccaaggtatcaaggaataaagtaatcaagaacaaaagggctatagcaaacaatagattaattccacccaatgacattcgaaaataaatgcattagttgaatagaaacaatagctttaaacgggatcaacatgctcaaagggttgtttgggatctgtgtgacttgccttgctggccttggaactcttcaaattcttcttctgcaaaaacggactctccggaaacgacggaatctaaacagaaagaagcaaaatcaccaaaacagcacataaacaagcatgaacagtacatgtggatatttttaacatgtagatctcaattttagaaaaacttagatacttgaaccaactaaatccgagctaagatgaattagttatgaatttttgaagattaaatcggattaaaacacttatattgattttaattgaattatgacgcaataatgaattatttttgaaaaggaaaaaaggatttattgcgtcagcggctagggtttcggtggaccgggcgcacggcggcggttcacacgaacggacggcagagatcgactcatccaaaacggacggccgagatcgatcggtctatgaccggctcacgggagagggcaacga

SEQ ID NO: 51919 - DNA, 1501 bp, Oryza sativa
aacatgtaaaataatgtagcattaagtgtaccgcaaaattaatgactgaaatttaattatctagtttaacttcatgcatggtagatcttctactccgatatgttgggagttaaacgtatcgtcaaggaaatccatggcggtctcttgttattccccattttgacaccaaggagggtttctgagaagtcggagctgctacgtcgagtatttgatgagcttggcaacgatgaattgaacctttcgcttggtttcaggcagggtttggttgttgtcttctagtgaagtcggagttgctgcgcttttgtgaaatcgggaacaataacccatgccaggcggaggccgagcatgcagaggagcgcggcaagctctagcttggtgagactcccatcgacatcgagcttgaatcggaggaagatcctgcgcagccactcgcgctcatagccagccagagcgggggccttccccttctccttcccatcgacaatgtcatcaccgcttgcatctgcaaggcaggcacgaagctggggttcaagaggcagggaaggaagcggcagcggagaaggcatgaatggtgggtcgatgaggggaggagaagacgtcatcatgtggggaagggtccggtgcggtggtcagaggactcttttcaatggatgtcggcggaggcaccttgggtgttgctctccatgtgcttgaagtcatcgtcaagggagacggaggcgaaggcgtggcgggaggaattagtgttgccaaagacaccggggaatggggaggcggaggcttggccgtacatgtcaaagaaaggattaggtggaagaaatgttaaccatattgtttaactaacacatgggtccacaatttttgttttaatattaaactattaaattttgcttcatgtaccacgtcaatgccacgttagatgaagaccaattcaaattagccacgtgggtgccacgacagctaaaaaccgtcatccaaactgtcctgggaccaatattgcaccggttttaatagttgaggaacccgttgtatctagtattgcggtttaagtatgaaaatcatactcactgtcacagagttggcaaagaaaaatcctcccactaggcccaaagcccttcggccgcataaaaagctgaagcgcatgtatagaccttattaggccctcttctaagggaaacgttcactttggatccattaactgttggtcgagtatcatacgttgcccctcaactataaaatcagatataaaatgtccaataactattaaagcttgtacaaactaagtctttgagacaaaaaaaaaatccttctgatcagccttcctaagtataatagtatcatcagcatactgaattattggaaagtcactttcttcatcaggctgaataggcttagaaattaaaactctattgaagcaactcagcccctagaacaaacaaaagtggagacaacgggtccccttgtctgacccttcttttgcatttgaaggatattccaggtacac

SEQ ID NO: 51920 - DNA, 1501 bp, Oryza sativa; identical to SEQ ID NO: 47096

SEQ ID NO: 51921 - DNA, 700 bp, Oryza sativa
atgtagagcttgggaggcacaatatatagtagcaaaggagcgcaattgtgctaatcagaaaatacaaagttcaataatagttcaaagtactagtcaatgtgctggcctagcctagacccaactctagctcaagcaagcacccgacaatactaaggactagatatgaatcaatgcacaactctgcactctcaaaacatactcaaaggatgaatgatttttcttttttttttcttggtgctgccttttttagcacctttctgccttttttttttcttggtgcggctttttcttcctttttctttgcaccttctgccttttcttttattattattttttttttcaacagtaactaaccactgacctcgaacagggactcaaatgtaaatatgaaaattattgggactcagcaaagtacaaaactaaaattggatcacctcaaaaatggattgctcatgtcattttcttttttacaaaaatatctcaaatccgacataaaaaaaaattctccaagatgtaacagaggtccgcctttatgtggggaaaataacgtgaggatgagagggattggccactgtgtgactcggcttggtttcctattggtcccacatgaaaatttagataatttatcctcaaccaacataaaccgatctgctattcccaaccaaaagaaaacctcctctttctcttttctacctgcgca

SEQ ID NO: 51922 - DNA, 1207 bp, Oryza sativa
agaggaagaggacgaccacaggagtgctggggtcgttgtctcaccctacgacgtgtccctaatggacccaacttaatacactgcccattgggcccaaagaggtgacgcggcaccgtggacagaaaaggactcggagtaaaatgaagattgtggctgcccagaactgatatggacatgaggctggattcatttgaaagtagacttgacagctttccatgaagtacttacaagcccaaatcggagttcgcaggaagtcgtggcggccgtcagaagtttgtgctatgctgtagtccgaatccatcccgcgcgaatcctctccccgtttgatcctctccattgttcctgatagttgagttgacatgcacgagcgtgggtaataggaccatgaagttgtaattgtggaagtgtggatgtatcgttggtgttgatgtcctcatcacatagaaccactgcttcgctctcccgagaagggagaacggaaacagtcgcagcctgacggtgtcgggattgacgcccttgatgttgtacgtgctacagatctccaggaactgttgcagatcagcattggacccctcattaggctcaccacagaacgggtttgcctgcgcaatcgtgatgaggctggacttcaagtcgaaatccacgtcccctatgttgacctgcggcccaatggccacattgtcagcagagggagcagcgaactcgcggagagtcttattagccatagtcttgaaggtcggcggcgttggtacggctggtttatctatcggtagagttttctgcggagcagcgactcacggcctaatgctccgaaagaaagcttctggattttctttgaagtttttcggcaagttgaaaccagtcatgcactaccctgttttcacaacaaaagtgaaaacaaccaaggttagcctgcaaaggaaaatgattatacagaggcaaatataaaatattagttcaagtagtctctattatgaatctcctccggcaacggcgccagaaatgcttgttcgtatttcttaacgacattactagaaatataattcccagcaatggcgcaaaagtacttctgatatattatggttacagagttcatccgcaagcccacagatataccattgtagtgtttcacccgagagtattccaagggtatcgtatttattttatcccgtggaaagatcatgtagagagaacttgactaataatt

SEQ ID NO: 51923 - DNA, 1501 bp, Oryza sativa
aactcaaattttttcaatctattagtaaaaaagttatcctaagaaaataaaaaatctattcttaattacagtcattatccttgactaacagagttagttatggtaccgcgtccttccaagaacgtgctccgcgtgcgcgctagttctgctcgcggcgcgtacgcgcgtactaggaacgccccgcttgtataggaacgccccgcttgtacagtacatcagggtaggcgtaagggaccatatgtggaaaccaattttcacatgtaacatatgaaaatgcccccatttacacagtcttaagtgatctccttacgaaatgtttgatttttcaaagcagtcgcttaagatatatagccgcttatgaaaatgatgatatttatgtaatcaagcatattaaactgaccgccttagagaatgtgtttatcgagatggcgctcttaactgtctgtatatgtcctgtcttttcatctacttcgcgaccttcaacaatcatgcctaatcagtgtgtgcttatgcatcatcactgcatttcttggtttcaaagcccaagaaaccaggaagaatctcaagagaaaactaaactaattaaacaagaaactgattaacttgtcatcagacagacagagcgctgctcgctgaaattaaatcaatagtattaagagggggacagtggcagaggccgtatctaccccgggacggcctgcgtcgggaaaggagcacctcctcctcctcatcggcgtcgagcagtcgcccggacagcgaccggaccagaccggaccagggcgccgcggaggcagcaagggaagggaggagagagagggcgcgccgccgtgcgcgccttgccggctggccaccgccgctcactgcagcaggggagggaggagagagaggggatagtggatttaggaagagagagtagagagagattgagaggatagaggggaaagagaggagagtcttataggtggggcccacactactttttttaaaaaaattttgctgactgtactcacgtagaactgaaactaccccgaattaagccggaggttatttgtccgattgtatagttaagggtgtaaaatatccggtattcgagtttagggagttaattcaatcgcccatgatagttcaagggtgtaattcgtaccttttcctagcaaaacacacaacgtttaaccatttgaaaagcgtacgtgcggaacacgatggagaggagttggaaccaaggatttaaatctccggctatagctgccgctattgccggagatagccgctgggagaagcaaccactaagatatgtccaatttggcgctacacattctatggcgctattagctgctcttagctggctatagctgctaaatgggcccttaaatagcggcagctaacttggtgggctgagagcctaaaactaaacaatggggcatatagaaacaattcaaccctaactctatcactctttcacagtcactctgtcgctcaccctctcccctcgaaaaacagg

SEQ ID NO: 51924 - DNA, 1501 bp, Oryza sativa
ccaaatatctaaagtttaatgtataaatatagcaattataaccataatttattatattataaaactcaacatacttacatgctaaatcatcattttgatgcttgataaaaaccgtctcatgtttgcttggtctctaaatttcttccaaatggaattattctaagttgaattcatattagttgtacttcacagcagtaagatatgcgttaaatattgatcatgcggttaagtagattttacatttatatgctcccacatatacattgatagaattcgtatgtacgagttctagaatcaaatccatcgattcatggtataccacaacaaaccgcagagtataactactgccaaacgatgtgatcagaaagcactgacggaggccgccaccgagcaggtaggggtagggcgaccatccaggctccgccgctgccaccgctaccctttttactaataaatattattaatatatagtataaaacttgatcgatcaccgtgaaacaccgtgctggctccaccaggaccatcactgccaagaagaagaggagagtgatagaaagagaaagcgagggaggagagagagagacatgaaggaagctcagagagagagaggccctgtttggcacagctccagagctcagccaaacagtttcagctccaccaaaactgggagtggagttgggtggagctctctcacaaaatgtactagagttgtggagctgggtttaggcagctccacaactccactccaaacttaactcctggagttatatttaggagttggagttataccaaactggcccagagagagagagagttttgcatttgcaactctctcctgtacttctctctctatacaacaactactcctcgactggactcggtccaagagaccacatacccccaacgaccctcctcccctcccccctcctctccccctcgccgagatatattttcccctcggcggcgactcctcctccacctcgtgagctcgccttcggccgccgcctctgcgcctcgcagatccccacccgcgaccgagcgagctggtgccgcatcggtatcgcatcccggtgagcagcgtccacctgacacgattttcctccagttttgctcgcgttaatttctcttctagaccttggatgggagccctttttctcttaatttgtgacagccttgttccacccccaaaaggcgcttggcatgttagatccgtcgtccctggctgactatatgattctttctgtgattcttgattggaactgtgattagtgtaaaatatgccattcttggcttgtttgaattgcctgttctttgcattgaatgatgattctaatcattgtgattgattgatgcatgatggttcattgattctgctgcagttcatcttctggctggacgaattcaattcacggacggtggtggtggtggtgttgactagggatttatttttttaccattggcggctcggctgcatccccaagtgaagaagagaattcgtaca

SEQ ID NO: 51925 - DNA, 1501 bp, Oryza sativa
gaaaaggtaaaatttattcagtgcatacactttatttgttcttatctttcgatcaattgatgatggtttgagatataaacatgtggtatgtggatgttgtactaaccaaagaaacaaatacacgagaccacttgcaagtaaaacagaccacacgctatctgctagctgtcatattgattcaagtgtatgttatcgaggctaactaccgttgcattagtacattttctttttgctatagagtcttttgatgacttatattttttaaaaaataatacagtaattacttaaaataaagaatatatgtatttacttgaaaatcatctctacactttgcttgtgaatttactccatatagtttcttatttcaactcaatcatgacgtaattacttctaatactatagagagttacttctattacatagcaaggttgcataaatgtttgaatatattcaagatcatcttgttttgtcacatattttaagggaagtacatggtgcaaatagatcataaaaataatatatgattaagaagatataagtcataaaaagattaaaaaaatacgtttttagctaaaagagaatttagtaggttgaagtgattgccgcattcttttcgggctattgggtttgctgattagctacacgtaaaacgagaaacatgattagcatatgattaattaaatattaattataaaattttgaaaattgaatttatttgatttttaaagcatcttttatatagaaagtttttgcacaaaatacaacatctagtagtttaaaaagtatgctaatgaaaaacgaggaatagataaggtgaactagctgtttagaacgccgccttaaccaagcaacgaccggtcgcgcgcaaactcacctgagtaagacatctcgttgtcgattaaggccctgtttagttcccacgcaaaaattttacaccatgtcacatcgaatgtttgaacacctgtatgaagtattaaatataggctaaaaataactaattatatagattacgactaatttgtgagacgaatcttttgagcctaattgctccatgatttgataatgtggtgctacagtgaacatttgctaatgacgaattaattaggcttaataaatttatctcgtggtttgatgatggattatgtcattagtttttttattaatgctcaaacaccctatgcgacaccctatataatactcgatgtgcacgccaaaactttgggcctgtttagatccctgccaaaaattttacgccctatgacttcaaaagtttgaatacctatacgaagaactaaatatatatagactaaaaaataactaattacacagattgcgactaatttgcgagacgaatcttttaagcctaattgcttcatgatttgacaatgtggtgctacagtaaacatttgctaatgatggattaggcttaataaattcgtctcatagtttactgacagattctgtaattagtttttttagtgcccaaatatctcatgtcata

SEQ ID NO: 51926 - DNA, 1501 bp, Oryza sativa
aggcaaagctagggcacacggcgctagggctactccggcgacgagaggcgaaggcgagggctgcgacgggtagaggagacaccgggggtccttttaaaggggctcagaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccgaggatcatttcccctctattgattcggccggagaaggaaaggagcggccggatttggaaaggaaacggcggcggcgcgaaactagggtttcgggcggcggcggccgaaggtagacgacgactgacgggtgggccccacctgtctgcgacagcgcgctcgcgcgggcggctgcggactgggccggactgggccgagagagagaacggttttgggccgactttcggcccaaagccaaaagagactttttaaaacctttttcaatttaaattattccttaaatgcaattccatttattaaaaatactttcttagctcaaataaatcccagaaaaatctaggaattatagaattaagcaaagtatttaatgaaattttatctggcccctttttatattggaatttattaattaaacttagattttcttttcaagacttttaaaattatttctaaaaattccatttaaacaacaatttatatattttgaattttcagggtgtgacaggggttgcacccaagatgaagtggtctgaacagaagatcgagttctcagatgaggaccgccccaaggctactgttatcccaggacgatatccgatcgtggttgaacccactattcggaataacaaggtagtgcgagtcctcgtcgatggcggcagctccatcaaccttctcttcgccagcaccttggacgcaatggggattccacaaagcgtgttgacacctaccgatcaacccttccatggaatcactcagttttcgtccaagccattgggcaagatcacgcttcctgtgactttccgccaagcgagcaacttacgaacacagcagataacatttgatgttgctgagtttgacacagcatacaacgccatcatcggaagaactgcactcgcgaagttcatggccgcatctcactacgcgtatcaggtactcaagatgcccgggccgaagggaacaatcactattcaagggaacgcaaagctggcggtccaatgcgacaagcggagcctcgacatggtcgagcacacgcccagcccacccgccacagccgagccacccaagaaagtgatcagaacgactaagacgtcgaaatcagacggcacaatcaaaatcgttccactctccagtgccaaccccgacaagacagtcaagatcggagcatcactgaacgagaaataggaactcgcgctcatcaccttcctccacgacaatgcagacatattcgcttggcagccgtccgaca

SEQ ID NO: 51927 - DNA, 1501 bp, Oryza sativa
aggggaataattccatatctattaaggccctgtttctttcagtttgggattattataatttagattattgagtcagattactataagctagattgttataatctgtagtataataagcgattagttatttctttcctagattattagagcctagattattgggtttgcaagtctaaagagggagtggggtggcatggtgggtaattttgcacccaataatctagaaaaagctcacctaaatgagcttatcagattataataagctgggctccagattataataagctgggctccagattataataagctatagcaataagttgtctgtttctttcagcttactccaaataatctggattataataatcccaatctgaaaaaaaacagggcctaaggtgtgaatttaatcatatcccctcaatccactccaactcctcccttattagggcatgtacaacagttagagataatatggtttttaatcattaatgtatccaaatactttttttttctcttctttcctttctttcactatcatgcaacaaaatttactctaataaatgctaagagtcgactctgagccgttgtcatgcataacaaccatactcctttctctttcttccatgtcatcaaattacttgcatggcaatagagagagaccactaataaaaaccgttgtacatgcacttaggattaactgaaaaaggcctaagagagattctggcaaggttccacattttgttactcagttttgctaactcactaatagagaaccgatctttcgtagattaaaaaccggtattaaagttgctttactaccggttctaaaagtccaattccctataaacaactttagtctcggttgatgttactaaccggtactaaaaatgcctccagagttaggtcaaaaggaaaacgtctctattcaagtcagatgtgtaaatatagttggtgagatggttatacgcgtgagagataaggtgagagatcttgagtttgaatcctacatcccacatattttttttctcttgctatatgcatttttagttttaaccggtactaaagatcgacatctttaatcccaatttgctcatctcggttgctaccaccggtagtaaatgtggttgtaaaccgggaaaaaaaacgtttcccctgtagcgactgtataaactacgaagtgacaagtgactgaataccaaattaagcctagacacagggactagtatgtatggcaagctaggtttcttcttgagtatatagtatgatccctctgatcgttgtgacagagctcagctgggtgtaaatcggagcgccttgtgatcgaccctctggaggtgcgcttcccatttgagaaggacagggatgtatcctgcgtgctgcagctgacgaacaggtccgccgatcgcgtggcgttcgccgtgcaggtggacgagtccaagtaccgcgcggtgccggacaggggcgtcgtgcagccgcggtccaggcggtacatcgtcgcgac

SEQ ID NO: 51928 - DNA, 1501 bp, Oryza sativa
gtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataatttcttttcatttcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatagtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaag

SEQ ID NO: 51929 - DNA, 1501 bp, Oryza sativa
ttcctatacggctatacgcataggaggaggaagagcccatgaccgaactgcattgcttactgttgggcctggaattaggcccattacctgagaccgatgccgatacgattgagcctggaattgggtctggacttcgcacaacaagaagtagaacaagtacaggtactggtgcaggtgcagatctaggtggagaaatttagtgccggttcactttatgcgaaaaaaaaaacttaccaaattttggtaatgccaaaattttggtatagttgacttaccaaaattttggtaggatttcttatatagttactaaaatttgacagcaaactaaatgtagccacttttttggtaactttaccaaaatttggtaaggttgaaaatggcttcaaagtgaacatgcccttaacaatatgctacttagtagatgtggctttaacagaagaccgctctctaggatgttcttataaaaatgccactcaatagagactgtttcttaataaaatgctactttgggctattttgagacattttttatttgtttatatttttaatttttttctcacactaagctcgcgaaatgaccgaaatacccttaggatcgtttagatctggagaatgcgtctcttctctttctcacgacttcttcttggcacgctaggggccgacgccgccaccgccgccctgtcggcgcgcgctcgcccagctgccgctgccgtcgctgtcacttgaccgcgcgcagtcgagaggagctaggggccgacgccgcccgtctgcgcgcccctggccggccgtgctaccgtcgcggcgtcgcccgtccacgcacggccgatttcctctcagtcgcgctaggggccgacgccgccaccgccgtcccgccgccccaccgcagcgccaacgccgagaaggagtcgttatcgccgcagggaaagacacatgggtatttttgtcattccgcacatcttttgcgattaaaagcctcaaaatagcctaaagtgacattttattaagaacgagtctttatctttattgagtggcatttttataagaacatcctaaatagtgacattcggttagagtacctctattgagtggcatattataaatttctccagacgcagctgagttcagctctgctcactattttatctccttaaaatatattcttatagtctgttattgtagctgctgtgatgatgcatttactcgctgaaaatctgtgaggtgtcccaatcctgaaactacatggaacttctccattggcttgattgatggctgattaatgcttgtccgcaaagcacctcaaccttatcatacagtagaatatagatcatttgtttacaaagtcaacggtacagatcatcaaaccaagtgttgactaaaaaatcacccaacattaactgacagtcaaaacctttcctgtctgctcagctcatcctgcatttgatactgcacagctgctggtatgatacaaacattacttctataattctagggacaatttcgt

SEQ ID NO: 51930 - DNA, 1501 bp, Oryza sativa
ttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcgggctagggtttgggtggaccgggcgcacgggcggcggttcacgcgaacggacggccgagattgatccgatccaaatcggatggccgagatcgatcggtccacgaccggctcacgggagaggatcccgatgacgtcaacaatgacatcaccgacgacggcggcggctcggcgaagaagacggctcgggcggcggacactcaccggcgaacggcggcgctacggcacgaacagagggcaccagcacgtagaggacaacgcggcgaacacaccggtgaccaaaacgacggcggagaagcaacggacggcgacggcgacgagaaggaagcgacggctaccttcgggttgtcgacggcgacaaagctccggcgggttccgacggctgcgaaggggcggacgaggacggcggcgacttggcgagcatgacggcggtcttcccgagcgacggcgacagctggagcgacggcggagcacggctgaagcggcggcggcgacggcgaagctagggcacacggcgctagggctcttccggcgacgagaagcgaaggcgaggggggcgacgggtagaggagacaccgggggtccttttaaaggggctcggaggcggcggcgaaggcccacggcgacggcaacggcgaaggaaaccttcggcttggagagagggaaaaccgatccgaatcgaactcgtctccgacgctttccaaagcgatttaaccaaagattccaaaggagaaaaggtagaggagatcccggagattgtttcccctctaacaaatcagccggagaaggaaaggaacggccggatttggaagggaaacggcggcggcgcgaaactagggtttcgggcggcggcggccgaaggtagacgacgactgacgggtgggccccacctgtcagcgacagcgcgctcgcgcgggcggctgcggactgggccggactgggccgaggagagagagaacggttttgggccgactttcggcccaaagccaaaagagactttttaaaacctttttcaatttaaattattccttaaatgcaattccatttattaaaaatactttcttagctcaaataaatcccagaaaaatccaggaattatagaattaagcaaagtatttaatgaaattttatctggcccaattttatattggaatttattaattaaacttagatcttctcttcaagacttttaaaataaattctagaaattccatttaaacaacaatttatatatattttgaattttcagggtgtgacaaacctaccccccttaaacagaatctcgtcctcgagattcggaagaactggcgaacaggtgc

SEQ ID NO: 51931 - DNA, 1501 bp, Oryza sativa
tctacattttatctggtgaaaataccacttatctgtttccagggacaccgatatttaaaagagaatgttctttatgtttcactaagttttcacttaatcccttctatgccataagttaatgtttggtcacttatatgactttgagtgttcatttcgatacagtgcatgcactcagtatgacataaattatgtttcatccattatatgactttgagtgttcatttcaataccctgcacgccttcagtaattttacctcctttagtgaaatcatatggatgaaaaatatatctgtacttttttcgacgatgatatctataatttgttgaagcgagtatacaatattttgtaagccataggatcctttcctactaggctactaccttcagcagaagaacaatagagaatgtccacaagcatcccttggccactagaacctctaggaaaggtaccagatttcacaaatgcaacattgtcatgatatgacgctgaccagaggcatattcctcccttatattaaaaataaataaataaattcaatctaacagtatactatgccaactgatattatgacataaacagaatatggagatatattaattattcgcaattgagtcactaagatatgataaagaaccaactcacatcgcaagaagggaatagcatttgtttgaaggactcagctacggtggaagctaaacttgttctggggacaatctcagcagcttcagtgacagcaggaggctcgtgggtggcaacaatcgcatccggctggaaaggaatcgggctgaagaccattccctggagaagaaatcccaaattaaagtttcaattagaggcctaataaaattagtgttgtgaaaaagaagaaagacgaaactatgcgaggcggaggaggaaggggggaagatgggagtgtactgacgaggacatccccgtaggcatccttggctccatcgtcggacagcgcatccgccgcaactgcaacgcacagacttggaatgagcagcccagctagcaagcgaagcggattggagacagcagagagagggggagcagggagtggatagcacacctaggtcgcggttgatctcgcagatggtgacggtgccgggcggagggaagctcggcatcgtcgttgtcttgcgtcggcgagcggcggccggtgctccgcgtcgcaggacgggttaaacccttgactcccccagagacctgagtacccgtaggctacagcccaaggcgatttgggccggaagcccacaaacatactgggccgatattgtatgtgatggaattggagttccgggccaaaattatatgggaagcgtcgatggcctcaggacgggagtgctggcacctggttgaggcccacgatatcacaaacgcatcatcaggcgtgctgcaaaaagtaggaaaaagttcgtttttactcgctcaattattgggcaaatctgatttgatttgtatcacataaccgtaaaacccgatatattggcgatccct

SEQ ID NO: 51932 - DNA, 1501 bp, Oryza sativa
ctccctttcagtcttccggacctccatttctctcccacctatttcacctttttcttttaggaggattttgtattttctttaataagtccgatccactgcaagctacgtgcgcctctagctgccggccaaatcctagcaccgttgccacgtcgatttgcctcatacgtttcctcctccaattgattgcaaaaatcgattccccactcccccctcattatttccccatgattttccctattaattcagctttaattcatcaaatttaatctgcgtttaacggtcaccaatgatgtagccgacaagcttccccgggtcatttttatccccaattttgcagattcgcttcaattattgagaaacagaaagaactccctcattatttctccaatgattttccttataaatctggctttaattcaccagatttaatcttcgtttaacggtcaccaataatgcggccgacaagcttccccaggtcatttttatcccccagttttatggattcgcttcgattacggggaaatagaaacagaagattgagtggattaaaaatccacaactaaatttgggagatcgagaaagattcggccagatttgatgcaaaggataggctacagcatcatagtagcacatgactgtcgtccggaggttgaagacgctaatgaaacgtgtgggtctagcttggtagcaagaggagacatcggctatgctagctgggtctgcagctccacttatgtatagtgatcttaatgtttcaatatattgcttagctcctaatagttgttgtatattaaaaaacacttacctgttgccaggggcggactggtgtcagacgacaccaacgactttcggcaaaacctatagcataactgcttatctatgttataacaatatgatctaaacataattagcatactatgacatcaatagaaacgttatgacaccaacgaatcgattttatgtatccgccattgcctgttgcaacgcagtctttttctagtatatgaaatatagcacaggcgagtggccttgacgatggcggccggggcttgtgtcgatctgttggaggaattgtctggttggggaagaaccacctgtatcactggcctaaattctgtattctactacttacctattgtctgatgaaactgttggctgaatggctccggacccacgagtccatccacctgccacgagagggctagatggttgcagctcttttcctcctcgtcaacgcgtcgagcacaagcgcgtggcagccgtggcctgatggcgcgccgtggaatttgggtaggagtggatatacaattgtatatgttgatgatgtaacgtacggttgattaataataaattaggtgggaaaagatcagttgttactcataacaacgaaatttccttactgataagacatgcgttcacatactagattgtacaagttctatcgtgtacagacatgcctgatgcctacctatagtccaatatacagtatactagattgtga

SEQ ID NO: 51933 - DNA, 1501 bp, Oryza sativa
tgcagccggggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataatttcttttcatttcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatagtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaag

SEQ ID NO: 51934 - DNA, 1501 bp, Oryza sativa
tttttagtcaacacttggtttgatgatctgtaccgttgactttgtaaacaaatgatctatattctactgtatgataaggttgaggtgctttgcggacaagcattaatcagccatcaatcaagccaatggagaagttccatgtagtttcaggattgggacacctcacagattttcagcgagtaaatgcatcatcacagcagctacaataacagactataagaatatattttaaggagataaaatagtgagcagagctgaactcagctgcgtctggagaaatttataatatgccactcaatagaggtactctaaccgaatgtcactatttaggatgttcttataaaaatgccactcaataaagataaagactcgttcttaataaaatgtcactttaggctattttgaggcttttaatcgcaaaagatgtgcggaatgacaaaaatacccatgtgtctttccctgcggcgataacgactccttctcggcgttggcgctgcggtggggcggcgggacggcggtggcggcgtcggcccctagcgcgactgagaggaaatcggccgtgcgtggacgggcgacgccgcgacggtagcacggccggccaggggcgcgcagacgggcggcgtcggcccctagctcctctcgactgcgcgcggtcaagtgacagcgacggcagcggcagctgggcgagcgcgcgccgacagggcggcggtggcggcgtcggcccctagcgtgccaagaagaagtcgtgagaaagagaagagacgcattctccagatctaaacgatcctaagggtatttcggtcatttcgcgagcttagtgtgagaaaaaaattaaaaatataaacaaataaaaaatgtctcaaaatagcccaaagtagcattttattaagaaacagtctctattgagtggcatttttataagaacatcctagagagcggtcttctgttaaagccacatctactaagtagcatattgttaagggcatgttcactttgaagccattttcaaccttaccaaattttggtaaagttaccaaaaaagtggctacatttagtttgctgtcaaattttagtaactatataagaaatcctaccaaaattttggtaagtcaactataccaaaattttggcattaccaaaatttggtaagttttttttttcgcataaagtgaaccggcactaaatttctccacctagatctgcacctgcaccagtacctgtacttgttctacttcttgttgtgcgaagtccagacccaattccaggctcaatcgtatcggcatcggtctcaggtaatgggcctaattccaggcccaacagtaagcaatgcagttcggtcatgggctcttcctcctcctatgcgtatagccgtataggaatagtcgtgtcgcgcctggattaggaccgcgctataaaatttaaaaatcaaggggttttttcgcaaaacgacgcgccctaacaacccaccccgcaagtcggcaaccctagccaccgccgccag

SEQ ID NO: 51935 - DNA, 1501 bp, Oryza sativa
agagattgtgtttattgctaattggagtgattaaagttgtagattagatggaatggatgcatggagtaacccaagtcagagtagcaaaggtctgggactggtcagcaaagggcagcgtggacgtagctcctctttcttttcttgcttgactcattctccctaaaaatctcctaccatctgcctaccagtttccaagaaacaaacaagtaccccccatgtttctgaaatttgatacttgtctattttgcttatgtcaagtatatagtaatgactaaactacgttctcatgcgataccacgtgattaatcaagtgtataactggtctactatttctttctctaatgggcactacccgagttctaaaaacacacacccaaatgaataatacgataattatcactggattgatgttgcttcagtttccagcctcccgaaaagaagcttccattactccaaagaactgttcactagagtacagataaacagagggaaccatacaaccagtccagagggacccaacgcagtgccaaacgtcaccatttcatgggcaatattgttacaagctctaggacagaacgtacatctctttactacatcaaaacggaaacaaagtccctagcttcacggataacaacagcatttgaaccgtcatctcataaatttgtcatccttaagagcttggaacagttagttgcttagattcggtttctgatataatctgacttgtacaaagcaaatcgccaattaagagctccaataccatagcttctgcttgtaacatatctttgtaaataaattcattgatctttcagctccttgacagcactgcatcttttatcatacacttacatggagttctgccctgcaggggatcacagagcagggcatagtacagtcaagaataatacagggaagcatatactccccttcgtcccaatttaaatgcaaccatgattttctgtgtccaactttgatcatctgtcttatttaaaaacaataaaaaaaacaaaaaaaaaacataagtcacgcataaagtaatattcatgttttataatctcataacaataaaaatactaattataaaaaaacaaatcaaataagacgaacgattaaaattaagcatggaaacttatggttgctcttaaaatggaacggatggagtatttccagcggggatcacggatggacatacatacagtacagcagatatattgggggcgccggccagtcctcagctttgtccacacctgtttctcaacatttttctatgctagttgctcctaacttggcctactgtcctccatctccaacaacacaagagtacaagacaagtactacaacggcaacaactatgcatgacatcaaaacgaaagctgggacctcgtcgatcaaagctaagcacaggcacataacaccctcaatgcaaccagcagcagcgaggaggccatgctgccatgaatcatgatcatggcgtcatcacaggagttcgaggctaatgacc

SEQ ID NO: 51936 - DNA, 1501 bp, Oryza sativa
acgtgcaagatttttttgctatgattctctgatattgaatgtggtattgaactattcaatgtaatatcaagtgtcttggctctttaaactgtacaagaattgcaaaatttatgttagtttttgtaaaaccgctaatgagcttagctgcagcaatagccagctatagctggttgttgacagttcgatcagtttcgaccgtcaatattactaaaataggggagaactagtgatgcttgcaatgcataaatatgttagaataataatattccactagtattaggtatacttaccttttgcagagaatgacaataaagtggaggagaatcaacatcaactcagatgataaatcaatcggatgatgtcgagaaccagacttatgtatgaatgggccaagaactcagaaataacacgacacattgggccaaaattcacaagtctacggaggaggacaacaaaggaggccgccagccgaagatgggttggggccgaacccaccgcagctccgtttgatccagggttctcctggacggctgagattgctccccaatgacggttggagggtattaccgactattccaaccgttacaaccgtcattgggaggctataaaaggagcaatcatcctcacttcactcacacacctcaagcaatagctctctcatttatctcaagtttagtttagtagtatctagctggtggaataggaacatagtagaaatcaggagtccggaagccttcggaagagtttgggtatggctctagtagcttttctcttctcttttgtaagccaagccttgtacttttagtagaatactcttctaaatacatttatggtattgaaatacattccgagtatatgagtacctactttacattatgttcatcttatactgaatatacggctagcttatctgggagatgctttggtgcgggtataatgtttgcctatgcaattactctatgtcatgacgatgatattagagtagtatctggtagtttagacgtggtgtctagattacgggatatcattatttggggttatatattgcgaatgagaggtgggctgctgatagtgacagctcagtacgggtattcctccgcgccggtatataatcctaagttaattccctagggaggatactcctccgtatttagccccggttgtatggtcatgacgggctgtcgtaaggaactcggcagtcaggagtggcttctcgaagtaccaggagggcatcggatagagggtattagttagtatatcggttaactagaatgtatgtatactatgtatattagaaatataggaatagattttcttttcttttctttccacttagcttaggtgatatattatgagaatgagtagttaatgcttgtgtgtcactctacccttggattatcttaacccctgcttagaatatgattatcacaagtaatatataaattattagtcaagttctctctacatgatctttccacgggataaaataaatacgataccc

SEQ ID NO: 51937 - DNA, 502 bp, Oryza sativa
gttgtgttgtgcaaagggtattgtcacgattttccccctttgcaatgccgtggtggtatttcggggcatggcaacatgtgcgaaatcgtgtcttgtgggtacagtggtacacctctggccagagtaaaactattcgaatagccgtgcccgcggttataggcgggttgagcaatgtttttcgtgattagtctcacacctttcacaataattatggatgttataattggtaataatttgtttagctcctggtttggagttagatctgtacagccgggtatggttgttcaggatggttgggcctgtacagcatgggtgtgctgttcagtgttgattaaaatttctaattaattactctactgttttacttatcttaaatctttgctaaatgctgcttttgcaaatgagcctatattatgccatcctttggtatccttgtgcacttgcatatttgctgtgtggcttgttgagtatgtcatatgctcattcttgcaataataatcaa

SEQ ID NO: 51938 - DNA, 1501 bp, Oryza sativa
tgacggcggcaagtggcggacggcgagacgagcgggtggacgatgcagccctcgacctcgcaaggccaacggcggcaatggagtggcacgacggtggagcaaaccgcggctagcggcggatggaggaagtagtgggtggcggtgcgtggtgagagcgatgtggcggcggcgcacggcaagcgagcagtggccaaggtgcatgttggctcggtgagcgcgacggcggtgattgcgcggcgcggcggcggctatagaggtggtagcacgcggccggaggcggcggtgcgcggcggtgggcggcggcgctagcggtgcacggcgcggcggtggtagagagtgtaggagagcgcggcaaaaatgggaaaagggagaggaggacgcttggttgcattttatatgcgcggggagggcggacatggccgggaactgcctggatttagaggggaaatgccgccggcgacgtggggtggagagagagagagagacgggggagattcaaattgaatcccgcccttgcgggcgcgcgcgcgtgggcgggaatggggtagcagttgcgggagatgggcgagtggtgcggcgaggtgggggacgaggctgggagcgcgcgggagaggcgggcagcagttgaggaggccgctccttcggcggctagaggtaggggaagggccgacaggtgggccccacctatcagcgcctcagagagagagggaggctgggtggacttcgggaggggaagggagaagttggccggcagcgcaggaagaaatgggatggcggcccaagagggggaaaaagggggaaaaagaaagaaaaaggaaaaaaaggaatttctagggattaaatattgcactttgtagcttttaattagttaaaattacttctaaggctctgaaaattccactaaaaatcctgttagcatattttgacatgtagaacccatgaaaaattccacataccatttccgattattctttgtatttattaattaaggaattagctctaggttaatacaacaatttcttcggatgatttattttatgaatttaaagcaaggtagggaacttcaaggtgtgacagtgcctctcgtgttcttattaaaaatgctttttttattggaaacatctttgtaggcataataaaataccataaccttggaaagacctgaaacgatatatgagagatgtttatgttcacatgtattgtgctgacattttgctcaacaaattgcaatgcttaaaacaagataacagaactgctacttcatactatcatgatatgcatgcttgtttattacattgtggtttagatgaatgcaaagaagctacagaattgatgtttttacgtgggctttacaaagaaattcaggacatgcttgattgtcaaagatatacatctctttcttatttgatacaacttgcttgcaatgctgaaagtcaaatagaggaggacatgaaaaagcaatacgctatgtttctgccttctattactaaccatttgcagg

SEQ ID NO: 51939 - DNA, 1501 bp, Oryza sativa
attggactagtagctccggttctgactcctacacgaggcggcgatttttgccgactagtctcaagttgccgaggacgacgagggcgaggacgttcgaggacagtagttcgtcggattttcggtggtgggtgtcggttcaaaggtagtcgatccggagcaaggcctcacggtagaccacattgtactgatatcctccacggtgatgacgtcttgaaacttggtcgatcttgatagtcaaattgttgacgacgatgattccgatctcgtcgggagacatactccggtcggattagatcttcccacagctggagtcgtcgagtagcttgtcgttagagaatccatctcttaaacccatctcgtcgaaatcttgaagcaccaaaatcccctacctgtcgcgccattgtcgacatttgagatcatgactacggtatttggatggtatggggatcgttggtaccagggtatatgcgagattgaggtaaaagagatggagacagggatttttatacaggttcgagccccttatctgacaggtaatagccctacatcctgtttatataggattgatatagataccaccgagtacaataattgggataacctatctaactgtcgtcgacttggcggctagataaccaacttgtagtcgatgacatggtagtcttcctcctcgagtatgaactcgtcgagatcagagatagcgctagatccctcttgccgatcttcgtagacacctgatggggtatgtctagactaatctctaatgtcgatatttggtggtgtgtgttggcttgtatcggctttgcggcttgtattggtctctctcctctcctcctaggaggcttgtatttatacccatacatgatcccttgtccaagtagaactagggagacaaatatgaatacagtctgcgtagtccatgtcatttccatatagaactctatttgtcattccttatctggaactccttctatatacaaggtatgtttccgtacaagacttggtatatggtgggccccgtcgagcttagtcaactactattaggtatgtggtatccataaccctgacagcatggctaagcaattcctaatccaacatctatacattttaatacccaagttatcaatggcataaggtaaacaatatatggctgactaataggacccataccacatgacattgtaaaataatgcaacatttaatagaaatgcgggacatttgtaaattgggtgtaatatgatcaattgtaatgcatgacttgccttgctctcgcactgatgggacctcagcaacgtcttcgagaaaccgcggattgacgaaacagccgaaatctaagcgacaagcaaagcacacaagcaaaacatgctataagtctactgaaacaggaaacaaaaccatttttaatggattctatgcatttttatgaatttactgagagttgaatggacttaaacggaactcggatcaattagttatgaattttagaagattatctgtgttt

SEQ ID NO: 51940 - DNA, 1501 bp, Oryza sativa
caagcatgcatatcatgatagtatgaagtagcagttctgttatcttgttttaagcattgcaatttgttgagcaaaatgtcagcacaatacatgtgaacataaacatctctcatatatcgtttcaggtctttccaaggttatggtattttattatgcctacaaagatgtttccaataaaaaaagcatttttaataagaacacgagaggcactgtcacaccttgaagttccctaccttgctttaaattcataaaataaatcatccgaagaaattgttgtattaacctagagctaattccttaattaataaatacaaagaataatcggaaatggtatgtggaatttttcatgggttctacatgtcaaaatatgctaacaggatttttagtggaattttcagagccttagaagtaattttaactaattaaaagctacaaagtgcaatatttaatccctagaaattcctttttttcctttttctttctttttccccctttttccccctcttgggccgccatcccatttcttcctgcgctgccggccaacttctcccttcccctcccgaagtccacccagcctccctctctctctgaggcgctgataggtggggcccacctgtcggcccttcccctacctctagccgccgaaggagcggcctcctcaactgctgcccgcctctcccgcgcgctcccagcctcgtcccccacctcgccgcaccactcgcccatctcccgcaactgctaccccattcccgcccacgcgcgcgcgcccgcaagggcgggattcaatttgaatctcccccgtctctctctctctctccaccccacgtcgccggcggcatttcccctctaaatccaggcagttcccggccatgtccgccctccccgcgcatataaaatgcaaccaagcgtcctcctctcccttttcccatttttgccgcgctctcctacactctctaccaccgccgcgccgtgcaccgctagcgccgccgcccaccgccgcgcaccgccgcctccggccgcgtgctaccacctctatagccgccgccgcgccgcgcaatcaccgccgtcgcgctcaccgagccaacatgcaccttggccactgctcgcttgccgtgcgccgccgccacatcgctctcaccacgcaccgccacccactacttcctccatccgccgctagccgcggtttgctccaccgtcgtgccactccattgccgccgttggccttgcgaggtcgagggctgcatcgtccacccgctcgtctcgccgtccgccacttgccgccgtcattcgtcgtcgcccctttccgcgccggccaaccccacgatgagaactccctctcctccctctttctctctctcccgtgttcactgccgtccactgcgcgcgcgccgtcgccttccgcgccgtccgtcgccgcctcctgtgtcgccagttgccatcgccggcgaccgtgcaccgccgccgcgtcgccatgcttggccggccttctttgaagccgagt

SEQ ID NO: 51941 - DNA, 1501 bp, Oryza sativa
ttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcagaacggatatcctaagggaagcagaagaaaaggtaaagatcattcaagaaagattgcgtgtggctcagtctcgtcataagagttatgccgacaatcgccgcagagatttaagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaacaagctaatcttgaccagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttggaaagcgtcggagacgagttcgattcggatcggttttccctctctccaagccgaaggtttccttcgccgttgccgtcgccgtgggccttcgccgccgcctccgagcccctttaaaaggaccccc

SEQ ID NO: 51942 - DNA, 1501 bp, Oryza sativa
gtggtggtggacgctggcgaggaggtaggcgtaatccccggcgagccgcagccgcgctctggcgtcggcgtccgtgccagtggggcggcggaactcggaggcgacgaactcgcggaagtgcttcttggagtccccccgccgacgtgcttctgcaccgccttgagcacccgccggtagacggccgccgacgtggccaccatcgatctgtccacggatccgccgcgagaggaggcaatcggacgcggagactgcgggtcgccggcctcgccttcttggccgtgtcgatcgaactggaactgtagaggaggaggaggaggaggaataggtaggcgtccccttgccggagattctcctctgcagttgccggagttcgccggagcttctccgccttcttcaggaaggagtaaaggacagagtaaagggactgaagtaaaaaaaattgcaaagaatgaaaagggctattctgcaaatatccatcttcatcctgagcctcaatctgaccgtccatcttcgatctaacgcccaaaacatttgcaaatcagaccatggtttggtttggattggactgctacgagtttgcatataaccaaaaatgcttctcgctcgaacatttcagcataaaataacttttttctttatttgaagatggcttatcaatactttattatatctattataaagctttaagtttttccagggcggatccaggaatgaaaaatagaaggggctcaacatacgggaaaaaccgacataaacatatcatgtctcatacaatattacagtatcaacaggtacccctatatcatggtctgcaatttcgattctaaaaaatttaggaattctgcaacaccatcccccaaggaaactatcacacccaaataaaatcatttttcttgtgaagtttaacaaaatctattcaattttggtaaaaaaaaaattcaaatatcgaaaaactttcttgcctaaaaatttcgaaatttgcagtactaatcttgaattcctagctaatctaagctccctgattcaaatattggccatctttgtttaggcttaaacttattggcttagacttttaagtcagcttattggcttatatgatttataagccagtgaatttaatgtcctaagtttagtggtagagtcatacatctatcttatataagccaaaaaaagcttctccaacttagcttttggcttaatagtgtaagagtggcttataactttaagaaagccaaacgaaaaaactgcttgtttgtttaggcttagactttttggcttataagttgacttataagcctaaacaaagaggaccttaatagtggaagggatcgccaatatatcgggttttacggttatgtgatacaaatcaaatcagatttgcccaataattgagcgagtaaaaacgaactttttcctactttttgcagcacgcctgatgatgcgtttgtgatatcgtgggcctcaaccaggtgccagcactcccgtcctgaggccatcgacg

SEQ ID NO: 51943 - DNA, 1501 bp, Oryza sativa
cccattggcccaatagcaaaaaaaaaaaaaaaaaaaaaaagagcccaaacactttctaaccctgtctcctcaccacccatcccaactctccccgtctcctgactcccgatccagccaccaggacagccgagaccgacgcggcgacgcgccggcgccggcgccggtcgccctgtgcgctgcgccccatcgccagctacccgcctggcgcatcccccacgtcgccaccgccgcgtctccaccctccaggctccagccacggagccgctgcgcacggtgcatccggcatcccccgcgtctcgccctctccaagctccagccgccactcgccggcccgccgggacgccgccgcgtgccgcctggcaggctccaccgcaggtggcaggccgctggccgcattgccacaggcgctgtggctgtgcacagtgcgctgagcagctgaccgccccctgcctccctccactcaagtactccactcactaaggtaactcactaactcttcccttcaatcctcgcctagatggctagatggttaggaagtaggaacaatttggattaggaaaacaaccatacaggagattaggatttaattcatagttgaatctagcctgttggatattgttcatggttgaacattttttatttaaaatttgaatccacgaatgatttatggttgaatagagtatactgttgttttgtaggtttgaaacatgaaaaaaaggattggttacattcattaaaagggatttcttcttgcaagttcaggataaagataccatcaatcattttcaaaatatcaagaaatggaaagttcttctctaaattgtaagatttcttatcattttgccattttgtatactctataaatttgatatgttttcgcaattaatagtttagtattatactctaatatgcttaacacattcaatttatgatcaattttatccatccatctatgactttataaaatcatgtttataccgttatatattatacaattattagactctgggttgaacaattttttctatctcttctaatttcgaatacccaagttgaaaatcctgggcccgccgctcatcaccaacaccaaccttctccactggctgatgcgcctgcatgaggcggctcaggaagcgcaaggttgacggctcaaacatcacccgcaagcgcaaggccagcgacctcatactgtcatgatgtcatcccttagatctctcaagaatttggtcattcctgatgaaagcctgacaaggttggaacatgtcgtcaagacccttacacagctctgcgcaacctcagccactttcattgagctcatcaagatggatgattccaaaacaaaccagctgcacaaggcagcagaggccagctctcatctcccggtagatgtccctgtgtttggccgggatgaggtcaaggagttcatcctgaatgtgattattggatcaccgtagcatgatcatccagaatccagcattggaactggtaaagtaagagcagc

SEQ ID NO: 51944 - DNA, 1501 bp, Oryza sativa
caaactagatatagttacagtcctccctcctatctatatatggtaaaaaattttagtggggtctttgtggggctctcatagtcttcacgccagtagtggaccgtcaatgtccgccgctcaccatcattcctccaccaccaccactatatccgtctaagtggagagaatatcccaccaccaccatatccgtctaagcagagagaatatcaggtgctactgcacaataatgtgctaccgtgctaccaacctcgaaaaatacatccaaaaaagtcacaaaaaatgtaaacaaattatgatatgtgcaacacttggcatacaccaccactaaaaaaaatcagttcacaatacgacgtacacagtgagagaataaaaagataaatctcaggtgaatagtaacataatctgtttgaatattactggagtacaaatttgtttttttttctcattgggtacatcatattttgagctgattttttgtgtggtggtacatgtcatattgttgcatatctcagatttcttttttcacatttgttgcaaccttttggatgttaattccagaccgccggcgagggtcaaaggagggacctggccaccccccgtactagtttagttaggtcggttctttgttgtgaagtattcactgcagcttgggttcttcccgagttgggcttttgctagcatggtctcatggatgctggagtagacggcggtggcagcggttggtggcgatggagaagtgggaatcgatgatttgcggcggaatcggacattgaaattgtctcctctaagcagcgccggcttgctcatctggatgggtggggagggaacagctccccgtagctctgatttgatgttccggcgcgacaacatcgtcttcagcttgctagtcgactgcctcgtcttccggacagcagttcattcgccaccattcatgttcttgggtctttatgggtggctagatttgggtatcttctacctattgtttccttgaagcagtgtgcatgcaagatttgtcgttcgggttaagctcaaactcctctgattcagcggtgaactccgtggcgaattcctattgagcctggtgaaacccacaccaaaatttacagctcagcaacaaacctccaattatgtcatttctgtgaaggcaaccgaaggtgattacatgttatcaagcagtgtgtacgtcaaaggaggcctaaggatacacaatcgtcatggcaacgccacagttccctatcgatttgcacctctacatcttggtttcaataaaaagtttgcaaccttggtgcagtttcccattctttggaatcggatggctagtaactttcggccaaccaatttggtgatgtactaggattaccattgaaaaaaaggattacctggtgatgtactaggatttccacataatcattgaaaaaaaagtggctcccagaaaagaaatgtggggaagcttgtttgtgacgataaataattgagtaggatggcgaaatcaaatccgatt

SEQ ID NO: 51945 - DNA, 258 bp, Oryza sativa
ggcgttatgggaagagggagagcgcgggggaggaggggactggcggcggtggctagggttgccgacttgcggggtgggttgttagggcgcgtcgttttgcgaaaaaaccccttgatttttaaattttatagcgcggtcctaatccaggcgcgacacgactattcctatacggctatacgcataggaggaggaagagcccatgaccgaactgcattgcttactgttgggcctggaattaggcccattacctgagaccga

SEQ ID NO: 51946 - DNA, 1501 bp, Oryza sativa
gacggaacgccacgcgcagatatgatagcacccgcgcgtggctagggttttgctcggggagggaagtgacggctagggtttctcacgtgatacaatacctccgccggtcacacccctcacgaatatataggatccatcactcgggcctccaaggcccgtaggactcctattcggatccctatccgaattaatctcatattggatctccatgcaatccctttattccggcccattaagcgtgcgacccgaacatatatactcggttgtaacccgaaaactcctttcggtccacgcgtcaacagcgttagcataacgtattgacccccgggcatacataaagatcatatcagctgaacctctagtgtatacttgtatgaacccctttgcctcacgatatcgattaagctcaaggctagatatgtgccatcctctaatagctcaatcattcattcgaacctgttgatagattatataacttgtgattgactcctcaatcacctttggcatggccatgcacttctataatctacaacatcgaggggcccagagatatctctccataggaggggcaaatcccatcttgattattcatatcccactacatgtaattcatagcatacccgaaaactacttttatagctacccaattatggagtagcgtttagcagtccctaagtaagctactacacatgttgggaaccatgataatctcaggtctaaggattcaacaccaacactaaatgagatcactgatgacacaacacatatggctcttgcagtgtctcatgttgggtctatccaacaacctgttcaataacatgtgtctacattattaatttggtatctctatactatgatccatgagacatgatcatcaattaatacatgtgctgatcatctaaatatatttgttccacatatgatatttgatcagggatcctttagaaatagcaacacacaacataaagagtctcacgaaagaatcacatattcattaaccaataatgagtttatctatttcaagaaacaaagtcggataaatatgtaaacatagtgtgtgatacaattatctctatgattggctctagggcatatcactaactaacagattatccagtaataatgtactatactgctttttcttgtctttttcttttatcacatattgagccatggattctttttcaatcattcactatctcactgtgggtagaagacgaaacttcaatttgttttcatatcatttgttcctactaactattatttttttagtccagaaaattaggtggcaggtaccatggtatcattatctagcttgcatgagccaccaataatctcaaattcaagagaacctgcatagcgacggcacagtacgatttattcaaatcatgggatcaaaatttaatgcagtggagttgtatgttcaaaaataaaataaaataaaatcagcaagtgttgtttaattaaccaattgttttcttccttgaagcccctgtcttga

SEQ ID NO: 51947 - DNA, 1501 bp, Oryza sativa
gagagattgtgtttattgctaattggagtgattaaagttgtagattagatggaatggatgcatggagtaacccaagtcagagtagcaaaggtctgggactggtcagcaaagggcagcgtggacgtagctcctctttcttttcttgcttgactcattctccctaaaaatctcctaccatctgcctaccagtttccaagaaacaaacaagtaccccccatgtttctgaaatttgatacttgtctattttgcttatgtcaagtatatagtaatgactaaactacgttctcatgcgataccacgtgattaatcaagtgtataactggtctactatttctttctctaatgggcactacccgagttctaaaaacacacacccaaatgaataatacgataattatcactggatgatgttgcttcagtttccagcctcccgaaaagaagcttccattactccaaagaactgttcactagagtacagataaacagagggaaccatacaaccagtccagagggacccaacgcagtgccaaacgtcaccatttcatgggcaatattgttacaagctctaggacagaacgtacatctctttactacatcaaaacggaaacaaagtccctagcttcacggataacaacagcatttgaaccgtcatctcataaatttgtcatccttaagagcttggaacagttagttgcttagattcggtttctgatataatctgacttgtacaaagcaaatcgccaattaagagctccaataccatagcttctgcttgtaacatatctttgtaaataaattcattgatctttcagctccttgacagcactgcatcttttatcatacacttacatggagttctgccctgcaggggatcacagagcagggcatagtacagtcaagaataatacagggaagcatatactccccttcgtcccaatttaaatgcaaccatgattttctgtgtccaactttgatcatctgtcttatttaaaaacaataaaaaaaacaaaaaaaaaacataagtcacgcataaagtaatattcatgttttataatctcataacaataaaaatactaattataaaaaaacaaatcaaataagacgaacgattaaaattaagcatggaaacttatggttgctcttaaaatggaacggatggagtatttccagcggggatcacggatggacatacatacagtacagcagatatattgggggcgccggccagtcctcagctttgtccacacctgtttctcaacatttttctatgctagttgctcctaacttggcctactgtcctccatctccaacaacacaagagtacaagacaagtactacaacggcaacaactatgcatgacatcaaaacgaaagctgggacctcgtcgatcaaagctaagcacaggcacataacaccctcaatgcaaccagcagcagcgaggaggccatgctgccatgaatcatgatcatggcgtcatcacaggagttcgaggctaatgacc

SEQ ID NO: 51948 - DNA, 1501 bp, Oryza sativa
gatgcagtatatatcagtcagcttaattaaacaacgtacgcgtaattcggtcgaaacgcatggatgatctgatcgatagctaatactaactgcagatcgctaatataattaagcacatacgcgtatagttaattacctggcggtggtcgaggtgcaaggtaacgccgccgccgccggggcgaggtcccttctccggcacggccgcgtgctgcggcgttagtgacgacgccgacgacgctgcgacggcgacggcgacgagcaggagcagcaacggcagcttcgtgcaggccgccgccgccgccatcatggacgatcgatatatggaagtagagctagctagttggacaagtgacgactaaagcgcatgatcaatcgatcgatggatatatgcgtgtgcaaaacgcgctctatctatatatatatctatcgatcgatcggctaacttatatagtagttcttgcttccatttatcgatcgatattgaagcatgggcggctgggatttagtatcaagtgttggttacggcgccggaaagacgaactttaaaagaatgggaaataatgatggatgatgagtttggttgttctagccgtgcaagtgcggtgcgtcgtcgtcacaattcttgcctttagctcgatctcttcgcagttttgtttgttacaccaagccgttatcttgcttttgctctgcctctgatcatcgacgatgcagacactactacgcagttggatgcaggtctggcctccttaattatacgtagcagcagctaacaaatatttaatacagaaggaaattgttggtctgtgcaatttgccttcgattatattagtcgtcgttgtcatcaagtatacatgtaagtacgtgcttgactcgatcgaatcaaattaaaccacattgtgtttcagcttaaaattgctacgtacggagtagttgcagtgggattaggtacatatttaggtaaggttcgtaccgtactccactccactaatcgtcctgaaaatttctcccaaaaaaaaggactggtaatcgtcagcataagcatgcaatgcatgcagccggccgctagctacacgggctgggccttagtgggctaatgggcctagcccaaatcaaacaacggaaggactaccgctgcaagcaggctttgcctttaccggctttaaactagttaggcagtttgggctgccccaaataaaaaatactggctaactatcttacccttatacggaattgctaaccttgtcgactcgatagaaaacacatctccaaatcttacagatttttctccaaatattacagattttggaccactggataagctttatgattcgtgctccaggcattctcctccaacttcggcgacctcctctttttctccggcgtcggcaataccctaggctccggcagaggaccctacgggttagggtcccgagttggggtggtggtaggaggggtgggagagggagggggaagagggtggagttcgccagctttagaggga

SEQ ID NO: 51949 - DNA, 1501 bp, Oryza sativa
gtgattgcgaaaggcgtcacataaaacgttctaaagcgaatgaaattatgtgtgcatcaaagttccactcctgttttgcatcaaatcaacataacataacatacaacattttgaatgaggcatgaaagaattgtgatatctttcaaaaggaatttggttgtgatagtccgttatcaaacatgacaatgatccagatcatggcgcagtcaagcagacttgcattgcatattttcaagccgccagcagatggactatcgcaaaagcaaaactaggaacatctgaaatttctacagaagtttcaaggctgagtaacaagggatgatacaagtgtatgttgggataacaatctcagaacatgatcacaaggtccagaatgccgataagtagaaaattgaacaatataagactacaagggaacaaaaaaaaaggttaggggactcactgatgcaagtgtcatgctctctcatgtataacatattacttccaccacagctgcactcatagcttccccatgtattctcacaagagcagtccttgcactggcagaaaagcttgtctttgcattcatcaatatctgaaaacgccaaccagagatatgttaagtaatcacctaacagtttcaaactattcagggtttgccagtactagtttgtatgggttttacaagatggttggctcaagcagaaatatcaatctttctatatttaaaaggaaagttttgccacatggagtaatattaccttcacaactttttataccatcacccttgaaacctggtgggcatttgcagcctttagattcttcattctgtagagttccatgattagttctgacctcatagaacagccgcaaactagaagacctctggaagagattcttactgagcaggcagaaaccgtcttcccatttttagtttccttccagcagcctccgttgttgatttggcacctaccgacaccagaagctgccaaagggccagccgtaaaccaaacaatgtaatactaatagttgaaataataaaacaattaggatgtgttatgcatagcacagtctatagcaaggaaacagtattgtttcaaacaaatgaaaaaatgattccaaagaaataaatgctgccaacccatcttgacgaaataaaatgcaaatgtgtaccttcacagtgagtgtacccgtcaccaacgaacttcacaccacgggcaatagggcattcacaaactcgcccacggaaggtgtcctacaatatgtaacacagcaaataagaatgtgcacctcaaactgaatagaggtgaatgtcgtaaccagtatcagattatcaataggtagtactacctccgtttcaggttataaaacgttttgactttggtcaatgtcaaactgctttaattttaaccaagtttataaaaaaaagtagtaacattttctattaggaatgtatagccatatatgtataggattcttttgtatccttagtttccttgtatactcctctaattgaggaccc

SEQ ID NO: 51950 - DNA, 1501 bp, Oryza sativa
ctataagtcttgtaacaaacttgcaaaaatcagttgcctgccaattcttccacagttgtgtatgaattagcaaacatttcaccaagtaaacatcggacaaacacacacagtcaaaataaacacatgacaaactgtctcctctaaggtttttgcatacttatatgtgagacctccttacaactattattggttagttctatgaaaaaaaaacttcatcaccgcgtgctagcccatagcatgggtagtctatgatgaatttcaccgtacaatctcatacttacaaatgggattagcttgctatgggcctatgtggatcttgcctaccaattctcctatgacacaatactttttcgcatgtgatatccctgattctaatgatgaatttcacggtatttgtgatgaccacgtttgcctccgtgaccaatttttatgatcacacttgagtcatcactagaatcagttgaggcggaactttatgccgacttcttttaatatttgtcaaacatcaatgacatattccctatttgtcaaaggcaatccgtcaaggaaggccgaatatgttgtagtgtgggaaagaactcttgttagtcccaaaaggcgattgtgagcgatcctgatacccactccgcaacttcctattcgaccactctcctctctagtctaggcaccccttttacaccatctcgctgccataccatcgtctcggcgtgtaacagctccatggttaactaaaataaaaaaatgcaaaaaccatcccaaatatctccttgagtttaagattcccccctataaaatgatttattgctaatacgccctactatttagctttgtgtgagtcctccccaattgccgttgtccatgcattcattaacctttgtctgcatgtattctatgacttcttttctcaccagtctactaacagtgacctaagtgttgcaccaagctcatctttatcatcttgaatctaccaaagaaatcatccaccaccgaaccccatgaagtaagcacaacaattcatcatgtagtgcccccaatgttttagaagaagactcgtgaccactaccgcccaacgacgtgccgggcttcctgaattgggatgccacgatcatgtcatagggcatggccgacatgactaacgatcatggctcttcacctattagtattcactagcaaaaatgcatgtgtgtagcaacaggtgaagacaatttttacaattgataaaaactcaaccaatttaaaagacaaactgaaataagactaacaaaacaatggcaaaaaaaagtcagaaatcatatataacattgaacccgatagcgctcacctcatgcgtcatcacacgaagaataccttatatacaccattccatagcctcgcaaatcgatcggatgtctattccataaattgatgaatgggtattttgctatatcatattgaccaaagattaaaattttgattattcaattagtgaaagtcttttttactatagatgaaaagtatttgc

SEQ ID NO: 51951 - DNA, 1501 bp, Oryza sativa
tccccgaggcaaagccaggaggtctctacctctctctctctctctctctctgaattcgtcgccccgtttctcagcttgctttaatttgtgtgaaatttgagttgatcgatattgcttcgtgtttcggtttcttgatgtggatttggtcctttaggatgattcttctccctttttttttgtcagtggaaatgttgtgctttcctcccgcatctcatgtgcttctcctgaatgaatcctagggttgatttgtcgagccaggttttccagttttccatttttgttttgagcaatcggttaaattcaggtcggaagggagctcccctaccgccgattcctcaagcttcttacattgaacagatgatttcgatgtggagatgtggttgggagagggagaagagcttgtgccttttagactgagctttgcatgcttaatgggaatatcaattggatgaaaatgatccctgatcgggacaccattctcggttgattttttgttcaggcgttcagcaaaatgctggtagcgaactattgtttatgaattatgagattaactagggattagtgtgtacaattatcagtaacaggaggcgttgaccatcatagtgtagctacgatgaccatcatagtgtagctacgattatagtagattcttgagctaatttttaggctgaatgcatagtccctgctttattagaggtaggacattggttgaagcagggcggaagctttttactctagaaatttagaggtagactttatgaatctaaaggtcaactggaacccaaaggtttaggttgtaaagttagatgctctttgattgcttttctatgactctaatatgtgcattctgatagactgcaacggccagctgactggcattttttactttgaaacatatttctactagatactgtgattgattgtgattttgctttattgtgccattcagaactaaatgcaatatttagcatcagatatctgcatatgtataattccaaacaaagtaaaaactgaaaggaaaaatgttcccaaaagaattcagaataactttctaaacttcccatgcaaatgatttttttcccctgtaaattaactagttccacaaaaaagaatccctgtctagcccttataaaacctgttgttcagtatgttctctctttcctatagagataagactaacaccatattcattttgcttccagtctagacaaactcagcttcatgagttcaagttcaggaaaagcactggcatccagcatctcctattcagcaggaaagagcagcattttcttgctctgcctctttgcaggatacttgggaattcctggccgaaaattccacttgctcaagaccgtttgcagcactgcatctccttccatcattggaagttgtggagggaaccttctttagactactttagcacaagtcttcagtttctattagtgtggaagcttggcctgcaaaaccagcaaccttagctacgtagtaggcctttggatga

SEQ ID NO: 51952 - DNA, 1501 bp, Oryza sativa
ggccttgcctacttgcatgatagctgtcgagattgcattatacattgtgatatcaagccagagaacatacttctcaatgaatctttcgttcctaaaattgctgattttggaatggcaaagattttggggagagaatttagtcatgctctgactacaatgagaggaacgattggatatcttgcccctgaatggattagcggaacagttgttacagctaaagttgatgtttacagctatggaatggttttgtttgaaatcttatcaggaaggaggaactcaagtcaagaatatttcaaggatggtgaccattcgcctattttccaatgcaagtcgcccgccagcttatcaatggagggattggaaatctggtggatgcaaaattgcatggtgatgtgaatctcgaggaggctgaaagagtttgcaaaattgcatgttggtgtattcaagacagtgagtttgatcgaccaacaatgggcgaggtggtgcaattcctagagggtgtactagaactcaaaatgccaccattgccaagactactgaatgctatcacaggaggctcacattcaacaccactgtcatctttagatttaccgtaaatttgtatgctaatttgtaatttccagtagtttatgagaaaattatagtttctgtctcatttcaagaaaactaggcatagaaaataagaaacatcagtgttcataataagatccatatctctgtgtctgtacacagtaggacatgttatacataccgtagacctgtcattttgtcagttgagatgcttttaacaacacaggaagatttccttcccagttgagagtacattgttgagtccaatatagagaaatgtactgacaacctgcaagtcatactgatatatgcacagatgacatgcatgtgaagcagtaatggatatagactaacaaaaatatgcagcctaactgctgatccaaggaaataagcacattctacgggctaggatgaacactaacatagcaattgcaagtgaatgtgcacaacttcatatgacttactgtttttgcatattctgcaaagttcaatccagtgctgtaccctttctacaaggcccaaacaaaaccatttggagtagattggacctccttatatgggataactaacttttttatgttttccaacatatatactgacacaacctatcgcccctaagcaagtgaagggtttcatctttaatcatgatatgagtgaagtgatgattcgaaataactgtaggatgatatgattactcctgctacgatggatgatataactacataatggatcactcaaatcctgcactgctgagtattagtagaactctacagaggcaccatcaacgggaacactggccaattttaatgagaaaaattgccacataagacagtgagtacaaagtacaaagcaaatttcctggccagctttcattgtgcaggatctgatatgttatattatgattggtaattaacatagcagacaacttatg

SEQ ID NO: 51953 - DNA, 1501 bp, Oryza sativa
tccaccctcttccccctccctctcccacccctcctaccaccaccccaactcgggaccctaacccgtagggtcctctgccggagcctagggtattgccgacgccggagaaaaagaggaggtcgccgaagttggaggagaatgcctggagcacgaatcataaagcttatccagtggtccaaaatctgtaatatttggagaaaaatctgtaagatttggagatgtgttttctatcgagtcgacaaggttagcaattccgtataagggtaagatagttagccagtattttttatttggggcagcccaaactgcctaactagtttaaagccggtaaaggcaaagcctgcttgcagcggtagtccttccgttgtttgatttgggctaggcccattagcccactaaggcccagcccgtgtagctagcggccggctgcatgcattgcatgcttatgctgacgattaccagtccttttttttgggagaaattttcaggacgattagtggagtggagtacggtacgaaccttacctaaatatgtacctaatcccactgcaactactccgtacgtagcaattttaagctgaaacacaatgtggtttaatttgattcgatcgagtcaagcacgtacttacatgtatacttgatgacaacgacgactaatataatcgaaggcaaattgcacagaccaacaatttccttctgtattaaatatttgttagctgctgctacgtataattaaggaggccagacctgcatccaactgcgtagtagtgtctgcatcgtcgatgatcagaggcagagcaaaagcaagataacggcttggtgtaacaaacaaaactgcgaagagatcgagctaaaggcaagaattgtgacgacgacgcaccgcacttgcacggctagaacaaccaaactcatcatccatcattatttcccattcttttaaagttcgtctttccggcgccgtaaccaacacttgatactaaatcccagccgcccatgcttcaatatcgatcgataaatggaagcaagaactactatataagttagccgatcgatcgatagatatatatatagatagagcgcgttttgcacacgcatatatccatcgatcgattgatcatgcgctttagtcgtcacttgtccaactagctagctctacttccatatatcgatcgtccatgatggcggcggcggcggcctgcacgaagctgccgttgctgctcctgctcgtcgccgtcgccgtcgcagcgtcgtcggcgtcgtcactaacgccgcagcacgcggccgtgccggagaagggacctcgccccggcggcggcggcgttaccttgcacctcgaccaccgccaggtaattaactatacgcgtatgtgcttaattatattagcgatctgcagttagtattagctatcgatcagatcatccatgcgtttcgaccgaattacgcgtacgttgtttaattaagctgactgatatatactgcatctgcatgcatgcaggtgatgg

SEQ ID NO: 51954 - DNA, 1501 bp, Oryza sativa
acttgataacttaagtattaattgtattatatggactaaatttttatataggacagatcggtaaaaataaatcagcttaatctctactattataaaaattgaagatatttttgccggtactttggtacgccatccgtctatgagtcagtttttaaattcattcgcttttggaaacacagatccgtatttaagcccgtttttaagttcgttcacttttgtaaatacaaaagaaatcgtataagaaatctcattaaaaaaagctcgtatgtcaacttaagacgatcggactcctaattgtaactcatgattttctaacaaaatatatatccaagcgattttaacacaataaatttcatcctacctaaaccatataacaataacaagattaaaatagccttcacttgttgcaacgcacgggtatttttgtagcctatttaaaaaagaaagaaagagctactccagtatgctctccgattgcaatccaaagtggtttcaaattagaaaatgcctttgcctcccactcttaaaaatgctcttggctttataccagctagcacttccaaaaattgcagatctcggcgtgaccacgagatagatttgcggctcagcgtcaacagtcaacagtcaacagtcaacacacacaggcgcacatgcaaacatgcaatgcgcgtcattctttctgatatgaagcctgtgctgaacattttcttttactcgtctggttgactccccctaattcagtttcagtcttcacttcttgcatatctggactacttttttgtcggccatgtactggactatgcagcattctcatagtgccaaattcaaaacccatttgatgatttgaagttggcatcattgtatcgcatcgcgtggtcatgcttttgcccaaatctgtgaacatcatgaaattgatttcctgttggaaaaagaatatcagattgatctcatcagtgcttaaatctttggcatggattaagttttccctttggagataaaagcatgatatattggtccaaaaaatggaagaagtctccaacaagcagcgcccattgcattgatgtcgtgaaagaacttccactgaactgcaaagttttaaaaaaaaggggttctctaaaagattaactcaactggaagttgctggaagagatgtcaaacatatttcttgaatagtttgcacatattattacgcagtcaaaacgatgcattgtttaggtctgaccaatgagaagattattaagatcgaggttaacccactgtcagttcttaatacagactgattaggacgtgcacccacaccatgacgttgacctggattctgagagctgaacacagaactgatattgtctaaaaaatcacagaactgatcatagaactgatattgtctaaataaaaaacacagaactggtctggcttcgaaacattgcatcacagtcgtcagaatcgatcatattccttacaaattccagtcctccactaaccttccctttcttcactgtcc

SEQ ID NO: 51955 - DNA, 1501 bp, Oryza sativa; identical to SEQ ID NO: 51931

SEQ ID NO: 51956 - DNA, 653 bp, Oryza sativa
  unsure (1)..(653): unsure at all n locations
ttcggtgtttgccacggcgactttttttttttatgaaaccttcngcttggagagagggataaccgatccgaatcgaactcgtcttcgacgctttgcaaagcgatttaaccaaagattccaaaggagaaaaggtagaggagatcccggagattgtttcccctctaacaaatcagccggagaaggaaaggaacggccggatttggaagggaaacggcggcggcgcgaaactagggtttcgggcggcggcggccgaaggtagacgacgactgacgggtgggccccacctgtcagcgacagcgcgctcgcgcgggcggctgcggactgggccggactgggccgaggagagagagaacggttttgggccgactttcggcccaaagccaaaagagactttttaaaacctttttcaatttaaattattccttaaatgcaattccatttattaaaaatactttcttagctcaaataaatcccagaaaaatccaggaattatagaattaagcaaagtatttaatgaaattttatctggcccaattttatattggaatttattaattaaacttagatcttctcttcaagacttttaaaataaattctagaaattccatttaaacaacaatttatatatattttaaattttcagggtgtgacag

SEQ ID NO: 51957 - DNA, 1501 bp, Oryza sativa
tctccctttcagtcttccggacctccatttctctcccacctatttcacctttttcttttaggaggattttgtattttctttaataagtccgatccactgcaagctacgtgcgcctctagctgccggccaaatcctagcaccgttgccacgtcgatttgcctcatacgtttcctcctccaattgattgcaaaaatcgattccccactcccccctcattatttccccatgattttccctattaattcagctttaattcatcaaatttaatctgcgtttaacggtcaccaatgatgtagccgacaagcttccccgggtcatttttatccccaattttgcagattcgcttcaattattgagaaacagaaagaactccctcattatttctccaatgattttccttataaatctggctttaattcaccagatttaatcttcgtttaacggtcaccaataatgcggccgacaagcttccccaggtcatttttatcccccagttttatggattcgcttcgattacggggaaatagaaacagaagattgagtggattaaaaatccacaactaaatttgggagatcgagaaagattcggccagatttgatgcaaaggataggctacagcatcatagtagcacatgactgtcgtccggaggttgaagacgctaatgaaacgtgtgggtctagcttggtagcaagaggagacatcggctatgctagctgggtctgcagctccacttatgtatagtgatcttaatgtttcaatatattgcttagctcctaatagttgttgtatattaaaaaacacttacctgttgccaggggcggactggtgtcagacgacaccaacgactttcggcaaaacctatagcataactgcttatctatgttataacaatatgatctaaacataattagcatactatgacatcaatagaaacgttatgacaccaacgaatcgattttatgtatccgccattgcctgttgcaacgcagtctttttctagtatatgaaatatagcacaggcgagtggccttgacgatggcggccggggcttgtgtcgatctgttggaggaattgtctggttggggaagaaccacctgaacgctggcctaaatgctgtattctactacttacctatcgcctgattaaactgttggctgaatggctccggacccacgagtccatccacctgccacgagagggctagatggttgcagctcttttcctcctcgtcaacgcgtcgagcacaagcgcgtggcagccgtggcctgatggcgcgccgtggaatttgggtaggagtggatatacaattgtatatgttgatgatgtaacgtacggttgattaataataaattaggtgggaaaagatcagttgttactcataacaacgaaatttccttactgataagacatgcgttcacatactagattgtacaagttctatcgtgtacagacatgcctgatgcctacctatagtccaatatacagtatactagattgtga

SEQ ID NO: 51958 - DNA, 1501 bp, Oryza sativa
accctgaggtatggcagaataccctggagagcttcttccaagttccaccaatcactctcggcaacccttctccaattatcccaggagaacctacatctcagcaggtttcctattacttttgctgctaatggtaatccatctagcttctttgcaatcccttgggcgatcaatagcatgtttcggttgtcatcttgttggggaacctccacaccaccaaatgtgtggtactgaaagagaggccagaagctctcccacggcaatgcttttaaatttatgggataaatcgtggcggcaaattgtgcaaccctttagctctgagttgtgacaaggaggacactcccatgctgacgtgcctcatcggataatgctgtgagcagcacgctccattcctggcacatctcttcccacatgttgtctagcaccaaaaagaatttacatcctccactgatcttgatacggagcttggtgatggtagcttccatgctttcatcgccattgaaaatagcgccaccgtgtccttggaacgaatgcaggatttcttgcaaagttcttttgatggtgaaatcctcagaaacatagacccaagctctatgctcaaagtgttgcttcactctggcatgattgtagatgacctgggcaagtgttgtcttccccacgccactcataccgactattgggagaacaagaatgttgtgcctggctgctcttactttaccagttccaatgctggattctggatgatcatgctacggtgatccaataatcacattcaggatgaactccttgacctcatcccggccaaacacagggacatctaccgggagatgagagctggcctctgctgccttgtgcagctggtttgttttggaatcatccatcttgatgagctcaatgaaagtggctgaggttgcgcagagctgtgtaagggtcttgacgacatgttccaaccttgtcaggctttcatcaggaatgaccaaattcttgagagatctaagggatgacatcatgacagtatgaggtcgctggccttgcgcttgcgggtgatgtttgagccgtcaaccttgcgcttcctgagccgcctcatgcaggcgcatcagccagtggagaaggttggtgttggtgatgagcggcgggcccaggattttcaacttgggtattcgaaattagaagagatagaaaaaattgttcaacccagagtctaataattgtataatatataacggtataaacatgattttataaagtcatagatggatggataaaattgatcataaattgaatgtgttaagcatattagagtataatactaaactattaattgcgaaaacatatcaaatttatagagtatacaaaatggcaaaatgataagaaatcttacaatttagagaagaactttccatttcttgatattttgaaaatgattgatggtatctttatcctgaacttgcaagaagaaatcccttttaatgaatgtaaccaatcctttttttcatgtttcaaa

SEQ ID NO: 51959 - DNA, 1501 bp, Oryza sativa
tttgacatctcttccagcaacttccagttgagttaatcttttagagaaccccttttttttaaaactttgcagttcagtggaagttctttcacgacatcaatgcaatgggcgctgcttgttggagacttcttccattttttggaccaatatatcatgcttttatctccaaagggaaaacttaatccatgccaaagatttaagcactgatgagatcaatctgatattctttttccaacaggaaatcaatttcatgatgttcacagatttgggcaaaagcatgaccacgcgatgcgatacaatgatgccaacttcaaatcatcaaatgggttttgaatttggcactatgagaatgctgcatagtccagtacatggccgacaaaaaagtagtccagatatgcaagaagtgaagactgaaactgaattagggggagtcaaccagacgagtaaaagaaaatgttcagcacaggcttcatatcagaaagaatgacgcgcattgcatgtttgcatgtgcgcctgtgtgtgttgactgttgactgttgactgttgacgctgagccgcaaatctatctcgtggtcacgccgagatctgcaatttttggaagtgctagctggtataaagccaagagcatttttaagagtgggaggcaaaggcattttctaatttgaaaccactttggattgcaatcggagagcatactggagtagctctttctttcttttttaaataggctacaaaaatacccgtgcgttgcaacaagtgaaggctattttaatcttgttattgttatatggtttaggtaggatgaaatttattgtgttaaaatcgcttggatatatattttgttagaaaatcatgagttacaattaggagtccgatcgtcttaagttgacatacgagctttttttaatgagatttcttatacgatttcttttgtatttacaaaagtgaacgaacttaaaaacgggcttaaatacggatctgtgtttccaaaagcgaatgaatttaaaaactgactcatagacggatggcgtaccaaagtaccggcaaaaatatcttcaatttttataatagtagagattaagctgatttatttttaccgatctgtcctatataaaaatttagtccatataatacaattaatacttaagttatcaagtcatgataaaataaaatatgtttagtgatttttttaaattactagaaaaaatgcccgtgctttgcaacaggtgaaactattttttcactgaaattcactgtgagaattcatttagatatatatttttctaaaaaatcatgttaagttagcatgcgagttttttttaaaagaatttcttatacgactctttttgtattttcaaaagcgaatgaacttaaaacccgactcaaatacggatatgtattcccaaaagcgaacgaacttaaaaaccgacttatatttggatgtgtcagggttacggataagatataccctctacccttggatgtacgctatacgacaata

SEQ ID NO: 51960 - DNA, 1501 bp, Oryza sativa; identical to SEQ ID NO: 51942

SEQ ID NO: 51961 - DNA, 1472 bp, Oryza sativa
actataggcgaattcgagctcggtacccctagtatatagaaggagttttggataaggaaggaaaaatagagttctacatggaaacgacaaggactattcggattatatccatattgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgtaccactgtacccacaagacacaaccccacatcatgtcaccatgtgcctcaataccaccacggtacctcggaaaggagctgtgacaataccccttgcataacacaatccaccgcaggcccaccttctggatcataatcacccccttataaacaaggcatggactccccagcatcccctgtgggcttatctccgccacttctcagtctggtgccccgcaattaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcgttaagccatcattaattaattaatagtgaatcataagttatcccaaaagtgtgctaatgtttctaagcatggctaagcaattatatctaatacatctagttgaaccaatatataaagcccaactagtcaagttataataacccaaagtatcaaggaataaagtaatcaagaacaaaagggctataacaaacaataggttaattccacccaatgacattcgaaaataaatgcaatagttgaatagaaacagtagctttaaataggatcaacatgctcaaagggttatttgggatctgtgtgacttgccttgctggccttggaactcttcaaattcttctcctgcgaaaacggactctccggaaacgtcggaatctaaacagaaaagagcaaaaacaccaaaacagcacataaacaagcatgaatagtacatgtggatatttttaacatgtagatctcaattttagaaaaatttagagacttgaaccaactaaatcggagctaagatgaattagttatgaatttttaaagatttaatcggattaaaacacttatattgattttaattgaattatgacgcaataatgaattatttttgaaaaggaaaaggaggattattgcgtcagcgggctagggtttcggtggaccgggcgcacggcgggcggttcacgcgaacggacggccgagatcgacttgatccaaaacggacggccgagatcgatcggtccacgaccagctcacgggagagggcgacga

SEQ ID NO: 51962 - DNA, 1501 bp, Oryza sativa
cgccacctggtggtccgcgagcggcccgatgatgtcagtcaaggggagagcctgcacaacatgaagtcacgatgcgatctaaaagttaaaatgtaaagggtcatcgattacactcacgttgattgtggcttcgcgttcagccgcttctttctcgcaaagaggggtgggggcgttgctcaccatcgtgggatcactgatcatcacctaggcaacacggcgctccacgattgcgctgttcaaacctgtagatcgagaaccaaatttcgataagtcaggaggaatgcgcatcaaaggagagaaacccagaatacaagaaaaataccccgaggagaaacccgggtcgcgtcctccggcccagagtagtcaaaggctggataggctcaagcctggagcggctggatccgtctaccaatgaagtcggcagcgacttcataccccgacaaccctcgtactcggaggtcatcgatgatatcgatgaaagactgtagggatggggtcaaggcgggtttggtggtccaagacggaatcatgtctggttgctcctcaggaacaatgaagactggatccgaatcttctatctgaagatagaaccacctcgcccgccatttgctacgagaagaggggcactggaaagggatgtatcgcgacttcaagccatcccgaagtcaaaaaccaacacacccggatacctttttaggttccatccagcgcaactcgtagtaaaaacggaagaggtcaagaaacggctctaccccaatgtaggcctcacagagatgagaaaaaatgctaaggaaggctatggagttggggttcagatgaagcagagaaagaccgtagaagttcaagacgagaaggaaaaactcagaaggcggaggaagaaaaccacagagaatgtagtcctcaaccgcaaccatgcggcccaggacgggttcaggttcagtacctcccggttccctctccatagtcctgcgaccgaggagagcgccctcctcctgcaatttcttcaaggacgcactgctggaggtggacttgtcgaggtccatcgccgttggagatcgccggagaagaagccgaggcgagcgaattagggtttgcgtggaagcggagaagacgaagagcgtttagaggctagaaagttttcgcaccagccggactcaaaaatggattcccaaaactcccttaaataggcgcactaccgacggtgcgaattccaaggaaaggagagagatggccgtcggaaatttctgggtccgttgcgcgaggcggtttctcggacttcaatttaaattcactcataaccgttgaacttcgcctggtgttgtcgatcactccttgtctctacgatccccacaccgagatcgaccagtcgagaacgacaacaactccgacatcagaagtcgtgatcggttataggagtttatttaagcagaagtcgggggctactgtcagggttacgaataaggtataccctctacccttggatgtacgctatacggcaata

SEQ ID NO: 51963 - DNA, 1501 bp, Oryza sativa
gagctccttgttggaagtggtgaaatccacaggatcgtcggctcgagcgaggatggagtggtagtccggcggcaggaagcgctcccacacggcgttggagctcgccgctgcttggaagtcggcggagacggcggagcagcggcaggcgtccgtgggagtggtgaaggagattgcatgagccaggcatgcctctgggaggcgtgagatgctgctgctgctgcagtatcctgcttcttcctccttcttaccaacgctcacatcgtcgtccacttcctcccttcgtgattgcttcatggccagcggcttcaacaactgtcgttggagatatcacaatctagtatactgtatattggactataggtaggcatcaggcatgtctgtacacgatagaacttgtacaatctagtatgtgaacgcatgtcttatcagtaaggaaatttcgttgttatgagtaacaactgatcttttcccacctaatttattattaatcaaccgtacgttacatcatcaacatatacaattgtatatccactcctacccaaattccacggcgcgccatcaggccacggctgccacgcgcttgtgctcgacgcgttgacgaggaggaaaagagctgcaaccatctagccctctcgtggcaggtggatggactcgtgggtccggagccattcagccaacagtttaatcaggcgataggtaagtagtagaatacagcatttaggccagcgttcaggtggttcttccccaaccagacaattcctccaacagatcgacacaagccccggccgccatcgtcaaggccactcgcctgtgctatatttcatatactagaaaaagactgcgttgcaacaggcaatggcggatacataaaatcgattcgttggtgtcataacgtttctattgatgtcatagtatgctaattatgtttagatcatattgttataacatagataagcagttatgctataggttttgccgaaagtcgttggtgtcgtctgacaccagtccgcccctggcaacaggtaagtgttttttaatatacaacaactattaggagctaagcaatatattgaaacattaagatcactatacataagtggagctgcagacccagctagcatagccgatgtctcctcttgctaccaagctagacccacacgtttcattagcgtcttcaacctccggacgacagtcatgtgctactatgatgctgtagcctatcctttgcatcaaatctggccgaatctttctcgatctcccaaatttagttgtggatttttaatccactcaatcttctgtttctatttccccgtaatcgaagcgaatccataaaactgggggataaaaatgacctggggaagcttgtcggccgcattattggtgaccgttaaacgaagattaaatctggtgaattaaagccagatttataaggaaaatcattggagaaataatgagggagttctttctgtttctcaataattgaagcgaatctgcaaaattg

SEQ ID NO: 51964 - DNA, 1501 bp, Oryza sativa
aagagcccaaacactttctaaccctgtctcctcaccacccatcccaactctccccgtctcctgactcccgatccagccaccaggacagccgagaccgacgcggcgacgcgccggcgccggcgccggtcgccctgtgcgctgcgccccatcgccagctacccgcctggcgcatcccccacgtcgccaccgccgcgtctccaccctccaggctccagccacggagccgctgcgcacggtgcatccggcatcccccgcgtctcgccctctccaagctccagccgccactcgccggcccgccgggacgccgccgcgtgccgcctggcaggctccaccgcaggtggcaggccgctggccgcattgccacaggcgctgtggctgtgcacagtgcgctgagcagctgaccgccccctgcctccctccactcaagtactccactcactaaggtaactcactaactcttcccttcaatcctcgcctagatggctagatggttaggaagtaggaacaatttggattaggaaaacaaccatacaggagattaggatttaattcatagttgaatctagcctgttggatattgttcatggttgaacattttttatttaaaatttgaatccacgaatgatttatggttgaatagagtatactgttgttttgtaggtttgaaacatgaaaaaaaggattggttacattcattaaaagggatttcttcttgcaagttcaggataaagataccatcaatcattttcaaaatatcaagaaatggaaagttcttctctaaattgtaagatttcttatcattttgccattttgtatactctataaatttgatatgttttcgcaattaatagtttagtattatactctaatatgcttaacacattcaatttatgatcaattttatccatccatctatgactttataaaatcatgtttataccgttatatattatacaattattagactctgggttgaacaattttttctatctcttctaatttcgaatacccaagttgaaaatcctgggcccgccgctcatcaccaacaccaaccttctccactggctgatgcgcctgcatgaggcggctcaggaagcgcaaggttgacggctcaaacatcacccgcaagcgcaaggccagcgacctcatactgtcatgatgtcatcccttagatctctcaagaatttggtcattcctgatgaaagcctgacaaggttggaacatgtcgtcaagacccttacacagctctgcgcaacctcagccactttcattgagctcatcaagatggatgattccaaaacaaaccagctgcacaaggcagcagaggccagctctcatctcccggtagatgtccctgtgtttggccgggatgaggtcaaggagttcatcctgaatgtgattattggatcaccgtagcatgatcatccagaatccagcattggaactggtaaagtaagagcagccaggcacaacattcttgttctcccaatagtcggtatga

SEQ ID NO: 51965 - DNA, 1501 bp, Oryza sativa
gatgggatcgaagcggaatcgaatataagggttgttgcggaaacagagtaagaatcggctggagtccggatcgactatgattgggatcggctaagtctgagtcagattaggttaagtgatacagccgattccgataatacaacttgtgtacgacatcgggttcgaattgatgtgcttcaagatgattgccacgcatggatagagtcctgggaaggcaattgtatctattaattaggatattttatgtaaattacttagagataaatgtgggcaaaagtctgccgcaaagacttatggtatcttacagtttgttagggataagagtcgtgtccaatatggacatattttataattcttgggtataaatagtccccgagccctatgtaattgagaacacacacgttcaaaacaatttcggcgcatcaccaccctttttgctttagttttatttcgacgagttcttactttcgggttgagctgcatcggtttcgatcttcaacatgaggtaaaacttgttatgacggtttgtgttctcgagattagtgcttccatctttatgatactctaatcttgttcatgtaatccgtcaagttatcctatatcttgcataatccttgacaatatcgtcatctaacctacaatcggctaacatctgttaccagaaggcaaccgattaggttaaataacgacgttggcttagattatatgagatatccaccactctacgaaacatccagcagcttgattgtctagatattgttcttcttttcatacttaatgttgtatcagttgaatttcaatctctagcctgcctactggttgccgattagggtagtatcggagtttcagccgatcttatctgatctaattgcttttatcctatatgatcgattgacatgttagatctaccctttatgttaagatcttgttgcatttaagtatattaggcttatgtttggtatattctatttgctttaatatcttaacacgatgtggtatcggagtattagccgatacatgctagatctatctgatcggctatgctatgaatatatgtataatctcattattaatatatatttcgatctaagtgatttatactgtctcggcaaggtgaccgatctatcccaatcacttgattcaagtatatatcgatataaggattatatattattgatatctacagccgatcgagtagatttaattctgatttgtttacttaacacatgccgatcgatttacatatgacatcggctcaaagataaatgatatgtcatcggcatttagccgatcggctatcatttatggatttaatcacggtttctttgtctttgtttcttgttgattgcatgatcaaatcaactggcacgctcatacatccgaaggcgagttttggacctgcactggagttaagcagatctcccaggcctcgtgttttctgtcaacacgcttttggcatgcctggtgggactgattagaagtcagaaggcagcttccctca

SEQ ID NO: 51966 - DNA, 387 bp, Oryza sativa
agtatcaccaagctgaccaacctacggcatctgtatgtagatggttcagcattgtccaagattcaaagtattggacagcaaactgaacttcaagagttggagagcttcattgcacgaaagggacaaggattcatgataagagagttaaagaacatgagggagttcacggggaggctgtgcatccgtggtatcgagaatatcagaagtaaggatgaagcgatggaagctagattgatggacaagaaacatgtgggtgccttggtgatcgaagggaaaagagtgcccaagtttgcacttgaaggactgcaaccacacacaaacatacaggaactcaccatcaaattcttccaggaacaagattttcctgattgggtgtgtccagataac

SEQ ID NO: 51967 - DNA, 1501 bp, Oryza sativa
taacatctcattattgttccttaacattactaacgctgatatatactgtaaaaaaacttcagcatgtacaaattgatgaaaaatgttcattcattttgaaaataatttacatgagctcttcctactattcttctgctatatattggctatttagttcaaccgcttctggatagataaacctgtgactcgggggtggagctagtgttatagcaatggtgtcacatgacaccaatggtctttgctataattttgacaatctaacgcttttagaaaacatatttgaaaagagaactatatcaaaaacttatttcaaaaataagccgtcacctcagtccaatggctctgtgccagcaatcatggcgctaaccctatatatctgttaagtgagagtatatgttcctatcgtacataaaccatcttgtaccgaagtggtgttggtcatccgtttttttaaaaccacaagtagacacgtggtttgatcacccggttcccatgttttttttgtaaatttttgcgctatttcccgtgagcgatgatcataaaggcaaaaaatacgtcgagggggagattcgaacctgggacttcgtgacatctcactaagcaagtgaaccactacaacacatgcaatgaaatgctcaaatttagcacacgctgtgtgcgcggatggcggagtttcggaaggttgccgatggcggtgcagatctggccgtggctgctgtgcacgaggaaggagggaggagtcggcggcgttaggatggaggtcgccatggtcatggcacttcgacggttggccatggcgggggcaactcacggtgtcactgccggtgtggcggtgtcccctgttcggatcgtggccgatgcatatggtgcaagagatgctgtcgcgacatgacgaggcgacatccctcacagttggcagcatgtagggaattttctgggcgttggtgttggctcatgctccactggtggataggcctccccctgctatctacagtaaaaaaaactttcactaattgaataatcaaaatttcaatatttggtccaagatatagcgaaatacccatgtatcaacttatggcatatccactcgtggatctatgaggctatggaatggtgtatataagggatcctttgtgcgataacgcatgaagcgaacgcaacctagttcaatctatatgtgattattgaattatttccattgttttgtctgtcttatttcggttttatcgtttaaattggcagagttcttatcaatcatgaaaattatctttatctgttgaacgcacaaatatttttgctagtccttaaaaaggtacaagggtatcatattttctattgcctttgtacttccagatactaagtatctcaaaaaaaatatatcttgatgtaccaaaatttgtttttagtgtattccaagtttccgcatcctaaagcaaaaccatacattatacatggaactccagaaccaccactaaagtatataaaaaaagtcgcatatata

SEQ ID NO: 51968 - DNA, 1501 bp, Oryza sativa
tgcccaaattagcagcgagcagagccaatgaaaatctgtaaatcccccacagtaataaaggaaatggaaatccccaaatcagctgcagcgagaggctctggcgccgtcctcgtcatctccacactactcgagtagtccatctgcacatgaacagcttggtggataggcagatcggacggtcgaacacaggtgatgaatgaacagtgtaacagttttactaatttgttgacaattagtaaaaatgtattcgattttcaacttttttgggttcaaatttcctgaaaacttggaatttcagtctaccgattctttttggactctgacatcttcatccttcctcagaagttagcaacaggcatgggattgcaacagtaattagtatagcttccttcactgttcttcgataaaaaaaaagaaaaaaggaaaaaggagtcgaggacgagcagagagcacagcatcagttttatttcatgactacacaacgaccggtctctggtttgcctaaagcagcgatcactccatcctagatttaaatcttattttagcttaaaaagtactatagtgcatgtttttttacctctttaatcacttgtatcttttaaatcatatattatttttaagatctatttgtatcattgtactccacttaaaatatgtgataaaacgagatccagattgaatatattaaaatattttattaatttaaaagtaatttatttaaattgtaaaagtaacttagctatgtaatagaagtaactctatatagaagtaattacattatgagtgagttccaataagaaactatgtggagtaaattcaaaagtgtagagaagattttcatgtaaatacatttatgaaagtaaatttaataaagcctgaaagtaatttacaaaaatcataaaagtaacttagtataaaatgaaagtaagttgttatgatattagaagtaaattcgtcgtaggaataaaaatataagtctatttagaaattaaatttaatcaacacaaattatgaaactgagtaaaaacaataataataaaagtaatcaactcaaagcattatgaaattatgagaagtaatttaatcaaatctaaaagtaatttgtatataagataaaagtaacttacatatattataaaagtaatttataacataaatgttttttttatcataatattatcatgtaagatcttgttataaagatttaattgcaacgaacacaatggtgtaatcggattatagatcggataagtaatttaagtgaaaattttataagaagaaaaaatatgcacaacctaatagaaaaactgcttacatgcatgtctgtaatgctactaatacttctcacgtaattgtccacgtcgctcgttaagtctaaatcgagatgcctctcgaaatagattttgcgtttattaagatactccctctgtttcacaatgtatgtcattctacatcaatatgaatgtgggaaatactagaatgatttacattgtgaaacgga

SEQ ID NO: 51969 - DNA, 1501 bp, Oryza sativa
tgttgagccctttgaaaatgggcttccaaacctatttgtgtttgttcatttatgtatttttaatttttatttgtcaaataatattagctgttggatatagatctgttggttaaaaaaattgacaagatcggaggtccaaaaatctgtcgacagtgcactagacagtcccgattatttttccaacttaaacaaatgagtagatcaaagcagtaagaacaatattaaccggcagtatgtatatgagcgtcgcagtgaattgattttgtctctcaaaacaaacagcaataacagatagtagttttaaagcactgatacatatcaacgatctgcaactccacccgtgtggcaatacacacgattagagaagatggaaccaaacctgactccaagcaacactccctggagaagtatcctggacgtgtgctccctccacacctcacggcggcagcggcaaatcaacaagatgggatcgccatcctccagttcgacaggaataaaccctagacgacttcaccaaaagcaaaaactaactctcattacaggcaggggccaggggcggatgtactgttggggctggagccccagcttcacccgacagcaccccccccccccctcccctccctcgcaagctgggcctggcccattgggttggcgaccgagaaagcaagccgtcacagcgccacgcagaaggaggcgcgatacagaaggagtcgaggcgtcactgcgtcaggcgacagcgccggcggcagcaacgatcgcgccaccgcggaggtcctgcaggacggatcacgggacgacgagtcgacgagttgcttgcagttgcagcctacaacgatctcatcatctgctgcccggctggccagcacaacgccacaaccagccacaaccagtacaggtaaatcaatctatttgctctctactctaacactagtctcttcagtttcagtttattttatcatcactgcagtaaatttcagtaaatcaattatttattttaagcacacataggacagttaatttgcaaggatggagaatcaaacattgcataatttttacccacgaaggaatctaacaaatgagaacaacatgccgaggcatgttttagatcctagtgaaattgttgccgatccagcgtgtcgcaaacaaattgaagattatcctaaggagattatagatcaagtgaggagggcatatatgttgaagggtccaactcagccatcaggacaacatgctgaggcatgttttagtatgttttcattgcattgtgggttgtacataggatattagaagcaccccctctattttcatcctagattcgccactgaagcggtgtcggcaaaacctatagcaaaactgtttatccatatgttataacattatgatctaaacataattaacatactatgacaccaatatacacgttatgacaccaacgaatcgattttctggatccgccactgattacaggccacgttgggcttttatattgcacgcaggcaat

SEQ ID NO: 51970 - DNA, 265 bp, Oryza sativa
ccccttgctctcctacccgaaaaatgaacagtatactgggttgggatggaaagtggttggtaggttgggggtataaataggccgcaactcacctcaaacgagttagggctagagcccgtttgagatgagtgaaggccatctctgacgggctatatctttatggcccatcacaggtacgtgtttacctttgacgggctggaactagcatccgatagaggtatcactttaacgggtgtcagattcagcccgcataggtgaccaccta

SEQ ID NO: 51971 - DNA, 1501 bp, Oryza sativa
  unsure (1)..(1501): unsure at all n locations
aatttaataattatttactttcatatcttgaggattttactctaacagaatctggaagattatgctgagatatagtttaattgcacgtcagagcatgcacgtatatcttatccttaggtgatgtgttattaaagccacttcggatgtggcagattttcctaattaaaatatactttctatagcacagctaaatattttaagtgtcctatgctacttaaattgtactttcaatgcacagctaagaatagcaagtgtattatcccaacatctattatgatgtcaatttcatcgcacttccaaacatggattttcgaaacatttgatgctaaatcgcttagttccatggcattctttcttaaatatacttcattcgaaatattggtttgaaccctttctttctctcatttttgtcaatttaatttcatgatattttctcaacaataacatgccacttgctctctttagttgaaacccatggagaaggaggtgattgtacaccgtgttagttttgtgttcagccggggtttatgcaaatggacacatcaatgctttgttctttgtctagctagatgttgaggtacatttgtgatatgtttgccaactaatatcagttttgaaatcttttggtctctccttctgtcgcaacttgatattggcgaagaaacattagaaaaaaaatatttatatagggaaatattgatctaaccatattaaacattgatcaaacctttagattgttcgcttcaatcggtcatagagcaattttttaaattttaaagtttagtattaatgtattatcaatgaatgtgacaaaaagatttgggtatattgttctcatagagaatagcttgcactaaacagttattagtgtaggcggttccttgcgacaaccacttcattaaactactgagagaattggttctatgcccaccggagtttactgtagttcaaggatttgcccttaacacaattgcgtttatctattttttctgccccccaaaaaaattttaattgggggggccctttaaaagttttgggngggggccaagatactttaaaaaaaatacccaaaatgccattcaagacttacaagaggttacaattaaagttacgaaaaaaattaaattattttacgtagcctccttacataatatagaagtatgtttatatttcaagatttttattttgcatgtgttaacttttaaagaaaatataaattatgttttataggctaatataatgctcttgtgttaatgttcttctatatacatcattattgatatgctatacaatttagttgttgtccttggaagaatcctgttcttaaattatacacacatgttctctgtggatacgataccctagaatactcttaggtaaagactataatggtatctgtatacttgcagattattctatggtcgtaataaaaccgagcaccattatgtaataaaatccaacaacactacgcttggagcgagggggtcgtcgtgaatgagga

SEQ ID NO: 51972 - DNA, 1501 bp, Oryza sativa
tgcactttgggttttgttttgatgtaagtttagctgcagctacttccttgtactcgcgtgtgtcggctagaccacccggatacttgtattcagaaccccattttggtttgtttaagtttcatcatttgacaagtgtcgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcaagtggtatcagagctcaagttgctcggtgagagattttatcacttctttgtttttacctacagcccaaaagaaaaaccactaaaataggtcagacccgaaatcaccaaaacatgttgagcctttgctgttctacttagtctttgcttgctgagttttcgattgcatcgattggttgagttgctggttctagtagtttagtcctttagagtttcgagttctgctcgcgatttcgtcaccgcaaacacttccaccatcacttcatttatcttcatcccgctgccaccatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgtttcgatttgttggctgaagcttgtgaaatttcgaaaatgtttgagaaaaggttattttgctaaggcttgttttgacttgttggctgaagctttgagcttgctgtacaaaaaaaaaagaaagaaaacaaaaaaaaagaaagaaaaaaaatcagaagtgaagagaaggaaaaaaaaaggaagggaagagaggaagttgttgttgttgctgttttgtttgtgttattttcgtgctattttgagtggctacgcttgtgactaggctcgcgtctctaaagggttttgcctaggaccagcacaataccatcgttgaatgattattcaacttgctttgattaatgtggttctagctgtaccttgatattacttgcagccacctatagctccacaaatttttatctactatatcacaggatcgtgcttgttgtcggctccggtactactaaccgttgttgctgttcttgctgtttgccaacgccttttacataacaaagtaagaacatgtaagaactcgtttgcacaagtttggtagaagtggagatggacaacacctagctccaatagttgataggacatatttcttgtgaattgtttcttcccattaacca

SEQ ID NO: 51973 - DNA, 1501 bp, Oryza sativa
gccgtcggccgcgtgtcgtcgccgctagccttggccgtccggccggctttgatgccgagccgagcccggcggccacctctatcgccaccgcccgatcggctcggggccgatctgggccgtcagtcccgtggaccggcggtggatcacccgcgtggtcccggtccacggtggaccgacagccttgggccgctgacccgggggccccacttgccggcgcccctctcccccctttgagccgctgaccagtgggccccgcccgtcggcgccacccccccttgatgacgtcagccctagaaattattgcgcaataaattatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtattatagcctgtttgcattgtttgctttgtatgtcgcttagattccggttcttccgacgctccggtgtacttcgaaatagtcgccgaggttcctccagcagcagagcaaggcaagtcatgcttgtcacttgaacatgttgatcctatattgcaaatgctctactttttttcttcaaatactgcatcgttttataatgttattatgggatgtttacctattgttacagctatgctattttggtaccttgctcctttgttagcttgggttataacatgaatagacgttggactaggagttgcttagccatgcttagttcaactagtacacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttggttagagggggttatgcgaagggtcctgtcacggcctcttttcggtatgtcgtggtggcatgtcggcgcacggaaacgtgtcgtggggctgtgtcttgtgggtacagttgtacacctctgatcagagtaaaactattcgaatagccatgcccacggttatgggtggtcaaccagattcaccgtgattagtctcaccctagtttagtctattgaaattggatagtataggtggatggttgggcctgtcgcaccatggtatagcgttggacagtggatgattaatattgattaattattacgactgttttcttctttaaac

SEQ ID NO: 51974 - DNA, 1501 bp, Oryza sativa
ggctcggctcccctcgcgccgctccccatttccaaaccctaggcggcggcgcggcgaggcggcaaccggcagcgggagctggaccgtgctatcgcggagggggaggccattgccgtggcgagcggtggccgacgcccgccactccgccaatctcgggcggtcaggccggttgggtggccggtggccacgaggggcagggccagcgcctcagcgcttagacgggaatacccaactttgaaatcctggctccgctactgaaaggaggaagatgcacatgtttttttaatttgatgttgttgccccgattaatcaaaaagaaactgaaatagcaatcccacaccatttgctagacccatgcaaacagatggacttgctttctatgcataagaatgttgtggagaacaaaaatgtctgcatactgaatctataactattatttttacttttatatgtagatagtacttaccttggaggtaaaccaaagaagttcaattctataggtagaaagcactggcaacatagctgaataaattttaagaccgcatatatgtgaaccataaaagtaagcacaaaatagaaggacatctgagcaagcattttttcctgtcaatccaatctaagtgctgttttggcacaacatatctaccagaagtgtttcttcagtggaataaacctatttatcaattcataagagcacagctgaatgtagcacctgtactatagcatcagaaagttgaaagcatgaggctacgagactgtatggatagaagtaaaataaagtaaaactaaaagttatagttagatcaaactaccttcgtcaaccaaaacaaagccacgagtcttgcactgcaaactcaccagccaatcaatacttgcagatcacatttagcagagattaagtgatagaaaataaacacaaattaaatcactgtgaaaaataaaggcataaaggatggcacaaactcaacctgaaccctaggagcaactacgacggtgcgaaatcaggcaacggcgtggcagccgaggtagacatctaacgtggggaaagtttataggacaaaacaatagggtttattaagcgaatggcaacacgggtgaataaatttgagcgctgcatagatggaaactatggaagtaagctcaaacataaaaatatatctgaccaagtaacttctttgttgccaagtcagtctaagtgctattttggtaggtttctatgaaaagggccaaaatatggtctaacattgttaatgttatgataggacactctgcatagatatcgattgaagaacacatctcaacaacatatggatttagaatataagaacacgtgaatataactctgatggggtgacatacatataaatggtaggcaattgctattatatggactgatagagaggattttgacattggactcataaatcccttccataggaatgtgccatcgccgcccatatatactctttgcttgtctgatgcacactgcagacatttttat

SEQ ID NO: 51975 - DNA, 1501 bp, Oryza sativa
gaaattgattgtaagtttttttctcatagttttgctttctagtactttaaaatagctaagaacacattataaagattttacttataattttttactaataaaccgtatgacttgtaattaacattaggacaaccgatggcaccataagtattatagtcactcactcatacatcatgtctctgcaattttataccctctttaatcgagtacacttatttacgaagatgtaacgtgtaaattaactctaccacgttaatcccatctcgaaggctctacgactcttcgagcatcattactatctatttcataaattattacctcttgattacatcatggatcttaagtctcactttgtctcattaattagcataaaatcctatgacaaagagaaatgtgccagtgataatatcggaaggacgatgaggttccacgttggaagacctaaattcctaaaatgcatgtttgctgaaataaatatttgtatccttagtttcaaaccatggatgtataagctgacgccgtcaaatatgcaaataaatactattccctctgttcagactataagtcgttttaattttgattaaagtaaaactgttttaaatttgatcaagtttttagaaaaagtagcacttcccccgtttcgtattataagactttctagcattgtctatattcatatagatgttaataaatatatatacagactactatatatatatatttattaacatctatatgaatgtggatgtacagactactatatatatatttattaacatctatatgaatgtggacaatgctagaaagtcttataatatgaaatggagggagtaatatttttaacctaagactaatatattatgaaaatatatttaattatagatgtagttacctaatttggtcttgtaaatattattattatattatatttatatacaaacttagttaaatttgaaagagtttgactttaaccaaagtcaaaatgacttataatctgaaacggatagaacagttattttgattcattggtcgttttaggcacaaaattatacacctgtatttccattgccaggagtcccacactcccacttcccaagtgctgccgatgagacccgattcatcagaaagtagaaattcggtacttccgatttggtacacgtagcaagttaacacacccaacgcggcacgacgacgcttccacgcaacaaggcccctcctcgcccacgcgtgcgcccctcgcccaccactcggactcggaccgcattattattacttcatttattaatatcatccaccaaaatcaactgccgccgaaacctcccacccaaaaaaaaaaaaaaaacgagagagagagagaaaaaaaaggcgaataattccgctgttgcttcgctgccttttgccttcttcctcctcttttccaccaccaccgccaccggccgacgcattttcgattcgatttcgccttcccacgaatctatctccccccgagtccccagcgaga

SEQ ID NO: 51976 - DNA, 1501 bp, Oryza sativa
taattactagtatataattaatcaatctccttttattacatatatgtatcccataatcattgcaataaatatatacgtgccgcgtaccattctcttcttcatccttaatatataagtatatttctagatacttaaaaaaagtatttctaactagctagcagctgagtgatgtttatacacaatgcaacaagataatattatatactccctatgtattttaatgtatgacgctgttgaatttttaaacaacgtttaaccatttgtcttattccaaatttttgtacaaatataaaaatatttatgtcatgcttaaagagcatttaatgataaatcaggttataataaaataaatgataattacataatttttaaataaaataaataattaaacgataaaaaaagtcaatgatgtcatacattaaagaaagaaagtatgttttaggacagaggacgtacgcaccctgtatatattacggcgtgggtgaagtaggtggttccaccaaccgtggaaaacttgtcgtatttagcaccaatggcgtgctttttgctggtctggacgaaagaacactcaaggttgaagcactttaatttcacgccaccatcgttctgcatatatagtatatcccatgcatcaattacaccagtgagtagctatagagcactgtagactgtgctgtacataccagctgacatcaccaactttaactagcatgcacctaattaatttgtgtcatcttcttaaagaaaaaaaaatgagttttaagaaaattagctagctgttttaaatctagctagtgctctatctaactatcttaccactatatatgcaggtaagaggagtagaggactcctactgatcctgaaagttgattatccatcatgtgcaatattgaataaaagaattatgtgatccttctattaatacatcacaggaaagtagtagtagtagtagtagtagtagtaataataataataataataataataataataataataataataataataataataataataataataataataattatcgtactaagaattaggagattcataggggcctacatgtcaagaaacaactgaatatttatttttggtatttaattcaaacattcaattttctgtgaaatatattcaaattaaataaaagtgaccaaataatttttgtacttctaatgaaaacagtatgtatgcaattcgttacaaggtactccctctgtttcacaatgtaagttattctaacatttcccacattcatattgatgttaatgaatctagattcatcaacatcaatataatctagattcattaacatcaatatgaatgtggaaaatgctagaatgacttatattgtggaacggaggaagtaggagagacactttacagtggagtatatgtagagccgaggaagatcgtcaccaacaaattgagggtaaacctgcatacaaattaatgtaacatacgttggtatatacgtgacacatatggtata

SEQ ID NO: 51977 - DNA, 1501 bp, Oryza sativa
cattattttaaatcaattgagacattattttaggtcgttagatctatttttttttaaaaaaaaaatcctaaacctccttccctcacttcctcctccgtgcagcatgcggttttaaaagttcattatacattctataaacgctatgttacgttgttctcttaaatcagacgaaatcctaaaaatgatgataggaaaacaaaacatattatcattggttttaacttaaacatccaacccattattttaggtcattagattaatcattcagaaaaacatcccaaacctccctccctccctgattgcccgtgtgcagcgtgcacagttccttttctctttcttttttttatctccctgacaattaaaattaaaattaaggtagatccaaacaacaggctaatctagcacacagtgtttcttttttgttttctaagagaagtctagcagtactatttgatggcatcagagatctgtgattcttcaatcaaactctcagagcaagtacattcttatgtttcaaggctgagagaccccaagttggtagctttagcttttaggccctgttctttcatgattctggattctaggtttttgtttgcatgcttccaagctcttagatggtttgtttcgtgcaaaatttttataatataatttttattgtaatacttttctaaagcatcttttcaactttgttgtagttaatttattcgtttatcccttaaatagatatcataaaaaaaatagattatccatcaatccaacgtgtttagctatctcaatcatggccttagcgctagctaacagtgcggctacaagaattcatatatagtcgagcaaatttgcaacctaggaagagtttgtaccagtacatgcatttctgatttctgtatatactataaaaatacccgtgcgttgcaacgaaaaactaaaattataacaaatataaaaatattagatgattaaggtttagttttacatattgaaataaaaaaagttcaactgaagggacctaaagtgaacttattccgtgcggagtgtacatgcggtccatgaggtggcccaatagtgcgggcggcctgggaacaattcggggacaacttgagcgacataaagtaaacttatttgtgcggagcgtacatgtggcccaatagtgtgggcggcctgggaacggcgcccggcccgacgcgggagaagccgtagccatccgatctgatggacggtcctgattgatcccgatctatacaaatactcagcagcccaaaccctaaccctaaaaccatttcctcttccccatctctctctcactcaaaacaacgtcggcggcagagcctcttcccaacctttctcccaccagcgccggcgttcccccttccccttccttcaccggtgaccggcgccaccgttccatcttcccctctttctcctgtctcaccggcacggcgcggcgactgggaggggacccaccagcagcgccgtttcccttggccactccccccttccttca

SEQ ID NO: 51978 - DNA, 1501 bp, Oryza sativa
acattagttaaactggtctttagcaatgtatgaatctatctaaaggctacataattcagttttttgtatggagggagttttagaatccatttcagtgtgataattctctcttgtacctttcttttatgcatatattcagattatttgtaatatgatgtttactaccgtgaatattgagtattggactcaatgttcaatggaaacccatttttcatgttatatattcactcgcgcgtagaaaagccacgcgtgttttctagtaatatcctagttagatatatgacattgaaatgttctcgacaaaaaaaatttgctacttacaatatttgcctttataaaatatcatattgatatatgccactccagtatatgtatatatgtattgtttatttttgaaataggaaaatgtctgatttacttccaaaactatatttatgttcatctaatttattccctcaaaccacaaatataatatagaccacaccctaagttgttgaaacagaataaattgttccaccagttaagtagaaacaaaatttgtggttttatgtgccatcatatatggtggtggcttgcacataaagtagggaggcccacctatcagacctacctcttttttcttcatctgtttctttctgggaacgtatcctctttctgtctagcttccccttacttcctagatgcctatgctttgttctccatcccctcacttctcaatgttctcccctccaagctttgacttttctgtaccttctgtttagtgtagagtcccacattagtgtagaaaccatggatttgcacatgtaggaccaaattcatcttgatcaatggggtaatttgtctcatttaaaaagctcagagtgtgttttatgtactaatatagtttagtggtataaatcatatgtacagtcattcataggtaaatcataatatttttctttcagttaccactgtgaatttcatgaccacgatgaccccactagtcgatatcctctgctattgtgtcgtcatatagcaccaacagattgatgatgaatgaaaaggttcagtgagcggtgtgctagcaagcataccactggtgatggtgcaggttgagttacacatccaaatctatcaatccatttggtaacttccaccacgccctacaagagatccaattggcactatatttcttcttgatctccattacatcctatcacttgctttgattctagggacaactttaaaggggtgaagagaatacggagggtatatgcgctgcatgttagaatttagaatcattcaccatacagattttcatcaatttttttatggagatttagcaatagagacttgacctttcaacattgaattgcttattttccttttgatcagtgtcattgtatcgttttttcgttcacctttgttctattctgtagcacttagattttgagctcagaactttataataagtggtcgtacgtaccttactacgaagcaaaaatcgagtttttatatgccc

SEQ ID NO: 51979 - DNA, 407 bp, Oryza sativa
taattttgtacccccctgtagcacggactccaagacataatgtgtgtatgacatgtgaggccagatattaataatatagtaagcaactattgtataaattggctataaatgatttggagctagcagttggttgtactattaaccttgctctaagggattttgatattttgcttgcactgtttgaccactcgtcttattaaaaaattgtgcaaatataaaaaataaaaagttatacttaaagtactttggataataaaataagtcacaaataaaataaataataattctaaaattctttgaataagatgaacagtcaaatagtgtaagcaaaatatcacaatagggacggagggagtattcttctgcactctggtctgcatgtcgcccaaaaatgcttagatggagaa

SEQ ID NO: 51980 - DNA, 1501 bp, Oryza sativa
aagcaaacaatgcaaacaggctataatactactgaaacagagaacaaaaccatttttaatggattctacacatttttcttgatttactgagacttgaatgggcttaaacggagctcggatgaattagttatgaattttagaagattcactgtgtttattactataacaaaaagtccttaaataatttattgcgcaataatttctagggctgacgtcatcaagggggggtggcgccgacgggcggggcccactggtcagcggctcaaaggggggagaggggcgccggcaagtggggcccccgggtcagcggcccaaggctgtcggtccaccgtggaccgggaccacgcgggtgatccaccgccggtccacgggactgacggcccagatcggccccgagccgatcgggcggtggcgatagaggtggccgccgggctcggctcggcatcaaagccggccggacggccaaggctagcggcgacgacacgcggccgacggcgacggcgaccggcggcacgggaggcggcggcggcggccgaaggcgacggcgcatgacttgaagcggcggcgcggcactaggagggagagggaggggagtaaaggggagaggacgcctcaccgagggtggtcggtgcggaggaagacgacggcgaacggcgacggcgagccacgggaggacgacggcaactggcggacgggcttcggggtgccctaaggaaggaggagagagagattagagagagggagatgaaccacggcggccggcatccatggccgaaggcggcggtagaggtagaactcaccggagcgcgaggggatgcgaattccggcgacgaatcccgacggggaaggggcggaccccttctagaagtaatctagaagtaagtaataatactactatactccctccattagaaaaaaaaaactcaatccgaccccttctaggatcatgaatttggataaaggtagtccagatttattgtattaggaaagatcaaatcttcttctaggttgatttttcttttttacgaaaggagtatagcactagtgattacattagtttaatcgtcaaattaaacatatggtgatggatttagtatgatgtgtgcgcagattgcagcggcatatggagtgaatgggccatatcacggtgcatcggcgtggcttcctatatggaaagttggggtgggaccctctaaattctccaagagctacctcgccatcgccagtccaacagtcagggaatttacgccaatcccaagcaaagatccacccaacattgacaaccaaattgctctcgaaatcgccgtacatgccagttaccatttctatatatttatttttgtactccctccgtccgaaaaaaaacccaatccgtatgtccagattcaaacccaggattgggttttttttgggacggagggagtatgtgtatgttaccggccagttatcacttttatatgtatgtataccatatgtgtcacgtatataccaacgtatgtta

SEQ ID NO: 51981 - DNA, 262 bp, Oryza sativa
attaggcacgttttcccttagtttatcgactgttagtttttgtctgttagtttgtgtgtttaggtttgttcgcttgtgggtcagtcgacggtcgatatcatgtgcctatgatatggctatcctaataagtattttgcttgctgttttaagtgttttaattctgatcagaacaattgcagtttaaattcctataaaataaagcttagttcctgagcatctgtttttcttcttttccaccccctccgtctgctcttccttcaga

SEQ ID NO: 51982 - DNA, 1501 bp, Oryza sativa
catcatgatgctagcctttacccgggtaatagcgggcttcgggtaaagactagcatcggccttcacatcgccagtcgtgccatgacgtcggtggtggttggaggatgagtaatgcgcttttatggcgccccatactcgttcctggtgtcttccctaggctctggcctcggagccatgtcaagagctctggagcccttgagctggctcatgggcctctggggcccccgaaccggcgccggggcctccggtggcccatggctgggctccgggatcctccgggccttccggttagcttcaaacttcccggagccaactgccctcttcgggctcggccggcttcctaggccatcggaatgggtcctccctacggagacgggctccgcagggtgctggcggcgggcctccgggcggaggccctatctcctccggagccaccagggagtgaatggcgcaagatcgcaatccttcccccaacaataaaaacacttatcatttcttaagtggaatttttttaagaacaggagctgtgcatagtgcaagacctgtcaagctaactggaatatagaagagacgacagcagccaacagaggtcagaagctattgcacccaattatcatcatcctcaaatcaattgaaaacttgctgaatgaaaggtgctgttgataaggagtgcaacaatttcttccatacataaatctctatttagctgtgttgtctataaatttgttgaccaatgaataatattttagtaatagttataatgcagttgtttggaatatgatactatgattcttcagaagtgaatcacttttctagcatccatatttctacatgcatccttaccaagagtcacctggactttggacttactttccataacttgcatcacactaagttacagtgtttgttccaagctataatataatcgtagtattgtttgtccccgtatggacggacctggacctggacctgaagcatccacagaagcatagcccaagatgagagatgattgggatagttctctggacagtgatgtggcatcagaagttcagaactctcaagttcatgtccctgttcaacagcgacttccctgactttgatccatctatttccttgaccattccagcaagtcaaatgaagagataagagtcatcctgaagaaacgtcattcggctgtaactatatgcatgagggacctaccgattgatcaattgtttcaagcactgccgaatgtttcttgggcaaatactacggacacttgttttggcaatatattcaaggcaaatgtcatttctcatagaaaagtccaattagaagtgctcctctgcagcataacaatttttaaaaattcaaaatcggcagataagtattccaaaatgtcacaccagttgcactgtgaaattatgactaaagaccagttctttatcatgcaacaaactagtagtcaggctatgctcatccaaactctaaagctcagaccatctctccaagactgcaacaa

SEQ ID NO: 51983 - DNA, 1501 bp, Oryza sativa
accatggccgttccgaggtagggctttggatttcattggtcagatttatccttcgttatcaaaagggcattggttcgtgctagttgcaatggatttcactaagtgggccgaagccgtgccgcttgagaatattacttatacgaagttgaggtaaatcttgactctcttcggtatttcaagcaagatgacttgtcggttgaagattacaagaccttgatgggaagcaattttgaagacgtcatcgacaagcgtttgaagactttgaaggagatgaagacacttcaagacggtgttttcatagagcaattaatgggaaatacttgaagaaatacttcccgagcatttggcaagatgcttaggaagtactatggccggtaattggattatcgccctaagacaatatgttctatgcttttagattcacgatgttcataaaaaatgcaggggggcatgtgtttacacccaaatttggcacctatagacgaaatagaggaaaatttaaagtttggaaagtgccgggtttccttcatagggccggttagaccgcaggtatatgggcagtctgaccggctagtagggccagtctgaccgcaggtatgtgggcggtcagaccggtagggtccaagtccgagtctgttttcgtcaggtctcgggtttccttgctcgggaaggcatgtttcgtgtttcctttattttctatcccgagttggacgtggagaagggacaagaccggttcatcgtaaaacacccgaatacaatctacttgaatcgttcttttactatgttttttattttaccctaattttagtccatctttgtcggtttgcgccgtaaaccgtccgtcgccgctgcgagagtgcgacacctctttgtaggtttgtcctgaaaaccttccgttttgcccacgagacgggtagttatcctcatatcgatctaaatcggcataaaggctgattttgatctctaaatcggctccgctagccggtttagcttttctttttgcaaaacccatagctccgctagccggtttagcttttctttttgcaaaacccatattgatttggccctttggttagatcgaggtggttggcgactccatatcaccgcaaggcgtttaggtgttgcgatcgtgcttgtcgacttgttagaaaaattaccaacaggtaatgctagaaatttttacattgtgaaacggaagaattacaaaattccaataccagtcgcgattgcctcctaataccatttgcaggatctggtccccattgtctcaggaaaaacatgttgtcgtcgtctgtcagggcgagtcaaacttattaggcgccttggtcacggttcctgcaatttgcctgtcggataaaacatttgttaattactagtatacttgtctaattaactcaacacatcaacagtgagtagattagatcaaagctaatcacttcctcgccacctaccaattaccattaccggcacgacttgacagccatgagcactagttgtagca

SEQ ID NO: 51984 - DNA, 1501 bp, Oryza sativa
ttatcctgtttgttaatctgcaaatcatgattctttatgctttgggtattgccaattcataagcttatccttgatattatattgctgttttgttactatatgcttaacgcatttcacttctatcaattggtctatttatatcagggcactgttttttgcttttggcaaaaattgcatgcttgacatgagatgaaaaatggtttctattctttatgtgtgtgaaaatatgatcacctgctgaaaaccttataagggttatcttctaaccatgccatattaaaactatgcgttccttttgatttatttagatccatgcattgtagtttctcaaagcaagattaattagcaacatgctaacgttaatgcaatgctatatttatttagggtcaacgtggatgctgctggcttgcatgaacaagacgaattaccgcattggatgtcacaattgtgagtatttgtttttgcgttcatgtatttcttcatattttgactcgtgcaccatgcattaatcttcatatgaagataattggcattaatttaatgcatgccatgtttagtctaagaaaatagtgcatgttgttaataaaatgtcatataaccgcaagattttgttgtcattacaatcatctctaaattaatagggacaattttttttaatatgattactaattggattgtaatgtgttgtttaggtttgagaaattggatttggaggtggatgaggatgtggtggatgaggacatttgttctattgggaatatgactcatgaagaggaagaagcagatctggagaggggtattcattctattttgaagaatcatcctatcatgaagaaattaaataaaggaatacatccagttgttcttgcccttcatgtactactggaggaggaggaggaggaggaggttgtccaggaagaggacatggctaagggtttagctgagctagatgaatatttatcacgtcacacataccataccatagaggaaggtatggctggaattgcaagtgggttccaaaacccaccaccatgtcctcattttcacaatcatacatgtgagaaagttctgcagcaagcttctatatgccagagagaagaccctcggtaacagcggcggagccgccgcccggctagcatgggcagctgcccgagctccgccgcatgaatcaacagtgaaagagcacttgttacttgttaccatcacttcgcctcattcagtgcaccatactgcagtgactagtacttagttacagggttcagtcgtacatgcagttgagtagtagtagctaattactttcttaattaatttactagttgatcatctgttttttcaattttaagataatacaagactatataatatatattaaatggtttatgtacttatatagatttaagtacaccttctacccatcgctaggcttgcccgggcttagaaaaattcgtagatccgccactgctcggtaacattctaaccttttcttgatgtgacccctcgg

SEQ ID NO: 51985 - DNA, 560 bp, Oryza sativa
gatagggcgaattttgtactgtgcggggggccgcctgcaaatgggcggcgagggggcatggaattttgcagcgggcccccttgccgccctgggggagggcgatttttgcctccccctataaagcccagtctcccctctctgaaatttcattatattcactaaaaatccaaaaaaaacgaaagagagagagaggagagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataattgtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 51986 - DNA, 1501 bp, Oryza sativa
gtttgcatccgatcggaacccaactaaaattaactgacctaatagctgtagtaacttgtgttgcatattaactgcttcgtacgtatatcccagtaacaactgctttatcgaagttgataaagatatactactaatataattaccaggcttaattttcttctatacatgatccgaaccaaactacaatacggatagggcatatagccgggcgtacgtacgtcaaacgtgtggttaattacctctcctataatctatttaaccaacgttaaccctgcatcgagttcttcgtccccgattgatctcgccgtcgaccaccaccaccaccactgttggaaataatacatacttagccattaattttattccaagcattattatttgaaagcacatacagcaagcataacctacttgcgacatgataggacaagaaaaactcataaattctatcatgctagatatcaaacaaggcataaataaccaagctaagtaggtcattaagctaatcacaatggtaatctagccacaatattttaatctagatgaacagtaccatgcatatataaaactcaggtacgatcaaaactagattcctttcctttgtaaacgaaagaattcactcactgaatggatcgacggagatcagcgagtcgaagcagtgcagtcaatcgatgatgtcgagcggccgcgtagaaatacgttgcccagaaacctttacaccgcccccgtgcaggtgcgaatgcggcgaaggctcggagacaccgctcaccgggatgctcattgcacgacgagcacaacggccggcttggaccgacggcgacgcaacacggcggcagtagaggaatttcagagtagatggctattgtgttctgtatccttcaaggacgtctccttgactcctatatagagctaacactgaacagcagcccacgctcaatccgttgctcctccgcgtcaaagccggatcggctccgtgagaaacgcagccgccaaacggccacaagcacacgttctctcttcacgtgagaactaagtcttcaggtgattgactcgatcagcagatgttgttgtatgcaagcatcttttcatccaacacatgctgatcgtgcggctaagcattaggcatttaaattgatgaaatgatcaatgtctccaagcatgttatttccatcacaccaccaggtagctgctagttagcttgccatgtcgtcgtcaccgacaaaggacgtcgtcaccgcgtcgacggccacctctacttcggcggccacctccggttgcaactttctcaagatcaaaatacgcaacgcgatcaagaaatctcaccaaggcagcaaatacgacatcgagtcgtccaagttccaggccgcaggtcacacctggagcttcttcttccaccccaactcgagcaaataaatattcgggcaacggctactccaccgtgtgcctcaagctccacgccgccgaccccggcaccgccaccgccgccggcggcggcatccgaacc

SEQ ID NO: 51987 - DNA, 1402 bp, Oryza sativa
tttaagaatttgtgatttattgcatgatcctgtgatgtatttgatttgtgtgtgatgtgaacttgtgatgtatttgcgatgaattttgtagaacttgtgatgtaatttgatttgtgtaattttttttaggatttgtgatgtatttgatttatgtgtataagtaacttaaagatttgtgatgtggatttgggatgttactttgatttgggatttggggatatgcatcccacttgattcgggagaaaataaaaaagaaaaaagaggaccatctgtactgctgttattccctctttagtcccggttggttgttaccaaccgggactaaagataaagtatctttagtcccggttggtgttaccaaccgggactagagatcgatttttactcccggctgtttcacccgggactaaagatagcgatctttagtcccggattcgtagtcccggttgaaaaaccgggactaaaggggggttacgaaccgggagtaaaaaccacttctccaccagtgtctggttgccgattcactgtgagcgacatatcttgaggctgatggtcaaattagggggtcgttcgacttgagaccgatggtttatccgttctgcggtatgtagacaatataagattatatttttatccaagaattgtcccacgtatactatttttgtagaactttttttttctcgttctaaccatcaatatatatatatattctctcctcctcgttttctccctgaacttattttctctgcatattaatgaaagcatagcaatcttttaatctcttgattaataatgtttttatcttttaatcccttgattaatatatctttgattagctaaaacaataatcttttagtgaacatggcgaagtgtacatgtaagtaagtaagatgagtccaactatgtgaatacgagcaaccaaataatatattgtggttttatgctcaacccacgcgaggctacacgcacgtgtgcatattcagttgatcgtgtgctaggggtggtaaagagcctaaatttttaggctacaaaattgagttatttcaaaaataaagtgggctttttttttattcattttaacctaaacttatattacctccggtttaaatatatgacgccgttgtatttttataaatgtttgcccattcatcctttttaaaaatatttgtacaaataaaaaatatttaaatcgtgcttaaagaactttcgatgataaatcaaatcacagtaaaataaataataatcacataattttttaaataagataaataaccaaagatatataaaaaatcaacggcatcgtatattaaaaaataagaacgcaatataaggctaaaataggattacgaaaaaagctatccacacctatcgtggcgtgggctgctctcactgggcgacgaga

SEQ ID NO: 51988 - DNA, 1501 bp, Oryza sativa
gtgtaggattagcggtgatcggtctcgcatagcggcgccggcggtcaatttggtgctagtgcttctcttggggtgtgtaaggactaaggagtcgctagcacgtggtgatttttttttctttttcctgattatagccttcgaggacggtaatcttctattctttttcctcctataccgtgtgggtcgtaaaaaagggttgctttcagctttgtcctgtttcattccaaaccttacaattttgttggagatttagacttgcatcccaagttttagaaagtcatctttcttccgagtcaaaattgctgactgatctcggaccggacaacaccacgtcttactttttaaactgacgcctacaaataatgaattaggatgcaaatcacattaggtatttgtgccttggcatccaagaattgggcggtacaaacaaaacaagtcaacacgtcaactgagtaactaaacgaaagaattttcagtagtgagttgctagaggccccttccactgatcgaatcgaatccgtccaaacacattccaaattccactttaattaaattaacattaaattaactccctataagttgaacaactaatccactttcttcagccctagattgcaaacatcagcccaagaaacgtccccagtattttcccgctcattgctaaattaagtttttggttttcagtattattacacaatgattaagttacattcaaaaccatcattttcacttttcagaagtgccttcacaaagtaatcctactttttttatttctttccaactaaagcttgtttctcttttgaatattctttcgtgatttccagtgcacacacactggaatacattttccccacacaaaccttcgcagctactgttccattattgcccataaaatttgatgatttgacactatatttgttgccattttgattatgttgatactcgtgactacggtatatgtaccatcttagtcaacaataatgtattaggatgttacaaaatttactattttataaaaccctgtctattatatattgtggcacgtaatctcaagtattatgttcactagagttttagaaaaccaaacagttagccattttgattttgatcaagcaaatgttacttccgtttttcaaaattttcatataggagtaatggagtatgtctaaaatagttaacggcgtggttttgtgaaactttataaccataatattcgaggttatgtttcacgtgctaaaattcctataatttatataacttggaccatataataagtgtgatagaatttactcttaaataatggaagcccagcatgtggagggtaaaatgaatcacacctctccgatttgaccgtcacaaactcgtcaacacaccaacttattatgctccgtataagttggacaacgaatccaccattttcagcctagcatcagcccaagaaacgtctcacagttggtgattcgatcgacatggacgagccaaccgtggaggagccactgct

SEQ ID NO: 51989 - DNA, 1501 bp, Oryza sativa
gaatccgtccaaacacattccgagttccactttaattaattaattaattaattaactccctataggttggacaaatatccactctcttcagtcttcagcctcagcttgcaaacatcagcccaaggaacatccccagtattttcccgctcattactaattaacactctgaccagtttttcggtttttagatatcacacaatgattaagttacattcaaaaccatcttggtcacttctgaagtgttctcacaaagtaatcccactgctctgtttctctcaaaataaaatttttcccctttgaatattctttcctgattttcagtaattttccatacactggatcgcgactaccttaattttccacacccaaaccctggcaccactgttccatcattgcccataaaatttgatgatttcacactatatatttgctgccattttgattatattagcactcctgaccatggtataagaaaccatattagtcaatgataatgcattatgatgttaaataaaatttactcttcaagagtataaatttcaaaaaaccgaatctatcatggtccaagctgcataaaaccataataattttgatatgtgacacaatgtcaagtattatgtttctaaagtttcacaaaaccacacagttagtcattttgataattaagtcacatacaaaaccatctttgtcacttttgaaaagcgctctcacaaagtaatcccactattctatttctctcaaactaaaacttttcccctttgaatattctttcctgatttctggtccacaaatactggactaccttttccacacacaaaccctggcagccactgttccattattgcccgtaaaatttgatgatttcacactatatttcttgccattttgattacattaacactcgtgaccatggtatatgagaccatcttagtcaacgataatgtattatgatgttaaataaaattttctcttcgagagtaaatttcataaaaccgaatctattatgatccaagctgtataaaaccacaatgattttgatatgtagcacatgataatacgtattatgtttctaaagtttcacataaatacacagttagtcatttttattttgatcaaacaaatgctacatctatttttaaaattttcatataggaatatgtctaaaatagttaacggtgtggtttactaaaattttatagtcacgtaccaaaattcgtataatttatgtaacttggactaaaaaaatcctataattaatttatgtaacttgcaccataaaataagtgtgataagatttactcttaaacaatgatggaatgcctgcatgtggagggtaaaaagaatcactcctctccgatttgaccgccacaaacgaaacatatcaaacccatgaacacactaacttatatgctcatccctataagttggacaacgattcaacgaatccaccattttcagcccaataaacgtctcacagttggtgattcgatcgacatggacg

SEQ ID NO: 51990 - DNA, 764 bp, Oryza sativa
tttgaataagacaaacggtcaaacatatttaaaaaagtcaacgacgtcaaatatttagggacgtagggagtaattaataaataatattcgatagatatcatacaattgatacgactctatatgagtaaatcagattttttttaataatgaaaatatatcacacaagcaaataaataaattagatctaaagatattctctccatcccaatttgatcatcacctaacgattttgaggtcttcctaaaataattatcatataataataagtgtctctttatttatttattatgcaaagggtaattgggcatcgctgaatggaatgcatgcatgaagccatatgcatgctacgactgttagtgcaattccatgcaacatttaaagtgtgatgcaatatccactggatatatggagcaccttgattggtgataattaatttaaaaacatgaaaattttattgtccttgtctttgcaccttttatttaggggatgatcaaattgggatgaaggatatactattaaactaataataaatagaaatattagttgtttcaacggaacatcgaaaacaaaatgcaacaattttagtttaagttatgaagttagcaagatggatcagcaggtgcctaactaatttaatcgagtaatcgatcggcagcaaaagaaattaaacaacaaattaatttagagaataatcaatatggattttctatattgtatttgtattgcatgatcgaaggaaagaattaagagatcatgatcgaaga

SEQ ID NO: 51991 - DNA, 253 bp, Oryza sativa
ggccttttttttaaaaaaaaaagaaaaaaacttgagggtggtatactggggcactggctttgttaatttatctgggcttaggccccgtgttggggagtttctgggcactgtaagttgtcctaaaatccccttaaataaattagattctcattcagatttgattttgagttatagaatttagtaaaaactaaaagaagttataaaacttaactattatcagaagctgattaccaattaattatcctctaacagg

SEQ ID NO: 51992 - DNA, 1500 bp, Oryza sativa
caaaattgctcctgtgaaatgtatgataaggcaatggttagaaaatataaagttctctgctcctgttgagtgcacttctctgattactcggatagcaaaagggctagtggtcattagcgaccaaattgcttttatctcagccgcttgtccatgtattgatgagacttatctagtgcaagggcatattctgaaacatggagaagatggatctttaatttacttttttcccggttgtataaatgaaatcccgttgccaaatgcggggtatcatttgtacaactgtcgtgaactaaccattcccctgcacaccatagaagaatctcgtgcaggtggagcatacagggagacgcgcaacatggcaagaaatgaacagggaagttcatcatcctcaacactcgtgcaaatgtatgaggcaggttgggaaccaactggggatgcacccggatggacccaagctcaacgccatagcatcggagtctcaaactgggcaagtgccagttaggaccgatggcatgcgcctaatgacatacattgggggaataaccaaccttccagatcaagtggtgtgcctccatctcgaagtgaatggcgctcgagttcctctcgttggggcttgggtgaaatcgctaggagaatggacaccctttatatgcagacgggggagatccagtacaacctcacggaacacatagcacaaacgcaagaatggcaacaatctgctgatgctcagttcgcaaacttcaacaacatgatgcagcaacagcacgatgaccttcaaatgtactaccgctttcaacggttcaatccttgtcaaggaccctgagcgaaagccaagcttggggggagagatgtctctccccccactgcggtaacttgtatcacattgcatatttcccttttcaattgcatgtttgctttccaattgcatcttataaacttgaaaacaatataaaaatttgcaaagtagaaaataccaaaaggatacgacaggtttgagtcatgctagataagacaagccagttctctttgttgaaatgatgaatagttgctctgttttatatctcttatatatgggttcatggtaagtgctctctcaaaggttaaatataagtagccaacaattatctaggaacctgaggtaaatgagctgcacttgctaatctgagtctaagttgttgcaagatatgagatagtaaataagtgttactatgatcatgatcctagtttgacttacattccgaatgttctgtttttcaaaatgataaaattgaaagttcctcatttgatataaattcctaccagagcaaaaaatgtgctatcatgattaaaccatatacattttggttacttgccattccattgaactttgtcaaactcttgtgacttgtgtagatacttctcatgctctatgatcaagatcatacacccacatatatgcacattgtcagggttacggataagttataccctctatccttggatgtacgttgtatactgata

SEQ ID NO: 51993 - DNA, 1047 bp, Oryza sativa
cctaccaatgaaatcggcagcaacttcataccccgacaacccccgttctcggaggtcgtcaacgatatcgatgaaagattggagggacggggtcaaggcaggtttggtggtccaagatggaaccttgtctggctgctcctcaggaacaacgaaggcaggatccgaatcctctacctgaagatagaaccacctcccccgccatttgctgcgagatgaggggcactgaaaggggatgtatcgtgacttcaggccatcccgaagtcggaaaccaacacacccggacacctttttggattccatccagcgtaactcatagtaaaagcggaagaggtcaagaaacggctctaccccaatgtaggcctcacaaaggtgaaaaatactcaggaaggcgatggagttggggttcaaatggagcaaggaaagaccatagaaatttaagaccaaaaggagaaattcagaaggcggaggaagaaaaccgcagagaataaagtcctcaaccgcaaccatgcgacccaggacaggctggggttcagtacctcctacttccctctccgcggtcccgcgactgggaagggcgccatcctcctgcagtttcttcagtgacacactggtggaggtagacttgtcaagatccatggccaccggagatcgccggagaaaggaccgagatgagttggctagggtttttgcgggagcgaagaagacgagggacgcttggaagctggagagttttttcaacgggcagacctcaaattggatccccaaaactcccttaaatagacgcacctccgccggtgcgaatttctgggtccgttacgcgtggcagtttttcggacttcaatttaaattcactcatgaccgttgaacttcactcgatgttgtcgatcactccttgtctctccgtcctcacaccgagaacaacgacaatttcgacatgtgaagtcgcgatcagtttcaccagttcatttaagcagaagtcggggggctactgtcagggttacgagtaaggtataccctctacccttcgatatacgtcacatatcgata

SEQ ID NO: 51994 - DNA, 1501 bp, Oryza sativa
tagtccacagtacagctgccctcaaattaaaagtttcatttctaaatgcatcatatatggaaatgccattgacaaatatgtctcttaaatcttctagaagcggctggaggaaaacatgaatgttatctccaggacttttgagcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaaccttttatcaaagttcttccatgccggagaatcagctggatgtcgaagcacaccatcctctactaagcgctcttcatcatgccaacgtgggagcgatgttgtttctctacacatgaacaatcttttcagcctctcctttattggaaaatatcataagactttgcttggcgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcacttcatttgttcatggatttcatattgaacaaaagcactagcagagataagtgtgatagttcacatccatcccataaaggcttctctgaatctttcaccaacttataaaatgcttgagcttctaaatttggtccatcagtgtgtgtacatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggtcataactctgaagcattccattgcacaccaaatgatcatagacatcattttttgaaagtagcatagtatgtacgcatgtttcacatggacaataaatctttgtatcctctaacttatctttatatgcaaattcaagaaatccatctactccagctaagtactcaacagaacctctagggtagcgcaaaagaatcttgatggtttctaaatccatttcgacctatataaaaaatttgatatttcaggttcttgtagataataacaatgacaaggaattgtctcttatgatcatgacgtagcaaaaatagggcaattagaaaagtaccagtataaaatcagtgtcagctaattttgtcacaacctaatagacctcctttatacactgaaacaaaagcttttactctgcaaaaatagagaagagctaaatcaattt

SEQ ID NO: 51995 - DNA, 1501 bp, Oryza sativa
agagagaactcaactaataatttatatattacttgtgataatcatattctaaacaggggttaagataatccaagggtagagtgacacacaagcattactactcatcctcataataatttatctaagctaagtggaaagaaaagagaaaagaaatctactcctatacttctagtatacatgctatacatacattctagttaactgatttactagctaataccctctatccgatgccctcctggtactttgagaagccacccctgattgccgagttccttacgacagcccgtcatgactatccaaccagggctaaatacggaggaataccctccccaggaaattaacttaggattacatataggcgtggaggaatacccgtactgagctgtcaccatcagcagcccacctctcatccgcaatatataaccccaaataatgatatcccgtaatctagacaccacgtctaaactaccagatactactctaatatcatcgtcatgacatagagtaattgcataagcaaacactatacccgcaccaaagcatctcccagataagctaatcgtacattcagtataacatgaacataatgtaaataggtactcatatactcggaaagtatttcaataccataaatgtatatataagagtattctaataaaagtacaaagcttacaaaagaggaaaggaaagctgctagagctatacacgaactcttctgaaggcttccagactcctgactcctattctatttctattccaccagttagatactactaaactaaacttgagaggaaagagagagctcttgcttgaggtgtgtgttgaggtgaagagagtgagctccttatataaaggtggttatgacggttgtggaaggggaattgtccgaagtaccccgcaaccgccatcaggagaagatctggagcgtccctgccaaaccccacagccaacggtggagaaatgggttcggacgaaccaccaggtgcggccgaaccatcaggttcggccgaacctggggctggctcaacgagcccacaatttggctggtggcctcctggacttctcttctccacagacttgtgaattttggcccagtttgtcgtgtcaattctgagttcttggcccattcatacacaagtctgattctcgacatcgtccgattgatttatcatttgatttgatgttgattctcctccattttattgttattctctgcaaaaggttagtatacctaatactagtggaatattattgctctcatatttttgcattgcaagcatcactagttctctcctattttagtaatattgacggtagaaactgatcgataccgaccgtcagcagcacaaccgccgccgccgtctccaaatgccgccgcgagcaccactgctgcgaggaccaccacgagcacgatcgccgtcgccgtcgccaactgccgcgagccccaccgcgagtaggaccgccgtcgccagccggccaccctccagaccgaccgaga

SEQ ID NO: 51996 - DNA, 445 bp, Oryza sativa
acaaaagtacataggcatggctagataaaacagtgataacgcgggaatttaaataaagcgataatgcaataatttaaatcaaaataactttataaactaggattcaatatgttcaaggatgatgtgacttgccttgctcgctttcccaaacgtcggcttcaacttccacgaagagcggatcttccgaagctgcagcatctacacgaccaacggaaaagaaaaggattttactctaattttaaaagggtttattgcgtcagccgaggggagggggcgcgcggaccgggtccaccccacgcggcagcctcacggtccacggtggactgggtgcacccgggctcaccggccgacgccgtgggtcccacgcgtcagccgcacctaagggcgcgggcggctgacggccgggccccacgcggcagcaactcggcgcgcccgagggcggcca

SEQ ID NO: 51997 - DNA, 1501 bp, Oryza sativa
gaggattggggaaggtggatgaaccctcatggattaacgacaacttcaacaataatgttgttttcagttaaaactgctaagtcataggtttgtgaaatgatttgtgaaatctagctttatgcaaacgaaccaaggcatccttgaaatatccctgtgagcactatatgcattatgtagtggtggcttgctgagtacggttggtattcacccttgcttaattaaatattttagaaggagaagttggagccgatttgtacgtgtgccatgctgatgaagagatgtcgaatacggtggagtagggacctaggttcaccagtcgctgcctgtggaataagatggaccgtcgctgcttcgcttccgctaccgtatctacttcattggatatttggtcttatagatgacaatgcttggtctatttgggtgccactccagcaacccttgtattattaatgtattataaagcctgtataacgatatcggctttgtgatatacaacgttgccatgtgtataccatctactgatccagggaatggtattgtaatcacatgaggtttccagtgtacaaaaccgggggccgacacctcaccacagggtggataacttgttcatcatccagaatttctacaatggtgtaagcatggccatggtaaggctgtccatgtcggtgtggcccgtggccccccgtagtgcagcggagggtggtcttggtggtgcccgagccgacgtcgaatgtgtgcgtgcagcagtcggcctcgatgaggtggacggtggcaagatcctcctcggtggtgtgcaggtagcgcaacacctctagggtgggcatgtagcagaagtagcagatcaagaaccccacaagggctttcagcaaccgccgacgccatcacgttagccgcaggcgggaggcggctgacgacgttggtgacaatgttggatacgggatccaggggcccaaagtagaggttgctgtcgaggatggcgggtagcagcgctggcatctcatcgatggggaggcgcacgatagccgcagcgtagaacccatggatgagtcgtttcagcatcgatttgtcaccgcggtgtgcatacggagttgggccttgcctggtcctcctctcactcttccatgttgctgcacacatggcgcctatctttagctagctatggttgtctatctttcacctcctccgtcttcttacgtacatcgctggttgcgaaaattaatgatcgtccatgcaaaatcacctcctctggttgcttcatgcatttccctgcacaattattgtcccttcaccaccccccaccctccccggcaagcaaatatgtcggcagcaattttcctttttgttcttttttttatgaattcggtcaaagttttttcatatttagttacattttgttaaaaaaatcaaataactttgtgcaaaaagtgacaccaaaattccaaaatttcagtccaacaggaaatagaaaaccctggaaatgtattcactgattaagatccat

SEQ ID NO: 51998 - DNA, 1501 bp, Oryza sativa
tgctgccgatcatctacgagcaagtctactacgctatcaaactccgggttgccactgcgttgccccctcgggctacagtgccaccgccccgtgatctacctgtactggttgttacagtgctaagagacgccctttttagcatggctttatcaccagtggacttctcgccgttgcatcgatatggagctgcagctatatgttgtcctcttggacaacagcttcaccgctttcgtcgtcttcattgccgttcgagcatcaacaatttcgtgttcgcactggtcatcgccagctactcgggttcttttttgtctacttcgagcatagccaccgtgtctctaagttgccaccgtcgccgctctaagccggtggtccaactacttctaaatggctggcatgcaattaaataaaaattacaacctacttctattccacaccagaggcttgagggggcccttacgtgagggggagtgttggaatataaagtgaattgcccatcattcttcatcagcttaagcttttaggttgaactagtcagtgcatacaactcaataaatggtgtcaggcgtgccactgaccagaccatcatggcggacggcacggcgagctcggtgaaccggcggagctccctgaaggcgttcatggagaacccggtccacgtcgtcttgcaggcgccggacagccgcgcgtagaaggcgaggacggcgaagttggtccagtacgtcacggcaccgctcagcgcagcgcccttgctccccatgccggccttgtgcaccagcgcccagcacacggcaacgtgggcgaccgccgccacgccggagctcgccatcaccggcacgacgatgccctgcgcctgcaggaaccggagggcgcaggcgagcggcacgtaggccgcgagcgacgggatcatccaccgcgcgtacgcgccagcctcggccgcgatggccgggtcctgcccgaagaggaggaggatctcgccggcgctggcccagacgagcgcgatggggacggcggccgccgcgagcaccagcatggcgcgctgcgcgtagacgccgagcagccggtgctgccccgcgccgtacgcctgcccgcacagcgtgtccagcgcgctcgacatgccggactgatcagatcatcccaccgagaaatcagttacaaattcgaccaagaaatcggagagacaatgcagttattgcgtgcaagcaaggtgttcaacgggtgcgtacgaggaggctgaagccggtgacgctggcgagcgacgcggcgagggaggaaccggcgagctggagctcgccgaggtggccgacgaacatgacggacaccatctggaccgagttccgcagcacgaagccggccatcagaggcccagcgagacgcagcagcctcttcacctccgccgccgtcgacgccatggctccgtcctcgccatctccgccgcgtcggacggcgagcagtggctcctccacggttgactcgtccatgtcgatcgaatcaccaactgtga

SEQ ID NO: 51999 - DNA, 1025 bp, Oryza sativa
ctcccacccccacctccgcctccgcctccgcagccatgcagatgcaggcggccaccaccaccaccgccgcgcgccgcctcgcgccgaagccgcagccgcaggccaaccggtgccgcccctcgagcgtctccgtcgtcgcggcggggaggtcccggaggaggagcgcgcgctcctccctcagggcctccgcctccctcgaccaggaggtcaaggagcgcgcctcccccgccggtgagcgctaaacactctcatgactgcaaacctcgcttgcttgatcagcggaggggggtttgtgcgcttcggaggtagggctaggcttagcgctggatttttggtgccgccatggttgggttgctgattagtatcgtgaggtgaggtgaagtgctgtggttcgctttgagtggggttggttggggcactatgcccattgacgcgagttttgctacggcctcgctgatcaagtgcaatgagcacagaatgtgtatgctggtgcttggtagaggttgcccctccttttttttttttggtcctggaatgagttagcaatctgtaagtggtatatataattgggtgcaatctgattctcgctgtttagaattgggtggctgcagctgcataggatgacatagttgacatttcgagtatagcaattgtggcttcacaagctgagtagctccttagttgtaactgctaacaaatagatggagggttcaaggtctcaaacacttcatggaatgtattttgtgatttgctggctactcttgcatatttaatcgttgaagtttgttgaatgtgtttattgtgtgaaagctaccttgcctacattttagtttcacaaatacactatatcttccttccacattatatgtgcactggcttgacctagtgccatcagaacgactggtatttttcatgcatttatctatctatacatatcagcttcctgtcttttctgttatatgatgctaatctatgtaccatcttttcactgaattattcagctgggaagagtggtcaagcaacta

SEQ ID NO: 52000 - DNA, 1501 bp, Oryza sativa
ttggtgatgccgctttgatgatttctcaaaaatggaacgaagatgggtggctgatccttcttttcatttacttttgcgcgagccaaaattggctaggttcgtggctatgctcgtctgctggcataacggagtatttatgaaaaatcctgaaattttcaataaaatcaaccatatctctctaagaaaaacattaccatcacatcacatcagatattatagttggcctataattctatacttggcaagcaagttccaccacgtgcaaaacagtaaattgattttttttaaagagaataaaatatctttagaactcgcgaccggctgcctgcttgcgtggaactttccaaaacatttcactgcagctgaaccctataaacagacttccggacgtcctgtcatcttctcaacttcactgtttcatcacaatctttagacttgagaattagggcctatttagttccgaaacaaaattttcacagtgtcatattgaatgttttgacacatgcatgaattattaaatgtagacaaaaaaaacaaattatatagttcgtcaggaaattgtgagaaatcttttaagcctaattacgtcataatttgataatatggtgctacagtaaacatttgctaatgacggattaattaggcttaaaaaattcgtttcgcagtttcatggtggaatttataatttgttttgttattagactacgttcaatacttgaaatgtgtgtccgtatatccgatgtaacatgtgtgagcaaatttttttccaactgaacaagcccttagcggaatacttaggctgtgtttgtttccttcttttcccaacccacgtctctcattttccacacccactcttttttagaccgctaaacggtgtattttataaaaattttgtacacgaaagttgcttaaaaaattatattaatatatttgttttaaaaaaatagctaatatttaattagttatacgttgagtcactccgttttacgtattagagggatcagttcccatgtctagcctctaggaaacttagttgatatatagcctgatacagataggctgatacgcatggacaagccactaagccagccgccgaggcggaggcgccgctgctcggcgcgctcgccaatcacaagcaacgcgagagcaccgcggcagcggaggccaagagactggtgagcctggcggcgccgctggtggcgagctgcatgctgtagaacatcatccagatggtgcccccgtcatgttcgtcggccggcccgcctcctcgcctcgtcgctcaccaacttcaccggcttccgccttctcgtaagtattggtcgaacaccttgctcgcgtacaagaagtgtctaatctctgcaattttcttggtcgattttgatcatcagttcggcgtatggcgagcgcgctggacacgcgccgaacgcgctggacacgcgctgtgcgggcaggcgttcggcgccgggcggcattgccttctcggtgtccacactccacaatt

SEQ ID NO: 52001 - DNA, 1133 bp, Oryza sativa
tcttgaccttctttttggagaggctggacaggttcatctgaacctgggggaagagagagagagagagagagggagagagaagcaaagcaaccttttgggaaaggtttggagatagatttgcagtttttgagtgggaattagtttgaaggtaaatgatgcattggattagtttctgggtgacgtggccatggagaggagaggtagaaatttattactgcctccggttttgtaatggatgacgtcgttaacttttggatatacgtttgactatctattgtatttaaaaaatagtaattattctgctgtgagttattttatcactaaaagtatttaaaatataatttgtatcttatatatttacataaattttttttaatgaggtaaatgatcaaacatgtatttaaaaattattgatatcgtctattaaaaaatgaagggagtcctactactcccccgtcgcaaaatataagaatctagaaccgaatgagatattttttagtattacgaatctgagtttttatattttgggacgaaggaagtacaatttaacagccactaatttgattatggattggaaggattagttaaaggcttcttttaccgttctgtgtacctggctacccgccttgaatgatgtgacacaaaagataggatttttttttccatggttgcagtatttgagtggcaattagtttatatgataaaagatgcatgggattagtttctggttgatgtggtcatggagaggtagaaatttcatgacaatttggtaacagccactaatttgattatggattggaaggattagtttaaggcttcttaccattctatgtacctggcttgcatgatgggactcaaagatgggttttttttttccatggatgctaatctgctagactgctaggagtactagtttaactgttgctggacgaaacgagttaaactagtttcgtcgaaagctgattttgattttgaattttagaatttgatttcaaactgataccaagggttttcttcctcactttggttgctatatcttttttccaagaaagtcaaaagggcaagtaaaggagatgcgaaatatacctaagattattcttacgaatcaaattaaaaaaaatcaaaattaactt

SEQ ID NO: 52002 - DNA, 1501 bp, Oryza sativa
agttcaattatctgtaataaatttacatatttattatttaattttatagatagtatgtataaaatggtattaaaatacataggagtaccagactatctgttaattaacttacctgcaaaaaaaaaaacgcacatgaactccgagagccctttgaatggcaagattgaaaaaacaaatgaataggaaaaacacaggattctgataagaatacaagtgtaaaactgaggattgcaaaacacagggaaaactaagaaatggtcgtttgattggactgcaggataaacgcacaaatcagatgtgagagatagactcaaagggaattttccaagagattaaagtggatgctagattttctacgtttttatttagaatcgtaggaatagaaaagtttcctacatttttccttttcaattcatttgtttttagtataggataggatttcaattcatttgtttttcctccaattcaaatgggcctaagtgataagctcgaaagaacagggacttggattaattttgtcacagaatgatctagtgtggtgacggccagaagagatgggcccaatggcctaagcccgacgttttgccgagaaaaaagtgtgggcaaaaaaaagggcccataactttagtgggttatatagcccatcgaagcaccttaaggttccttgttgggtaagagaaatttgagcccataatttttaaattttttttattaaaagttttaaaaaataattttctatttcaaaaattaacaaaagtagtagcccgccgccgccctcccagagggcggcaaatgtgatgtggcagacggccgtcaatgaaatttgcatgcggcccccttgccgccctccgctagggcgattttacactgtgcggggggccgcctgcaaatgggcggcgaggggggcatggaaatttgcaggcggcccccttgctgccctgggggagggcgattttacactgtgcggggggccacctgcaaatgggcggcgagggggcctagaattttgcaggcggcccccttgccgccctgggggagggcgatttttgcctctctcctatataaccccgtcccccctctctaaaatttcattataatctgtaaaaatccaaaaaaaaaggaaagagagagaggggatggcagcagaaggggagcggcgaagccctactggtttgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtactttagtttgatctggaaaacgtaacctacttttagaattttggagaacaatattgtagagaatgtaacttagtgcgtagtacagaaatgcgaggttaacgcagttattgttttcatcaggcacaa

SEQ ID NO: 52003 - DNA, 1501 bp, Oryza sativa
gctgaagacaagggagccatcaactgggttaagcgttccaccgtgagcatagtaccagaacttcgatcgatccggccatttagcggtggccggttcgttacccctctcaatcaaacttgcctccatctcctcccacttcggcattgcgacgctatatccgcctgaccccaagtggtgatggtacttcttcttggcggcattttctttgtttctggccatcatcgcttgcccttgttgccctgtcttgtaagcaacgaactcgtcccaatgatcccttagctttgggaatacgtcgaagtttggtgttagtctcttcaggatgtatttcttgtagagatctcccttgaatctctggaactgttctgccatttttctttagagtccactgtttcactatgttctccgtacctgtgggtagcgtgaacgtctcgagcattgtggtccacagcatctctttctctgagtccgggacaaagctgtcattatccccgcgtgcccttgttctgtgccagtacaccgtgctgacaggcacgttgtccctcacaacccaaccgctgtggcgtacaaaattcttggctgcttctgctgggccactaggtcggccatcttcgtccacctcagttatgatgtgccgaccctctatcttcttcgcagcacctcgttgtccgcgtgccctcttctgtccagcggagggatgacttccactggcctcctcatcgttcccctcctcgttcccctccgcatccctctccacgttcccctcctcgttcaagtactggtttggatcctcgttcccctcttcttcgttctagtactggctgcttccctctgcgattatatcatacagtatatgttcctcatcgctatcagccatctgtgcatacaaaaaatatttgttagatctataggtcatatttgctaaccgtaatattaaaactctactaatcttatattaaatctctaataatcttatattaaaattgtaataatcatatatgctaagtctaacaatcttatactaaatcggtactaatctcatattaaaattgtaataatcatatatatatatgctaagtataacaatcttatattaaatcgctactaattttatattaaatctctactaatctcatattaaatcgccactaatcttatattaaaattgtaataatcatatatatatgctaagtctaacaatcttatataaatctctaacaatcttatattaaaattgtaataatcatatatgctaagtctaataatcttatattaaattgctactaatctcatattaaaattgtaataatcatatatatatgctaagtataacaatcttatattaaatcgctactaatcttatattaaatctctactaatctcatattaaatcgctactattcttatattaaaattgtaataatcatatatatatatgctaattctaacaatcttatattaaattgctaataatcttatattgaaaatgtaataatcaaatatg

SEQ ID NO: 52004 - DNA, 1093 bp, Oryza sativa
gggtgggggtggaggtgagtttgtaggcgggggtgtggcggtgggggcttgggggataacggccatgggtgcggctgtgccgctgcgaggccggccacgtcggccgccggcaaaccggtggcccgatggtggaaatgggtggggatattccttttttttgaaaattatcctgtggcgtccgtttgttcgtcgagtcgcggtcgaagaaaaattactgcgccctgtgaagtgaacacacacggtcacaatttcgaactcctctttgtactcgtgcgtgtgcctcccgtttttcgagttttcggttttttatgtgaggttgtgtgttatcttccatgctaaagatgatctagccagtagaaaaacaattacttccaatgagatattccatataataaatttcaactaccatcctgctaaattatgtatgccaagaagcatcggttgcatgggagggaggtgtcgttagggcattcacggtgcggtgtagtggcattctcccttgacccttggcacgtttgcttccggacccaccaaaataaagttctcgtgtccaaagaataccaccggttcttgggtgaaaaagaggacgcgtgaggctgggagacagcactgcttctacgctgtggagcgagtagcatcgtgctccttcctgtgctcgccctcatccaacagggccggagggggctaacacccccatcccaccccctccctattatactaactagcgcattagcatattaattagtccattatcaataaatatgatatagaaaattaattaataagaaagagacggagagacaacgcaaatcaactcctcgttttcattgcttcggcttcacacgtctctccgtactcccattgcgtctcgctatcgagcatggtgtctcaagtctcaaactgtcaaacatccaatgatagagctaaaaagctaaattcaagttttttatggcagaacacatgatgtcttgttttatcgtcggcattgcttactataacttatgacttgttcgccctgcccacaccctcctaaccataaatccaggcttcacccctgccctccaatgagccgcctagcccattgtccttgcga

SEQ ID NO: 52005 - DNA, 1501 bp, Oryza sativa
agatgctttctttttaaactaaccatggagacatcttttgtctgggttaataacattaaccgggactaaaaaatatctttagtccgggttggtatcatcaactgagactaaagatcaatttttagtatgggttgatgttatcaactaggactaaagatctttcattggagcaaagatcagttctccggtagtgacaacgaaattagttaagatggtgaattgatcatagcacgatagttcaaccaggcatcagctacaatacgataccaaaggtagccagaagaatgtcaagtctactcaaacgcacggcacgcgtcttgggcatgcgtggcattttagaaagtagttttcaggaaaataaagaacgtgcatataaccaggtcctcctgatacgcgagtgattgtgggatggacgcatgcacaatcaggaaatggtaaaacagaaaaaagcccacgcacacgatcgctccgcttgcctccaatctctacgcgtcttccctgctacgtggttgccgctccatgtgggcccagcgataaaattacaaactaaaataaatcgcataaaacatttatatgtcaaacattaatttgagtcaaaatccataatcttgatcggatatttaaactttcaacatataaactttaaatgtgtaaactttaggtatatacacttttttgtgtaaactttagatatatagatgttaggtatacaaattttaggtgtgtatactttaggtatataaattttgagtatagaaactttaggtgtataaccttactaaaataggtaatatggtaaaaaaaaaagggagcaatgtgaggagggagcctgatcgccgcgcacgaccgatcgcacggtagcttttttgcatttaaccgtgacaacaacctttcaagaatacaatatatttgtctccatatattatctatttcagcaatctgtgagctgcacgtactgaaatgtttaaaataaatattctaaatttaaaactcatgctacaaagtaacgatgtcacatgcatggcaaatttctcacacatattacagcctctgctgtgtttgtgcagtgtattactcccttcatccaaaagtgttaagtatattttattttttgcttttcgaagtgagatagagttatattgttagtcttgtgctaaattaaatatattgtttatcgaaataaagtaagcatcttaatacccattagttacatctttgcgtattatttttgggttttttacatgtggattagttaattcctccaaagtcttaggtggtgtttagattcaggtacttagctttagtctttgtatttagacactaatttagagtattaaatatatactacttacaaaactaattacataaatgaaagctaatttgcgagacaaattttttaagcctaattaattcataattagagaatgtttactgtaacatcacataggctaatcatggattaattagactcaatagattcgtcacgcgaattagtccaaga

SEQ ID NO: 52006 - DNA, 1501 bp, Oryza sativa
ttggatgaagggagtaatacactgcacaaacacagcagaggctgtaatatgtgtgagaaatttgccatgcatgtgacatcgttactttgtagcatgagttttaaatttagaatatttattttaaacatttcagtacgtgcagctcacagattgctgaaatagataatatatggagacaaatatattgtattcttgaaaggttgttgtcacggttaaatgcaaaaaagctaccgtgcgatcggtcgtgcgcggcgatcaggctccctcctcacattgctcccttttttttttaccatattacctattttagtaaggttatacacctaaagtttctatactcaaaatttatatacctaaagtatacacacctaaaatttgtatacctaacatctatatatctaaagtttacacaaaaaagtgtatatacctaaagtttacacatttaaagtttatatgttgaaagtttaaatatccgatcaagattatggattttgactcaaattaatgtttgacatataaatgttttatgcgatttattttagtttgtaattttatcgctgggcccacatggagcggcaaccacgtagcagggaagacgcgtagagattggaggcaagcggagcgatcgtgtgcgtgggcttttttctgttttaccatttcctgattgtgcatgcgtccatcccacaatcactcgcgtatcaggaggacctggttatatgcacgttctttattttcctgaaaactactttctaaaatgccacgcatgcccaagacgcgtgccgtgcgtttgagtagacttgacattcttctggctacctttggtatcgtattgtagctgatgcctggttgaactatcgtgctatgatcaattcaccatcttaactaatttcgttgtcactaccggagaactgatctttgctccaatgaaagatctttagtcctagttgataacatcaacccatactaaaaattgatctttagtctcagttgatgataccaacccggactaaagatattttttagtcccggttaatgttattaacccagacaaaagatgtctccatggttagtttaaaaagaaagcatctctacccaagtcagatgtgtgtagtaggaggcatggtaacgcgcgtgagggttgagataagagatcttaaattcgaatcccacatcccccatattttttttttgacttggtatgcatctttagtctcgtttatttcaatcgagactaaagatggattgtgcgtcctagttgcacaaccgagactaaaaatggttgcaaaccgggactaaagtccctttctccggcattgtgtgttcattaattagttagctgtgaagttaatttaggtgcatatatacagtaaaaataatatgatcagactttgtcattttctgtcttaaaattttttatgcataagtggtccaggctagatatagtaattgtaagtactatgcttgttcaagggagagaggacaatattcaattggattactg

SEQ ID NO: 52007 - DNA, 335 bp, Oryza sativa
attaaaagagaaagggaggagaacagttctatttttccaacatttttagagggcttctatgggtaaccatttggcataacctagggtcaaggaagctctgataccaacttgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacagg

SEQ ID NO: 52008 - DNA, 1501 bp, Oryza sativa
tgtttatgtgtcgggcctggcctgcggcccatcgtgccatgccgggccggcccaatgtgtcggcggagaggcccaggcacggctcggtggtcgggccgggccggcacgggcccgacccttaacgggccgtgccgttcttgggccgggccaaaacgccgtgccgtgggccaggccatcagacctcggcccttttggccatctatagtccccgcttgtggacgagagagagaagagaagaggaagagggaagatgacatgtggaccccaccatttttttaataagaaaatgctgactggattgtcacgcgtacgccacgtaggacaaaaccactctggattggatcgagggggataatttgtccggtattgaaagttgagggtgaacgacgtctggttttcgggtttagggggtaattcgaacgaccgcgatagttcgagaaggtaatttgtaatttttccggaattgaaaaggctagtggttaccacttggcaaattctccatctttcttctgagttcctcttcttgatattcatcctgcagagtaaatggaagggtattctgtatatgtgtttatcattgcttcaactgaaaaacaagcccgggttgcctccttgttcatgctttatcttttttttcctgttttcaagtttgtttggattggactctaatttttaggaaaatatccactaaacttataaattgcaaatataatttctgtataaagtttatatatataaagtctagaaagattttaaaaagtttatatatactttttatattaaaaagtctagggtacacaaaagtctatatgtagaaaatttggatggaaatagttcatataaaaaagttttcgttaaaaaagagtaataaaaaaaggaaacaaaaaatttgagtggaagaaaaagaaaaaacgattcttatgaccatgatgaattactccctccggtttgataatacttgtcgttttacataagggtacggtcttttaaaaaacaacttttaccattattttttattatattatgtataaaagtgttaacaaatatatgattttattaaagtactttttaagactaatctattcatatagtcaccattttaaaagacaaatattttagaaatgatttataatcaaagattttaaagtttgacctcacatttatgtaaaacgacaagttataagtccggagagagtacgagagaataaggtacgtaaaagaggaaaaagaaatgaagacatacataagaatggagaaagaaaattgaaaacagcccatgcggtctccaaccttgaccagttcgcgataggctagcaaggcacagttgctgcgaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacgtccgttcactctcgggc

SEQ ID NO: 52009 - DNA, 1501 bp, Oryza sativa
acccttcccttttcctttctttcgacccttgaatttgcgcctgttgttgttgcgtttgcgctttccagtcagattcataggattaatattcaaagaatttcccttgaatcctttcttattctcagcattattctgtacattgaagtgcacctcaggcagtggagcagagcccggggggcgctgttgggcattctttaaagaaagctcatggtgtctttctgcctgagtcaatgtatgtataagcagagaatgtttctggaaattgttagcgcgatactgtttgttgagtcagtatcttgtcttccagaagtatagttgatagagttttctctatcttctctgcctccgttagctcttgttcgcaaaacttcaacctggagcaaatgttatgagtagcatggttgtattctgccacagatttaaagtcctgtaggcgtaaatgaacccactcataattagccttaggccaaatgagttccttttgctgatcataacactcttttagagctttccaaaggttgagagggctcgtctctaacatgtattcatgtttgggatccttgtgaatgtagagcctcaaaagaaaaagggatgtattgagcttcctgtgctcaatttgtgggtccccatcattgggttcctcaattatatttaaaatgccctgagaggcaaaattgatttttatatcggaagcccagatgggatagttagtcccatcgagggcgagttcgtcgaactcttttgttgccatgtcccttcttctttcttcaatttccttagtttcttctatttcttttgcttttctcggaatcaaaagcgatgtagtatctcttcgcttagagcgaagtgctgataacgttgtcacgtcctgataaattcatcccgaaataaaaatcattctctaaaaggaataatagaattaattaaaattcaaaaagaaattggcaaacattaaaatacgtacaagaaaaattcgaatgtggcccggagaatttttgttaaattctccttggtctaaaaggagccctcaaagtttatttgaatttccagagcatcggaaataattattaagcaacaacaacaattatcaaagtttattaaaaagaaaactaaattaaatcctccttcctcctttgggccaagtccggcccaaagcctccctctctctccctcggccagcggccgaagtctctcttccctccctctctttttcctttcccatctctctcttgggccacccctccctcctctcctcctgcctgggcctgccccagcccaagtcgagccgccaccctcccgcgcacgcgtgttgaccgtgcggaccggtgggtcccacccacccggtcgtcgtcctcctcccgcccggctcctccctctcccgtgaaaccctatccgtttcctccctcaaatccacgcgaatcaattcccttcattccaaattgattagggggaattaatcccctttcctttctcttcaattccccctaatttcccccttgaa

SEQ ID NO: 52010 - DNA, 1501 bp, Oryza sativa
aagtaacttaaagatttgtgatgtggatttgggatgttactttgatttgggatttggggatatgcatcccacttgattcgggagaaaataaaaaagaaaaaagaggaccatctgtactgctgttattccctctttagtcccggttggttgttaccaaccgggactaaagataaagtatctttagtcccggttggtgttaccaaccgggactagagatcgatttttactcccggttatttcacccgggactaaagatagcgatctttagtcccggattcgtagtcccggttgaaaaaccgggactaaaggggggttacgaaccgggagtaaaaaccacttctccaccagtgtctggttgccgattcactgtgagcgacatatcttgaggctgatggtcaaattagggggtcgttcgacttgagaccgatggtttatccgttctgcggtatgtagacaatataagattatatttttatccaagaattgtcccacgtatactatttttgtagaactttttttttctcgttctaaccatcaatatatatatatatatatatatatatatatatatatatatatatatatatatatatatatatatatatattctctcctcctcgttttctccctgaacttattttctctgcatattaatgaaagcatagcaatcttttaatctcttgattaataatgtttttatcttttaatcccttgattaatatatctttgattagctaaaacaataatcttttagtgaacatggcgaagtgtacatgtaagtaagtaagatgagtccaactatgtgaatacgagcaaccaaataatatattgtggttttatgctcaacccacgcgaggctacacgcacgtgtgcatattcagttgatcgtgtgctaggggtggtaaagagcctaaatttttaggctacaaaattgagttatttcaaaaataaagtgggctttttttttattcattttaacctaaacttatattacctccggtttaaatatatgacgccgttgtatttttataaatgtttgcccattcatcctttttaaaaatatttgtacaaataaaaaatatttaaatcgtgcttaaagaactttcgatgataaatcaaatcacagtaaaataaataataatcacataattttttaaataagataaataaccaaagatatataaaaaatcaacggcatcgtatattaaaaaataagaacgcaatataaggctaaaataggattacgaaaaaagctatccacacctatcgtggcgtgggctgctctcactgggcgacgagatgagagacgaccgagatgtaaaagtacgggccatggacggtttcggagtcggaacgacgaggggtcgagcccgaatcgggatgaaaagtccaacctctcccgatataacggttatttcttctccatgattttttttctaaagaaaaagaaaaaaaaaacaaacctagctagctaggcgggagcgatttgtaactgcgtcaa

SEQ ID NO: 52011 - DNA, 1501 bp, Oryza sativa
ctgctttatccacttgccgccgccgccgccggtgacggtgcggctcacctgctgctgccgccggccaccatggccgtcacctgcgggcaccggcccgatgaagtaggcctcgtcctcgccgccccggccgtggcggtggagcagcgcccacggcggcgcgctcgccgggtcgtcgaggaagacgacgccgtcgacgaggaggcgtcggtgctgcaagtagggcaggaggaagaagcagagaagctgctcgacggacggattgaacttgaaccccggggagagcccctgcgactccgccgccgtcgccattgacgcagttacaaatcgctcccgcctagctagctaggtttgttttttttttctttttctttagaaaaaaaatcatggagaagaaataaccgttatatcgggagaggttggacttttcatcccgattcgggctcgacccctcgtcgttccgactccgaaaccgtccatggcccgtacttttacatctcggtcgtctctcatctcgtcgcccagtgagagcagcccacgccacgataggtgtggatagcttttttcgtaatcctattttagccttatattgcgttcttattttttaatatacgatgccgttgattttttatatatctttggttatttatcttatttaaaaaattatgtgattattatttattttactgtgatttgatttatcatcgaaagttctttaagcacgatttaaatattttttatttgtacaaatatttttaaaaaggatgaatgggcaaacatttataaaaatacaacggcgtcatatatttaaaccggaggtaatataagtttaggttaaaatgaataaaaaaaaagcccactttatttttgaaataactcaattttgtagcctaaaaatttaggctctttaccacccctagcacacgatcaactgaatatgcacacgtgcgtgtagcctcgcgtgggttgagcataaaaccacaatatattatttggttgctcgtattcacatagttggactcatcttacttacttacatgtacacttcgccatgttcactaaaagattattgttttagctaatcaaagatatattaatcaagggattaaaagataaaaacattattaatcaagagattaaaagattgctatgctttcattaatatgcagagaaaataagttcagggagaaaacgaggaggagagaatatatatatatatatatatatatatatatatatatatatatatatatatatatatatatatatatatattgatggttagaacgagaaaaaaaaagttctacaaaaatagtatacgtgggacaattcttggataaaaatataatcttatattgtctacataccgcagaacggataaaccatcggtctcaagtcgaacgaccccctaatttgaccatcagcctcaagatatgtcgctcacagtgaatcggcaaccagacactggtggagaagtggtttttactcccggttcgtaaccccc

SEQ ID NO: 52012 - DNA, 1501 bp, Oryza sativa
gccaccttcttgggccggccggcccgttaagctcggccgagccgccctttctctcgggccgcgccctagccgcccgaggaaagtctatattccctccctctccctttttcttttcttttcttttccaaaaatgatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttacttttcgccgtttgttgagttgtcccgtttcgcgtgtagttccggagccagaagacccgcagtgcgaggatttcgaggatcaagctccagatctcgagcaaggcaagccacctttgaacatcttgagcctatatttgaaatttaattatattgcttgcaaaatattatgcattgataggattgcacttaatctttgtcccgtctgcaaggcagattggcggacctgcctaatttgttgcatttgatccttcctttgttaattgttataccatgtccccttgtaaccacccagttgcgcctcgatattcgtgcactctatgcgagtatcgacggtcgtcttcaaaacttaaaatctgaaaaacaacttgggtaaaactttggttttacaaaagacttggaaaacccgacacctgggtcggtgcttgcgaactaaatgaacttctaaaaccgcggaccagggaacgtaccgggtgtacggttttcccccggacacaccccagttgcttcctctcgccgtggtccacgctttatccgcactgcgcggaagcgtgttgttggttcttccaccgtgttccgtttccaccacccagctcccccaccgccagcggcccgtgctgctgctggccctcgacaggttccgccggtcccttcgcgtcagccgatcgacgtttcttcgacagaggagccgactacaggaggcagccaggccgacgaggagtagaggaggcagtcttctgcagccgtccgtgtgataggcccttttgttctgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaattcagtttatacctagtgtgtgctatctgagttgctatttactttgctccttgccctcctaagtgctgatctgactcttaccccgccctcttctgggagtttagatggctagccgcccctgccgtgcagctcgtgcgccagcccacttcggttttgaagaaggtagagtcgaaccagaagcaaatcatgaatcagctaatgagcagtctcaccgcagcaacaattcgcaccgtactgtttcccgtaacgcagaagttgagcaaccccgccgtagca

SEQ ID NO: 52013 - DNA, 684 bp, Oryza sativa
agaacatataggaagaataaagggcttatttggtttggtaccctaccaaaattttggcagtgccaaaacctggtaagttttggcactaccaaaattttggtatggtagcacagtaaatacgagtgtttggattagtgccaatgttgtgccaaatttttatgggtcaatttccatttggattggtaccaatgaaggattaccatttttttttggtgtaatagttttggtactatttgctgcagaataagcacaaataaacagagcggtgaggcggccagccgaggagacgagtagtggctgggagtagtggctgggtatttattgaagtagagaaaagatgaagccctagcttcttttttttaacggaagtgcgtgaactagtttgtgcttagccaagttgtgtggcctgcttctgggcacttccggcgggcgacggatggctgccaattccagcctatgccttgctaccaaattaaacctaggcactaccagtgatttggtcacaatccaaactcacagtggtattgttctgataactaaaatattggtatggcccagtttttatagcaaaccaaaacggcccaaaaatgaactcattccggctgtgagggagtactgcacaattttactgctacagaaaaagcaccactacaataatagtctgcacaaattacgtactgtaga

SEQ ID NO: 52014 - DNA, 981 bp, Oryza sativa
cataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactga

SEQ ID NO: 52015 - DNA, 1501 bp, Oryza sativa
gtcatttccgtcgttgtgaaggttcgtgagtgcgtcagaagtgttcaagaagactaattgaagaccgattattgcaaggcaagtcacacagatcctaaacacaatcatttgagcatgttgctcctatatttaaattctctatttatttcaactatgcatttatttttaaatgtcaccgggtggtgtgaacctattcatttgttatggccaatttgcattgattaccctattctttgataccttgggttataatttgactagttggactttatatattggttcgactatatattagaataattgcttagtcatgcttagaaacactagcatactattgggatgattaatgtttcactattacttaatgatggatactttatggtagctcacgatggttaatcgtgttgtgataaataattgataattaaaacttgataatggtgggttgtgagcacatggttttgaaggtcatgctcatgacaattaaggaccggttcgcaagctactgttgtgagacattaaccgtactaatcacaagccagaatgggcaacggctggacactttgtatagcaaggctcattgtggggcgctagactgtgaagcggcgagaagtccgtgggggtcgctggggagtccacgcctctggttgtagagggggtgattatgatccaggaaaggtgcgctgctttgagttgagctatgcgaggggtcttgtcacaactacacaaatggtggcatgttcagcatgggcacatggtgatatggtgacatattgtggagttatgtcttgtgggtaaatttgtacacctctggccagagtaaaactatttgaatagccatgcccgcggttatgggtgggttgagcaatgtttttcgtgattagtcccacactactcattaatgataataatgtgataattaatttgactcctggtttggaatggtaaattcctggtttagaggtttgatctgtacgaccggggttggttgttcaggtttggttgggcctgcagcatgggtgtgctattcagtgttgattaatattgatgattaattactctacttatttactactcctaaatgtttgctaaatgctgcttttgcaaatgagcctatattatgccatcctttggtatccgtgtgcacttgcatatttgctgtgtggcttgcggagtattccatgtactcaccttgcaataatcaatcaaatctcagttgaagaaaaatgatccagaaggagaagatgcttagcttataccccagttgagctgctgtgggagtggagccgaagctttgccagattttatttttatttttccgctgcagatttcttcgttgtgaggactaagtgcctcttcagtaagtatttatcgctttagttcttttgatgaatatgtatattaaattgtcagtttgtgtacctcggttgattcctggacaagaattttatgcgcaaattagttcggaaattactagtgaatttctgggcgtgacaaatta

SEQ ID NO: 52016 - DNA, 1501 bp, Oryza sativa
tgagactgttccatctctgaatcacgggaagctgtgcgatgcgagcggttgctacggcggggttgctcaacttctgcgttacgggaaacagtacggtgcgaattgttgctgcggtgagactgctcattagctgattcatgatttgcttctggttcgactctaccttcttcaaaaccgaagtgggctggcgcacgagctgcacggcaggggcggctagccatctaaactcccagaagagggcggggtaagagtcagatcagcacttaggagggcaaggagcaaagtaaatagcaactcagatagcacacactaggtataaactgaatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcagaacaaaagggcctatcacacggacggctgcagaagactgcctcctctactcctcgtcggcctggctgcctcctgtagtcggctcctctgtcgaagaaacgtcgatcggctgacgcgaagggaccggcggaacctgtcgagggccagcagcagcacgggccgctggcggtgggggagctgggtggtggaaacggaacacggtggaagaaccaacaacacgcttccgcgcagtgcggataaagcgtggaccacggcgagaggaagcaactggggtgtgtccgggggaaaaccgtacacccggtacgttccctggtccgcggttttagaagttcatttagttcgcaagcaccgacccaggtgtcgggttttccaagtcttttgtaaaaccaaagttttacccaagttgtttttcagattttaagttttgaagacgaccgtcgatactcgcatagagtgcacgaatatcgaggcgcaactgggtggttacaaggggacatggtataacaattaacaaaggaaggatcaaatgcaacaaattaggcaggtccgccaatctgccttgcagacgggacaaagattaagtgcaatcctatcaatgcataatattttgcaagcaatataattaaatttcaaatataggctcaagatgttcaaaggtggcttgccttgctcgagatctggagcttgatcctcgaaatcctcgcactgcgggtcttctggctccggaactacacgcgaaacgggacaactcaacaaacggcgaaaagtaaagccctattaatgacctctaagcgtgccattagatagatctcgagatttggggaattttggaagttgaacggagtcaaacggatttacggtggggaagatattgaatttctaagattattggatttttggtctaaaggaaaaggatttaattaaatcatttttggaaaagaaaagaaaagaaaaagggagagggagggaatatagactttcctcgggcggctagggcgcggcccgagaga

SEQ ID NO: 52017 - DNA, 370 bp, Oryza sativa
atatggttttgaccactgctcccacacatgaggtggaagttgtccaccccatgaatcaaatatttgtatacattgagccccagagtttacttggtaaataatgtattcagatatggcgtctgcaaggtgagacaaaagtccccttaacacatttggtgctgtgtggcacatgctctttatatttgtgtaagtgttggtcatccccccttcaacaacataagttgcaattgtccatggggcccccacaaatcctagcaaagcactgatgaatcccctaatgattttggtaaaaatcattaagttaaggtggatacacatcttgtcatatgatcaaatggtttcgcgaaaaatcaataatcagacaacaaga

SEQ ID NO: 52018 - DNA, 1501 bp, Oryza sativa
tttgatgaaaaagtttggaactaaataaagccttaagtgaataaagactacaaatagaaacaatttatttggaaaaactcaaatgtgaaatatgtctaacttttgtagatggagggagtaatttatagcacacgattgaaaatgcattttaacatgaatgactcgtaacggtttagaatttttctaatttatatttaataaaccatggcaaaataatatggtattttaaattttcatttatttagttgcattgcttgagaatgagtttgagtggtttggttggatgtctaagtacgaatgctgctgtcatttgtgggaattgggaagattgttctttggtgggggttcaacatcactctttggaacagaactaaaaccatgcataaccaggaggatatatagcagataatcacatatttttctttttattttctttgttgctctttcatgtcagatacaacatgtattcctgatgtttcttacacatttctcatcagggggatatgttctaagctcaaaaccggacatttctgtatagctaatatatagattatgtattttgaacactgctaaagtgttattagtaaacctacaaaattacaagattaattaaaatcgacttcaattattagatataatattaacaaaatagttaagaaaaaaaaataaaaactcaagaacaaagtttttagccatttaatttgttaatttaatgactccgaaactaagtttagtttggtcttacaattttatatggttatcttcttacttatattgtgcgttttaaaagcttttgagtttttttttgattgtctagccggcagttgtctagcaaatccctaaattaattaattaatccgagattgtacaattatgtcacatcctgatttttgttttatgatttataaattatttaataaattattattagaatttatgttaaatgttcattaatttacaagtgaagttaaatgtgagaaataaaatttcctaaatataaatcatggctgcatttaatttttattaaattctccataattaaatatacgctctgcaattttctcgaatttttcagagctcaattactaattttaataatacaaagagcagttcagcaatgattcgcatattaaattaatcattaaatggtcttcttataatttttttaaatacttatagtgttcaagtattttaataatttttcttggaattattagagcaccggaagtatttttaacaatttagagatcatttcagtgattaatttaattgggaaagtaataaaaaaacacccttttcctttccgggccgaaactagaaaagttcacttttagttctcggtccattctctcttcctttcggctggttctatcccttctccgaagtccatttcatgtccctccttcaatcgggctgagtaaaagaagcccagctgaaagtctgttttccttccctctgctacagtagtcgcccctaacctccagccggccggagacagagc

SEQ ID NO: 52019 - DNA, 1501 bp, Oryza sativa
aacgttgctagagcagacaatactttccctgtttctaatggaatgcctagaagcaaacaacttccaaaggtgaccatagcaataaaagcaggagctccaaagaagacagatataagcataactgaggtgtatacatctttctttagccaatgcatctcctccttcctcaactccatgatcttcgacaagaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataacctgcacaggaaacaaccaaagctcatgcatggacgaattgaaacccgcgacacgcaccgcatcaacgctcacggcattgatgatctctccacttgaaatgctttccctggactgatttgagagggagagacccttttggtaaatgatggcgacaagagctgagcgcacccgcacaccaagttgttgcgatctgaagagcaaatgccttgatgagaggcctttgatgaactgcgcaacaacaaaactcaacaccaaaatgtagccttctttagcggtccgtggacttcgattcaggtaatcaacaaagtactcaatcaggtatggaccaacatatgaagagacagtacggagtaaggcacaaactgcagtgaagaggattaatttccaggttgtaagaacaagagctttgaccagcttaattgttgtaacaccggtgtacttccctgaaccagaaactgagatgagcttcgcctcaaagttagggaggatgccttgaacactgtcattatcatccaaagttggcacatcatcaagatctagtgctttcctccttccaagatcaagtaacggccccatccaagaaaaagtgataacactaaagaatccagcatctgtgaaagctgctctactgcctgtggccttagacgaggaagaagctgcacggtccaatagtggctgatccatgataaactaataactcctgaacatagaacaacaaactttagcaagttacaactgattatttatgagaaagaaaagtataaaagtgttaacgtaaaaatgataatttaagtctgttcatggacattaataggattacagaaagtatagctaatttaaaggaaacaaacataactgtgagtgttaaagccatatgttgcatgaaaaacatccggatgaatccgcacgataccacagaattccattgtcacacatggtcaagatgatatcacaaatctccaagtaaacaaaatcgagacctagattacataaatagcatatgtaatatgtatgtaatctaatatgtgctaaacttcctagaagtaaaaaaaaaagaggatgtaccgaacttttaaatttagcaattgagt

SEQ ID NO: 52020 - DNA, 206 bp, Oryza sativa
aatggaatattaatatcccagtcactgcacccatagatgcacaaaactataatcacttattacaagttttccacagaaagcgaaataaattaaacataaagcagcatcctgccgaagtgtttggcctttacttcggagcgcccgctcatggcttggtttcctatcgctcctatgtagtggtcggccttaaaagtatctttggactc

SEQ ID NO: 52021 - DNA, 1501 bp, Oryza sativa
gcaccataatttggcttatagttagtacatttgtgcaggccaaattgttttagaataaaatgataaaactgtcaaatgatttacttggaaaatatactcagtttacaggtgcgtgaatttgcgatgcactaagagatcgtgtgtgcaaactgttgggtgtggctgcagcaattaacctggtttggtgacatgtaatcagaggtgtgtcgcaagtattagtccacatagggtcagtgtgcagcttacatgcagggaggcatccggatcctttgtggaggaataggctacagcaggccacaaggtgtcgtggattatagaagatcattgattgattgcatgcagtataccagtccagaatccggataggaaggaaggaaggaaggatagcagaaaaaggagatcgttgatgcggcctgtggtgcttataaagtcagtccatgcgtcggcagaaaaaaagcccgaacaatttcgatcactattcatctcttttacttttttttgttcttttcaattttattttcatggctgagtcctagcaaccctagaatttagttaatctttgccgttttgcgctgaaaaacggtcgtgcttctccacgaaagcgaggaggttatcctttgctagtttgctcggaaactagtcgttcgtcgtcacgtaagtacgatatttatcctctttgctaatttgcttgtaaattagtcgcttgattccgcgaaagtgaattaatctcgaaatcggtttcactagccgattttgatctatcgattttggcgactccattgattacaccgcaaatcgttaggtgatcgtgtgttggccatgaaaaagcgtcaacatattttggcgactccactggggaagagagtttcggtcctgatctggccgaaattgatctatccataatttttgtctttctttcccgatctgtttatcggtatcctagccgccgtcgccgagagcgttgctgcgattagcacgtgtgagtgtaaaaaaggcttcagttcagaaaaaggttattgaacctggggggcatgcacgtgtacaacaactagaaaatttacacaatgtaagtatgaagtgagagtcttcttcggcagagttagtaataaatcagaatccgccgaagagcttcgtgggcaatggtagccaaccgagacactcatgtatcttatcaaattggcagaagaagcagttacacaaactaagtgcagaaaagctgagggatagaggtatggcatgggttcctaaaggaagtgttcaggtgcataatgaaaaagatgttaaaagagaagtggaggcaaaagaggagaagggagttcagaggcatgcaccaaatcaatggtttgtatccaatcgtcaggttctttcgccaccacattattcatattcttcacttatgccaccgatacctatgtcatggaaccaattctcaggtatgtatgattatccctcatggttttattcttatccttggatatcatatgggtctttgatgtgacca

SEQ ID NO: 52022 - DNA, 213 bp, Oryza sativa
ttcgattaatatgggaattttaggccgtgagagcgaacgtggaggctcatttttctatttctttaataagttaatagattttgtagctaggaggtgtatttagataaacaaaaagcttagggatgtaaaatgaacttattccttttttacctggttcatttgggcaatgaaccaaacatgcccataataaccgtagtcataatttaaccatga

SEQ ID NO: 52023 - DNA, 737 bp, Oryza sativa
ccatttcacaaatgcatcttaaagctcattaaatttgtttgtagagttgcttttgacgtcttaagagtcaaggtgatgaaaatggatgcggctcctgcagtactgcatgtgctcactgacatatgggccttacagaccctcagccccacattcagccccacattgagtctgcaatactgaggatctggattggacgaaaatcgcttgctgttaaattagtatcagaagtcttatccataaaaaatagcatatatatgacactctaatataaacattcactatgtctatttattttgccaaagggcaaatgcaaatgtgaggctaaaccatgactaattttcaccttagtggtaaaaagccaagatggaaaaaatccctcaggggcaaaatgaaaaatgttggtacaaaataattctgcatttttgtttgtttccatgtgtgttcccacatatactcgtgtaattaaaaaatattatcaaatattacctccacttgtcatagatatatgacattgggaatacttactagagggatattccggtctttgtgaggtgttgtgtgttgggttggtgtttattcttgatcttttttcggacacggtgatttatcctttctgatcatgttgatgttgctctatcttcactatcaatgaaatactgcaaagttcttctctttttttttaaaaaaaacaatgattagatggagtaattatttgtatatcctgtgtgtgttttagg

SEQ ID NO: 52024 - DNA, 1501 bp, Oryza sativa
gacaactgccggctagacaatcaaaaaaaaactcaaaagcttttaaaacgcacaatataagtaagaagataaccatataaaattgtaagaccaaactaaacttagtttcggagtcattaaattaacaaattaaatggctaaaaactttgttcttgagtttttatttttttttcttaactattttgttaatattatatctaataattgaagtcgattttaattaatcttgtaattttgtaggtttactaataacactttagcagtgttcaaaatacataatctatatattagctatacagaaatgtccggttttgagcttagaacatatccccctgatgagaaatgtgtaagaaacatcaggaatacatgttgtatctgacatgaaagagcaacaaagaaaataaaaagaaaaatatgtgattatctgctatatatcctcctggttatgcatggttttagttctgttccaaagagtgatgttgaacccccaccaaagaacaatcttcccaattcccacaaatgacagcagcattcgtacttagacatccaaccaaaccactcaaactcattctcaagcaatgcaactaaataaatgaaaatttaaaataccatattattttgccatggtttattaaatataaattagaaaaattctaaaccgttacgagtcattcatgttaaaatgcattttcaatcgtgtgctataaattactccctccatctacaaaagttagacatatttcacatttgagtttttccaaataaattgtttctatttgtagtctttattcacttaaggctttatttagttccaaactttttcatcaaacttttaacttttccattatatcaaaactttcctactcacatcaacttctaacttttttattcaaactttcaattttaatcaaacttctaattttggtgcggaactaaagcccaagaatctcagttactacctgttagctcggtacgacaccatttaagaatctcatcagacatctgcagcattttaatttgttgggggtgctaatgagctttcaagatggaagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatctccacactactcctcgagtagtccatctgcacatgaacagcttggtggataggcagatcggacggtcgtccacgggtgatgaacgaacagtgtaacagttttactaatttgttgacaattagtaaaaatctattcgattttcaacttttttgggttcaaatttcctgaaaacttagaatttcagtctgccgattcttttaggactctgacatcttcatccttcctcagaagttagcaacaggcatgggattg

SEQ ID NO: 52025 - DNA, 1501 bp, Oryza sativa
ttataaaaaatataaagcacagtataaaatcgccctcccccagggcggcaagggggccgcctgcaaaattccaggccccccgccgcccatttgcaggcggcccccctgccgccccgggggcgggctagcggagggcggcaaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcgcagcaactgtgccttgctagcctatcgcgaactggtcaaggttggagaccgcatgggctgttttcaattttctttctccattcttatgtatgtcttcatttctttttcctcttttacgtaccttattctctcgtactctctccggacttataacttgtcgttttacataaatgtgaggtcaaactttaaaatctttgattataaatcatttctaaaatatttgtcttttaaaatggtgactatatgaatagattagtcttaaaaagtactttaataaaatcatatatttgttaacacttttatacataatataataaaaaataatggtaaaagttgttttttaaaagaccgtacccttatgtaaaacgacaagtattatcaaaccggagggagtaattcatcatggtcataagaatcgttttttctttttcttccactcaaattttttgtttcctttttttattactcttttttaacgaaaacttttttatatgaactatttccatccaaattttctacatatagacttttgtgtaccctagactttttaatataaaaagtatatataaactttttaaaatctttctagactttatatatataaactttatacagaaattatatttgcaatttataagtttagtggatattttcctaaaaattagagtccaatccaaacaaacttgaaaacaggaaaaaaaagataaagcatgaacaaggaggcaacccgggcttgtttttcagttgaagcaatgataaacacatatacagaatacccttccatttactctgcaggatgaatatcaagaagaggaactcagaagaaagatggagaatttgccaagtggtaaccactagccttttcaattccggaaaaattacaaattaccttctcgaactatcgcggtcgttcgaattaccccctaaacccgaaaaccagacgtcgttcaccctcaactttcaataccggacaaattatccccctcgatccaatccagagtggttttgtcctacgtggcgtacgcgtgacaatccagtcagcattttcttattaaaaaaatggtggggtccacatgtcatcttccctcttcctcttctcttctctctctcgtccacaagcggggactatagatggccaaaagggccgaggtctga

SEQ ID NO: 52026 - DNA, 1501 bp, Oryza sativa
aaaactaggcaatttagattctacccttgtaagatcattatcatgtatcatgcgtgaagaagtcgctatatctcgttgatggtgaagatgttgacattgagcatgaccatcttgtttccccttgcgcaatcctgccatggttagcagcaaacaagaaacatacacaagaatatacacgctcctatcaactactaggtagtggcagctcaaatctcacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctatggagctctgggtaggcttaaatatgtagcaaaggaaagcaatggttcaaatcagagaatgcaaagttgaataatggttcaaagtcaagtaccatgctggtcctagactagatcgtactagagacgcgagcctagagacaaatggtaccacaagatagcactaggaacaacttatgcacaactctgatatatgaaagcaaattcaaagatacaactgatttttctcttttccttttttttttcttctttctttctttttcttttcttttttttggtgcggcttttctttttcttttttttatgcacctttctgccttttttttcttttttttggattttttaacaaaaacaacctcaaggactataaagcaagtttacagggactcaaatgtaaatataaaaaaatacagggactcaactgtaaatgtccaaactcaaaattaaaactatacaaaaatggaatgctctcgtcccgtagattccgtttttgcagacggatctccaatccgatacacaaaaatttttcaccaagctgtctataccgtgaggagaggggatggagggagtcggactcaccaatgccgagaggaaaccgtggctggagatctcaccaatgtcgatctatggaaaggctccatgtgaaaacagagacaaatccctccctttttcttttctacgttggctaccaaacagaaaccaatccaatctaatctagacagatctctcctccttccttcttcctcgcacacacatgcacggcaaaaggaacacacggcagcaacacggcctcgggacagcgcagaatcacaccacaaaaaactagatgcaactcagcaacaacaaaaccgaccgatagaaacttctgaaaaactagaaaaatgaaaccttggcggaaagacgattccgttttcgtaggtcctgacgacaacaaagcacacgacgacgatgatgacagtggtacaaaacgtgaccagaactcgaaactctaaacgaactaaacgctatgaccagcaacacgacgtgacgatgcaacacaaaattcaacaaagcaaaaactgaaaaaaacaatgcaatggcacaatatggctaggtgaatgatacgaatttttttgtatggctattttctggttataggaag

SEQ ID NO: 52027 - DNA, 1501 bp, Oryza sativa
tgtttatgtgtcgggcctggcctgcggcccatcgtgccatgccgggccggcccaatgtgtcggcggagaggcccaggcacggctcggtggtcgggccgggccggcacgggcccgacccttaacgggccgtgccgttcttgggccgggccaaaacgccgtgccgtgggccaggccatcagacctcggcccttttggccatctatagtccccgcttgtggacgagagagagaagagaagaggaagagggaagatgacatgtggaccccaccatttttttaataagaaaatgctgactggattgtcacgcgtacgccacgtaggacaaaaccactctggattggatcgagggggataatttgtccggtattgaaagttgagggtgaacgacgtctggttttcgggtttagggggtaattcgaacgaccgcgatagttcgagaaggtaatttgtaatttttccggaattgaaaaggctagtggttaccacttggcaaattctccatctttcttctgagttcctcttcttgatattcatcctgcagagtaaatggaagggtattctgtatatgtgtttatcattgcttcaactgaaaaacaagcccgggttgcctccttgttcatgctttatcttttttttcctgttttcaagtttgtttggattggactctaatttttaggaaaatatccactaaacttataaattgcaaatataatttctgtataaagtttatatatataaagtctagaaagattttaaaaagtttatatatactttttatattaaaaagtctagggtacacaaaagtctatatgtagaaaatttggatggaaatagttcatataaaaaagttttcgttaaaaaagagtaataaaaaaaggaaacaaaaaatttgagtggaagaaaaagaaaaaacgattcttatgaccatgatgaattactccctccggtttgataatacttgtcgttttacataagggtacggtcttttaaaaaacaacttttaccattattttttattatattatgtataaaagtgttaacaaatatatgattttattaaagtactttttaagactaatctattcatatagtcaccattttaaaagacaaatattttagaaatgatttataatcaaagattttaaagtttgacctcacatttatgtaaaacgacaagttataagtccggagagagtacgagagaataaggtacgtaaaagaggaaaaagaaatgaagacatacataagaatggagaaagaaaattgaaaacagcccatgcggtctccaaccttgaccagttcgcgataggctagcaaggcacagttgctgcgaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggc

SEQ ID NO: 52028 - DNA, 1501 bp, Oryza sativa
gacttgctctggatatatgcactatgaattcgtgatcatgggtctattttctatgctcaaagactggactatttattattccccgtaagggttatcaactgaatacttgcgccagtcgggattcaattgttacacctattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatataatatcattgctttttgccatgtaagtgtgcatttttattgaccaatattatggcttaggctgattatatattatggtcattttttaggcggttggtaaatcctttatgagtttacttactcggatgttataccacatgtgccatatattttcaggtgtggtgaaaccatgtgtcttttagggacttaagcacatctgttaaagcagtgtgcgcatggcgtatgcccaatactttggaaatttctttattcacagcattcaagcttctttatagttgttttgctatgtgaactttcaaagatgttgtcaactttaggttgtacgcatcatattatgccaagcagtcggtatatcacttggatcatattattcggggattcacaccgcatatgctatatattgatatcaagtcacttggttgattacaattatcaaaaccactcggttggttagattatttattccttgactatatgtttggttggttcaattaaccacatagtcaggggctacacctattaggtgcatctattcgatgcacctgactttatttttcagccctccacagtcctcagatttggtaaaagtactcgggagaccatggcgaagatgattgaagcactcggctttggagtaatctagttcgagagaagattatattttcgactgtgaagggtctcaggggctactgtggagattatgggtaccccatatccacacggcatggttatccgactagtaataggggataacatatatgtatggaatatgtaacagatcgtgacttgggtattacgtttccctatatattatggaacggcctaaagtcctggtttgataagattgtaaagtagatttaggaaaccgataccgtattggttaaggtttctatcttgtaatcctgccccccatcctatataaggtgggcaggaagccctctagggggca

SEQ ID NO: 52029 - DNA, 1501 bp, Oryza sativa
ctttacaaatttacacatgcgtatagctatgtcccattcttcctcggtaagaagcaaaacctcaccatcaccatcaccatcctcatctcggcataatttattatcaagtgcaatgaatcaatcaaatcataaattatttcctcataccctttcagctgacgcggcatgaggtatgttgtgttccagttatgtttcacgttaatgccaaatatcctcaaaggtcctctacaatagtcctataacctcaccttgatcagtgtgtgacctccaatgatagtaataacgcccatacctgcttagacaatgtggttgatgatgtcacatatgcattaaaatcaataaactatttgccttatgtggagattatgggtaccccatatccacacggcatggttatccgactagtaataggggataacatatatgtatggaatatgtaacagatcgtgacttgggtattacgtttccctatatattatggaacggcctaaagtcctggtttgataagattgtaaagtagatttaggaaactgataccgtattggttaaggtttctatcttgtaatcctgccccccatcctatataaggtgggcaggaagccctctagggggcatgagacaactagatcgtcagatctataatacacccggcggattcaaatccccaaataggagtagggtattacctctcatcgagagggcctgaacctgtctaaatcttttgtctccacatccatccacttttaggtctcgtgcgctaccccgttttattattgccgaattcatgtttcgacagttggcgcgccaggtaggggttgcgtcgagttttccgtcgagaagtgcgatggaactttgtgccggcgtcatcggtgctactcttgtctttggccgtgatcttctcaacaaaagggcagggtcttcgtcgccaaaaattctatctggatctggtcaatcaaccaggagattaatcaccgatcgaatcgatctacaaccagcttgttatcgtcaattttacctctgtcagtgagatcaaatccgtcgctacaatgctgccatgtctgttggtccgtcggtttcgtcaccagggcatgatttgaagcaatcagcaagcagccgccgccgaaatcatgcgaagatcaccgtcggttgagcctgtacatcaccaagtcaatactactcggatacgtacggcaagacacaaagtccaggatacaaattaaatatacctggtcaaatctgtggtcaaggaaattaatccatagacaaatcagctattacatgcacaaagtggtctccaaactaatccatgcatgtgctaccgacgattacatgtctacacggctgcatgacacggctgcatgctacggttcatccattgacaggccttgaatcaaaattggatcacaaaccaggtttatcgttctaaattttcttatataaattagatttaattcacagatcactaattattatttgatctattattttatacatgtaccgc

SEQ ID NO: 52030 - DNA, 1266 bp, Oryza sativa
ggccgaatgggccgcgaggagaggagagggagggggagggagatgggccgggccggcccaagagggagagggagggaaaggggactttttagagtttttctttttataaaatcattttaactttgtttatttcttaataattattatttatactctgaaaattccactaaaatttatttacgcattttaggcttttaggaaatatacaaaaatcccccaagccttatttgacttttaactttgcaccttttaattgttggaggctttcacacggattttaattattctaggcataatttagaggatgtattttagagtcgttttgggacgtgacaggcattaaaaggacgatgtatcttatgggtcaagctgtacaacctagtgttaattaatctattcgaatagccgcgtccgcggtcatggacatgctcaatgatatctcatgaggggtagtttgtgaaaactggaaatgaactgtgtgcaggttaatgaatatagctatgtggtcctgtgtggacgaatcctgtgtggatggatagttggtaatacccattatttataactattgttttaaacctgtttataaattgattataactgcaaattgctgtgttatacaaaatagccattgcctttgttgtcagctttgcatatgcatatttctgtgtgcttgctgagtattccatgtactcaccttgcaattcccccaattctagaagaaaggttcccgctgtttcctgaggagtttgttgctgaagacgaggaataggtcgtgagtcccagttgactgcctgtggcaagttgaatggagctactacgcatttatcatatttccgctgctactttaatattgtccttaggccctttgtggcagaataattgtaaactttagccataaggcttaacacagtcattattattgttaaatattaggattccttcgtgatgttggctgtgatattatcgttgagtctgtgtgtgctagcttgatcctggactagcacttatacacaagaggtcctattttgggtactcacagttttcgataggtttatttttagcagatttatatattagttaactgcaaaagaatgagctagctaggaagagaagaagagaaagaagggtagtttggtaattcgtccgagggatagatgtatgttttatatatgcagatttttggttagctttaattatcttgttcaaaatatttgaactaactaaagttgtattattttttccgcaattaattaattaatacataga

SEQ ID NO: 52031 - DNA, 1501 bp, Oryza sativa
gaggaggtgtggggagggtttaaatagggttggaagggggagagagcggccggaggggaaggaaaccggcgcaggaggtccggccgccatcaatggcgccggcgagatttgcgggggcaaatccgcccgtttgaacgcgagagagagagggaaaaatggggggaaagggagaggggatcacggggagtaattcccccctattgattgaacgcggggacgacgggatgcgacggattcggcggcggcggcggcgctaggcgcgggggaggcggcgggagcggcgggaggtcggggatgacgggtgggccccacccgtcagcgagggtggcgggcgggcccgcccgtcagcggcgcgcgcgcggggagaggccgagtgggccgcggggagaggagagagagggggagagagatgggccgaatttggcccattagagagaaggagggattttagggtttttctttttataaaacctttttaactttgtttatttcttaacaattattatttgtgctctgaaaattccactaaaatttatttacgtattttaggcttttaggaaatatacaaaaatcctctaagccttatttgacttttaaccttgtacattttaattgttggaggctttcacacagttttttaattattctaggcataatttagaggatgtattttagagtcattttgggacgtgacaacatccgggttccaatttgtcctacccctgatcttcttccacaaattgagggcacttgatttgcttttcttttttgtggggtctcctcagtcacccagtgagcaacatctagcttagtttggtacagatggaaaactctaaacaactcatctctagcatgttgataaacttttgaataatcaaagatcaattgcatcacctaatgatatgaaagtagtctccacgattttcaactttttatgaagatcaagtaccaaattaaagcaataatggtggaatagcagtgaagtatttgaggaatttttcatgcatgggtttaacaatggaagctaaaattttgtcatgttggttttcttcaaagataagtgataacttccaaagacattcatgcaccgaacaagaagtaggatagtgcattccaaatagcaaaactgaagttctacgaaagggctttacaaatttacacatgcgtatagctatgtcccattcttcctcggtaagaagcaaaacctcaccatcaccatcaccatcctcatctcggcataatttattatcaagtgcaatgaatcaatcaaatcataaattatttcctcataccctttcagctgacgcggcatgaggtatgttgtgttccagttatgtttcacgttaatgccaaatatcctcaaaggtcctctacaatagtcctataacctcaccttgatcagtgtgtgacctccaatgatagtaataacgcccatacctgcttagacaatgtggttgatgatgtcacatatgcattaaaatcaataaactatttgccttat

SEQ ID NO: 52032 - DNA, 1501 bp, Oryza sativa
agatcaatcaattgtaaccttttgtagaaggtgagtatatgacatactcaacaagtcacgcagcaaatatgcaagtgcacaaggataccaaaggatggcatagtagggtttcatttgcataaacaacatttaacaaatatttcagaaattgataaaacaattaagtattaattaaacagtattaatccaacgctacacaacataccctgttgcctaggcccaaccattctgaacaaccatcccggctgcacagttctatctccagaccaggaatataccattccaaaccagaagctaatcaaattattaccagttataacatcttttattatgatgagaggtgtgagactaatcacgaaagacattgttagacccgcccataaccgcgggcacggctattcgcatagttttactctaatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttatctccgccacttctcagtctggtgccccgcaataaaccatgctatacaaaaggtaaagccgttgcccacgctggcttgtggttggcacggttaatgtttcacaaccgaaactcgtgaaccggtccttaattgtcatgagcacgactctcaaaaccacgtgctcacaacccaccattatcaggttttaattggcacattaattaattaaccaatcacgattgaccatcgtgagctatcattaagccatcattaaataatagtgagtcataagttatcccagtaatgtgctaatgtttctaagcatggctaagcaatcatatctaatatatctagttgaaccaatatataaagcccaactagtcaagttataataacccaaggtatcaaggaataaagtagtcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttagaattcttcaaattcttctcctgcgaaaacggactctccggaaacgtcggaatctaagcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggttttcggtggaccgggcgca

SEQ ID NO: 52033 - DNA, 1461 bp, Oryza sativa
gccgcgctcctcctccatctagccattgtcgtcggacgcaggaactgccgtggtcacggcggaggagggattcggagaggccatggttgccgctgccgcaggaactgcggtggtcatggccgcagagcccaccgtccgccccgcagcccggtgccgctccgcccgccgcgctcgcccgtcgccgctctgctgccgttctcgcccgccgcccgcccatcgccggccgctggcctccctgaccaaagaagagaagagagaagaaagaagagagaagaaaaggacaagaaaagagatgaaaaaaatatgtcccgctgacatatgggccccacgtactttttaaatttttttttgttgtctaagatgtcacgtcagcgaaaccacccatatatactgcctaggggctttaagtgaacggttttgtatagtttaggagtggagatttctggtttcgtggttaagggatcttaaaaaatcttgctgttaagttgagggacctccggtgaacttattccttctatgcagtctgctgcctgggcaggccaaggttactctagacttccattcagttcaaactaccaacacaatgctcctccctgactgctcaaattctctccttgaaagaacagccacaacacattctggagcttgagaaattgttagaggaacaggctgttttgactcagcctgagctcaacttgtctccagagtattgaagggcaggaccaagcgtacctcggcatctagtaacaacttctgtgctacatgccaaagagaggaagataaaaaagatcccgatttaggtggggtttgaatctcctaaagatgtaaagatgatgaagataaagattaagtgttttatgtataacgaggtagtaataacgtgtgattaattgagttttaattattacaaacttgacaaatggattaatctgatattttagaacaattttcatatagaaagttttcgcacgaaacacatcgtttagcagtttgaaaagcgtgccactttaatccaaaatttaatccactcatttcagtggattcgaacaggaaacattttgactacaagaagagcacttgtttggcctgtaatgcaattcctccggtgttaaatgagaaagttgatcacccaccttagacaaagtgtgataacttttctcggttagtgatggcaaagtgtgactaggaaccaatatgtcatctctaatacacatattccaatactactaatattttcacaccttttttatgtttgtatagagcttctcccttgcataagagatgtggctcatgtttctctcctctatctcatcacctaatcttatgtgacactcttaggtcccattcgtttctgctcaagtggcgtagctgaatgtggaaaaaaaattaaaacattagcgcatgattagtcaagtattaacaatgacaaacttacaagtaaatttatttgatttttaaaga

SEQ ID NO: 52034 - DNA, 915 bp, Oryza sativa
agtccaatcgtctcaagttagcatgcgagttttttttaagagatttctatgcgactcctttggtatttctaaaatcgaacgaacttaaaaaccgactcatatacggatgacgtaccaaagttctggcaaaaacatcttcagtttttataatagtagagatataaatgggagaagttgttctgatatcgtgcaaaaaataattgtgtgaattaatgtgccatttggaaaattgagccaatgtggaattaatatatgtgtatatatgggtattacccaaattttggtaaaattgtttggcatatgtatatactccctctccgttttatattagaagtcattgtgatattttactactaaatttatagaaaaaattatcaacatctaaaataccaaattttagattcattaaatctataatatgtttgttttgggttgaaaatgctactaatttttatataatcttattagtttgactaagaaaaaaaatcaaagctaaacttttattcagaaacagagggagtacaactttagcaaatgtttgacattgacatgctttgatagaggaatagcagaacattttttttaccagcaccaatagtttcgaaaataaaccattaacaccttatcgatcggaaacttcaaacacaacaacctcaaactatattatactcgttagcatattccccctttgattaattctgtaagaagcaatgacgaagaagtatgtaattgatgatcattccaacccatagattattctcatacggaacaaatgactcggtaaaaacataattaaatcggtgaaacggtgtacatgtgtgtggctaggtaagagacaccaggtcctaaaaggtattagcatggactaaaaatatattttattaggataatgtcatcaaattgttcccctgcagg

SEQ ID NO: 52035 - DNA, 1501 bp, Oryza sativa
tggtttgccagcgtggttatggcattttacgaactcttacatcatacccagatgtggaggaacacaaaggacggacatgtttgtcaccacctctcatctacctcactttccgtgggacatacccgcatccaacaacattttgctgacctaagcaccatgcttatgttactaaataatgacactaattcccctggcactcccacccttcggatggacaagttagaactagtgcaacccgttaaggtcactggaccattaccatagcatagatcgactaatctaatcaagtgaatcatataaatgaagtataatctattcatagagcatataactaatgaattagcatatcaactatgaacacaatagaataaagaagataattctattaaagcaactatagtcttacaagaaaggtgaagtaccaaagacataccggaatctccaagaagactataggctcaaagattactcataacctaactccactgctactagagagaatgcaaggtatggagtgagagatttacaccttgagtgtgtgctttgagagtgaagaggtgatctctgtttatagctggcttatgatggttgaggaggtcgttaactccacaaccgccatcaggagccaacaagggatcaccacgtagaagggaggaaatgggggcaccacgattggttcagccgaaccagggttcgaatgtaccagacccaacgccaattggcaccgcctttggtgagtggctaacaggtgggctccttggtttgttcctggtggttaggcccaactttaggtcagtttgatctgacttgtgagcccctcaatacgtgtgttcgctagaggtgtgtttctttgcatgccggctcaattctccttcactttagtgtataatccctgcatccatagtatttctacaatataagtggaactacattatttgtaaatgatatatatgtaagaaatgttagttctccctttgtttattgtgatagttggtggtcgaaatttgtatttaacggttatcaacatccacttatgcaaagaaacgtattttcgagatcatgtagatgtcctattatctctatagatacggagttgctgcctgcacgtagcacacacaaaaaacaatcagggtttgccactttctctataccgcgccaccaggagagaaagtctctggaaccattgcctttgatgacttacagtaggaaaaaggcaccaatatggtttcttggaagcgctctatgtgactgctagctggtttgccccttcaagctgatcctcttccacaatcgaaacagaaccatcggtaaatctcaatcatgtttcgtatgtttgatttgttattcgtagctatcttgtatacaagtccagatcaactgacttggttcagctagtttacctcttttaacctcatgatttatttatggaataaattaaatctacatgcaattatgttttcaatagtccaaaaaccttactataggcactatggttttacta

SEQ ID NO: 52036 - DNA, 1501 bp, Oryza sativa
agtagggtttcatttgcataaacagcatttaacaaatatttcagaaattgataaaacagttaagtattaattaaacagtattaatccaacgctacagaacataccctgttgcataggcccaaccattctgaacaaccatcccggctgcacagttctatctccaaaccaggaatataccattccaaaccaggagctaatcaaattattaccagttataacatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcagcgcaccattcctggatcataatcacccccttataaacaaggcatggactccccagcatcccctgtgggcttatctccgccacttctcagtctggtgccccgcaataaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttagttggcaagtaattaattaaccaatcacgattgaccatcgtgaactatcgttaagccatcattaattaattaatagtgaatcataagttatcccaaaagtgtgctaatgtttctaagcatggctaagcaattatatctaatacatctagttgaaccaatatataaagcccaactagtcaagttataataacccaaagtatcaaggaataaagtaatcaagaacaaaagggctataacaaacaataggttaattccacccaatgacattcgaaaataaatgcaatagttgaatagaaacagtagctttaaataggatcaacatgctcaaagggttatttgggatctgtgtgacttgccttgctggccttggaactcttcaaattcttctcctgcgaaaacggactctccggaaacgtcggaatctaaacagaaaagagcaaaaacaccaaaacagcacataaacaagcatgaatagtacatgtggatatttttaacatgtagatctcaattttagaaaaatttagaaacttgaaccaactaaatccgagctaagatgaattagttatgaatttttaaagattaaaccggattaaaacacttatatggattttaattgaattatgacgcaataatgaattatttttgaaaaggaaaagggaattattgcgtcagcggctagggtttgcggtggaccgggtgcacggcaacggttcacgggaacgaacggccgagatcaatccatccaaaacggacggccgagatcgatcgggtctacggcggctcacggcagacggccccga

SEQ ID NO: 52037 - DNA, 948 bp, Oryza sativa
attcaacttccaaaattccccaaatctcgagatctatctatggcacgcttagaggtcattaatagggctttacttttcgccgtttgttgagttgtcccgtttcgcgtgtagttccggagcccgaagacccacagtgcgaggatttcgaggatcaagctccagatctcgagcaaggcaagccacctttgaacatcttgagcctatatttgaaatttaattatattgcttgcaaaatattatgcattgataggatcgcacttaatctgttgtcccgtctgcaaggcagattggcggatctgcctaatttgttgcatttgatccttcctttgttaattgttataccatgtccccttgtaaccacccagttgcgcctcgatattcgtgcactctgtgcgagtatcgacggtcgtcttcaaaacttaaaatctgaaaaacaacttgggtaaaacttgggttttacaaaagacttagaaaacccgacacctgggtcggtgcttgcgaactaaatgaacttctaaaaccgcggaccggggaacgtaccgggtgtacggttttcccgctcccgcacttaaggaccgattccttggaatttcatccgaacataggacaagtacgaccacatgggtggaatgggacacccctggctgagtaactagcttatcaggggagccatgatgccgagggacatgtggattcgccggggtggtgtcggagaggacccccctgggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatgtcgtgtgggtaaagtgtacccctctgcagaggttaacaaactgttcgaacagcca

SEQ ID NO: 52038 - DNA, 518 bp, Oryza sativa
agtcatatatgctaagtctaataatcttatattaaatggctactaatctcatattaaaattgtaataatcatacatatatatgctaagtctaacaatcttatattaaatatctaacaatcttatatttaatctctaataatcttatattaaaattgtaatagtcatatatgctaagtataacaatcttatattaaatcgctactaatcttatattaaatcgataacaatcttatattaaaattgtaataatcatatatgctaagtctaacaatctaatattaaatatctaacaatcacttctttacatcacttgcctgcgcgaattccttcgatggctagctaccacttcggcttgagggacgacgacgacgtcttctctgcaacattaccaggaaaatgtattagtctaaacgggccaagttacatatataatcatatatgtattaccagtaaatcgtattagtataaacgcgttcattctcacacttttagtacaagtgcattcacgttcgtaagc

SEQ ID NO: 52039 - DNA, 1501 bp, Oryza sativa
acacgacgtgaagttccaaatttatcttgccctccgatccatctttccatgagcgtcaggtctaggccttacggctgcatgatcatgtctatgaacatgtccagacatctagtacggtgtgttgtggaatgccttgagcttctccggtctggtggcatggcactgcatcgcaggtcaatgaagcttccattgctgcttgctggcgatgagatacacggggtgccacagaacgagcttgagaaggcctcatacaactgccggtggaccttgtccttgaccacgtcgagcaccttgcccttgggcagcttgaggtcctcagaaggcatggcctagggcgtcatttggagtccaatggtgcgaatttggatagctattttatcagtttaggtttatcttctcatgtcaagtttggatagcttatttatttccttgttcctcttaactagtctctccctcccgtgcacccttccaatgcgcacttcgttcttttttgtgttctgttgcctaccatcgtaccttgctggtggctgagaggtttggggctgaggccagcaatctatcacaactacaatatttggtctttgccaggccgtgacaacttggtaccagagcaaactcctgcgtctgtagacatgtcggccgctggtggaagcgaggaaaggtttaggccagcaaatggtggtcatcctcaagaagctggagaagttggacgtcctggagtcgaagcttggtgacatcaatcaccagcaaaaagaacatcacctgatcaccttgcgatcagtcgtttgtaggccagtaaatcagcatgcaatgccgataccttctcggtgagcaaaggcatcctcctccagtcccccgactatcttcggctctgggtagaccaccagatgggcgcgttgtgctaacacaagtggtacttcccgacattcgacaggaagaccccctggcccctgacatggcttatctgctgtgagcaattcttctgtgggcagtgcacgttagaggaccatctgattgcgtaccatcgtgtctagctgaccgggaggtctgaggtttaggctggctggctatcacgactacaaatcttcggcctttgccaggctgtgacagaggttgaggaagaagaacatggcaattggtgggtgagttgaaaaggtcaaacatggtaaataagcaagtatgtggcaaatgagagtatgccatcctggcatgagggcattttttcccaacaaaagtgtcatgtacgcaagcgagccaataatttaagagcaattaagcattgtcaaataacattatttatttacagatagactttgatcctaaatgtttctttgtacatgattttagtagctgatggttaagaggaagatttagctgtgaatttaagtcttaaattattttcatatgttattgcaggttgatctgcttttaggaaaggcttattctgattggggccatatcagtgatgctgttgctgtttatgaaaatctaatcactgaac

SEQ ID NO: 52040 - DNA, 1501 bp, Oryza sativa
ctttagacttcggtggaagttgggataagaatctgccttatgcggaattctcgtacaacaacagttatcaagctagtcttcagatggctccttacgaagcactgtatggtcggaagtgccgcactccgcttttgtgggatcaaacgggagaacgtcaggttttcgggacggatatcctgagggaagtagaagaaaaggtgaaaatcattcaagaaagattgcgagtggcccagtctcgtcataagagttatgccgacaatcgccgcagagatttgagttttgaagaaggagattatgtgtatcttcgtgtcacgcctcttcgaggagttcatcgttttcacaccaaagaaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctatcgaagaagctaatcttgaacaaatagaagtccaagaggatctgacctatgttgagagaccaatccgtattttggaaatagatgagagaagaaccaggaatccagttatccgtttttgtaaagtccaatggagtaatcattcggaagaagaatcaacttgggaacgagaagatgaattgaagtcagctcatccgcatctgttcgccagttcttccgaatctcgaggacgagattctgtttaagggggtaggtttgtcacaccctaaaaatcctaaatatataaattgttgtttaattggaattattagaatttattttaaaaagtctagaagagaagatctaattttaattaataaattccaatataaaatggggccagataaaatttcattaaatactgtgcttaattctataattcctagatttttctgggatttatatgagctaaggaagtatttttattaaatggaattgcatttcatgaataatttaaattgaaaaaggattttaaaagtctgttttggctttgggccgaaagtcggccgaaaaccttctctctctctccttcggcccagtcggcccagtccagccgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatctttgggatctcctctaccttttctcttttggaatcatcgtctaactcgctttggaagttcatggatttgaggtcgaatcggattcctctctctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagc

SEQ ID NO: 52041 - DNA, 1501 bp, Oryza sativa
cacgttgcccaaggaaacgggcagctccaactggtaagcgacttccccgcgtcgagcaatgatacggaaaggacccacaaaccgaggtgcgagcttccctttcgtctgaaacctatgtacacctcgcaatggcgtgacccgaaggtacacaaaatcatccactacgaattccagattacggcgtcggttatctgcataactcttttgccgggactgtgccacctttagattatcccgaatggttctgactttagcttcagcttctctcaggatatcagccccgaacacttgttttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaattgggtacccagctcttcttggagcttcttccaaaagtgagaggtgaattggcttcccctatcagatacaattttcttaggaacgccatggagactcacgatcctagcgaagtagagctcagctagtttgttccctccataggtggtcttcacaggaataaaccgagccaccttggttagtcgatccacgactacccatatagaatcataaccgccctgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttccctttcaagtctaagtacatcttcgtactgctagggtggatggaataaggactttcgtgagcttcctgaagtatcagctgtctaagttctttgtcgtctggaacgcacacccgatttccgttccatagggttccgtgttcatcctctgtgaaaccagcggctttaccctatttcatattcttgaggagtccacgcatatccggatcattcttctgggcctcgcggatttgatcgagcaaggtaggcttggcttccagcgtagccaagaatccacgaccaactatgcttaggttcagggcttccatctgttgattaagtttggctggaatgccacggacgttaagagtgttgcaatggctttttcgacatagagcgtcggcaaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccg

SEQ ID NO: 52042 - DNA, 178 bp, Oryza sativa
ttatccaattattagaaggttgtaccagatgaagatgagcatctgaacgaactcctccaggtatggtggtgtttattctgcaacattttgtttcttttcaattttgtgaggattgtgcagcatttttttgatacgagattatctgaattacatattgaatctgaataattgcttcagg

SEQ ID NO: 52043 - DNA, 1185 bp, Oryza sativa
cctcgtccacccttccgtttcggtcgccgaccgccggaacgccgtcgaccccgtcgacccgatccgcgctgtcgccttccctcgctccgaccgccttttttgtcgtcgccgtcgacctagggtgagccatggaccgccgcctcttttcccccttcccttcccctctctcggccgccgctccgccgtgcctatggccgccgccggcgaccataggggcgcgggcgctgcctcccgccggctgcgccggccttggccgccctcgggcgcgtcgagtggctgccgcgtggggcccggccgtcagccgcccgcgcccttaggtgcggctgacgcgtgggacccacggcgccggccggtgtgagcccgggtgcacccggtccaccgtggaccgtgaggctgccgcgtggggtggacccggtccgctcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgggctttgttcctgcttgttatatggagtttattagagtaaaagccttttcttttccgttggtcgtgtagacgctgcagcttcggaagatccgctcttcgtggaagttgaagccgacgtttgggaaagggagcaaggcaagtcacatcatccttgaacatattgaatcccagtttataaagttattttgatttaaattactgcattatcgctttatttaaattcccgcgttatcactgttttatctagccatgcctatgtacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatagtagcacctcggccatataaggaccggt

SEQ ID NO: 52044 - DNA, 1501 bp, Oryza sativa
tactcagtcttgctcaatttttcccaaacccagaagaggagcccctggatgaggaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgttaaactctgaactgtgtcaacttttggtgtaccttacctcccgggacaaggaataatgcacacacgtaaggaacgcccgttgggttaattctggtcgtgacaatgcccatgcacaagtgtcacacttcaggttgtgtgcggccaaaaatcctttcttatttgtaaaaatcctttagtctctctctgtcctgctgcttcatttatcgtcaaaatctgatctttaaaatgttgcttttctcttttgtttgaagatggccggcagcatcaaccgtcgtggtctggacctgaccggcttcgttttggagctgcggggcatgtgcgttgtcttagggtattcgcatggagtggactaccagggcaagcagctcccggagcaggagggtgacgatgcagagccccacgctgcttgggaggttactgtagtgatcctcactggctcacccgagaggacttcgttggcagtcaccgtgggtggagattctttctccgccgcttgccagaacgccgctctccttgccatcggcactcttcaccagctctacccggacgagttgcagcactcgccctaccgctaccaccctcgccgcggaggagcccgcgactacgccaccttccgggatgctagctcggaggatgacgctaccatcaggcacctggcacgcatggtggaggcgtacgacgcggcccgtatcgacttccatcagatggtgcgtcgcgggttggtcgagaacaacatgaagatcctggagctgcgtcaggagaatctgcagctgaagaaggacctagacgcagtggaggcgcagctgcgtcagctcaagatcgcccagggagaggtcggtcgccccaagtgtcgccgcgtctgccgcagcctgaagatcactgcccgcaagagtacctccaggcccgagcttgttcgtcagtccctggcgtggacctgcttcgtcgagaccccttgtgccgagcccgcgcccgtggttcctcaggaggatggagcctccggcgttggcagcacggaggatgcgctgctgctcaccttccgccctggcccgtcgcagcagtagacgagcagttagtaggcttgcgtgtgtgttcttctcgtttgtttttctgctagagtcgtatggggcatggttatgccggtgtgtggtataactgtgtcggagcctgtctttattttatttgcttaagcaacttgaactttaatggaccaatttaatagcagtaataaattcaagaattatggtagtcgtgggtggttagttttaattgtcagctctctctgtttgctggttctgggtggggttttc

SEQ ID NO: 52045 - DNA, 1501 bp, Oryza sativa
ctaggcaaattttggcactaccaattttttggtagggcaaagttagctagtctatgtttggtttaataccaatataaaaccaaaatttagtatgagagtgaagaagattttagaatgtagccaaattgagcgtggacactaccaattgtttggcttcaatccaaactagcatatttactattaaagttactaaaattttgataaggtcacgttttggcttcaatccaaaacggccctaattgttttaatgaatcgatattgatgtgggtctcatggatatgccatatatttcggtactaattgggagcatgcgagtcaaagagtagcaaaacttatcagggttgggttttgtccaactggtactgataaagggtatcgatatactccctccgtcctataatataatagattttgattttttccttgtactgtttaaccattcgtcttatttaaaaaaattaaaattattatttattttatttgtgacttaatttattatctaaagtacttaagcacaacttttcgttttttatatttgcacaaaattttttaataagacgagtggttaaacagtacaagaaaaagtcaaaatcccttatattatgggatggagagtagtagtgaaagcatcaatcctattcatacaaaacctccttcatcctcaaatattacaacacagttaacaaaaatggcaatatagttgcttacatgaaaataagcacatcgatcgttcgtcttaggccgtgtttagatttttttttttgccaaaaacatcgcatcgaatgttttgacacatacatgaagcattaaatgtggacgaaaaaaaccaattgcacagtttgcatgtaaattgcgagacgaatctttcgagcataattacgccatgatttgataatgtgatgctacagtaaacatttgttaatgacggattaattaggcttaataaattcatctcatagtttacaagcggaatctataatttgttttgttattagtctacgtttaatactttaaatgtgtgtctatatacttcaaaaaatattttggccaagaaactaaacacagccttagactataaatcacgagataagaatagacaaaaatatcctttatacatattcagtggtactctctctatgccataatataggcacggtcaaacttagcacgatctccaaaataacttctatataaaattataaccatataaaactaaattgaaatatcaatgatattattttcagaaaataaaataaaatttatattatactaattattgattaaatattataaaaattaaattttaaaatacgtgcacgtcctatagagcggagggagtataattccagcagtcttaggaattctctcgtcgtaagaaaacaccttcgcatatgtgccgttccccgtgtatttggcccaatccctccctgcccagtaacggccctaaacatacagcaaggccgaatcggactcggagacccaatcccgcagcccgcgagcg

SEQ ID NO: 52046 - DNA, 1501 bp, Oryza sativa
aatatgatctaagcagtactgacgtaaaagagttttagataaatcatgtattttttaaagcacgggacaaataatctgtaaaagtaaccaattatcctaggcctccgtagatcaatttataccagtaaataggatatgccataccggcgtactttctccgttcctaaaaagtcaatttgtagatatgaatatgatatacatctatctagttcatcctggaagttagtccttttttctaagacaaccaactaggtacgaatatggataaaaatatggataaacatctgtctaggtttgtttctagaagttgttttttagatggagggtgtaccctaaaggtttgtctctctctctgagatggtgtaccccgaccattattttctcgatattaggaggaacgaaaagtgaaaaaccaagttggtaagataccgccagattacagctgatgcacctgtggaaaaccttgggtaactttcctgcggttcgggatgtttcagaattcagattgaaaacgttgtcttggacggacgttccaggaagattgcctctgcaaccacggatcatacatttccgcgacactgaatcatacacactttgtgctcctttttgctaccaacttacttgattattgcagttctttatttcactcgcaatgtacgatcgcagtgtaacatctgtagcggaggcaaaatcgaggattcggacctccgagtcgaaccgcactacacgcagtgcggctgtggaaaacggctagccccccatctttctacgtgtaatgttttgttttaacatggaaaaggggagctcattggatctatctaatctttttttaccactgtcttgatctggcaacaatgtactgacctgtcttgtctggtgtagtagaaatcagtgttagtggatgacttgtgaggcgcggcgagccaattgccgcgcggcaacacagaccacttaaggtagctcgagttctagcccaggggcaataacaatgacagaaatattcgtaggagacacaagaggggcagaggcttatcaggtatataacgaattgattcggattgatcagcgcatgaagaaacagccggctccaatcatccaaccggaagtcaattttagcatgcttgaatgcttatgtgtgcttcagtacttgagttgttgtctgaaagaaaatactatgttagtagcataaggggaacaaacgtaatcaatgaactggttaacacaaacgccacaagccggcaaatacggtttagttacagtacagttcatgtgcaagaaacttcagtaaggaaattactttggtctgaaaggatataagtacttaccaaaaattttggagcatgagtgccgcaaagtgtggaacaacaaccatgctgggcttccggactagttttttagcaccatggtgtcacaaaaggtgattcagggggaggcgaccgtgagactgcaaatatacaaatctgggaggcggcgaccgtgatacccgcaagaggtgattcac

SEQ ID NO: 52047 - DNA, 1501 bp, Oryza sativa
accctctgatataacaagtccagagaagtcctcatttgcccaatcagtggccattacatcaccttcctcatcggatgatgcgtcgtcgtccgcttgctcattatctgaatcttccctctccatttcatcaacaattataccgactatctccccctcatccgccatgcccatggcctgctcctcccttgtttgattttcctcattttgcatcgatggtccaacaacatcccctgcattgctagaaccctccacatcttcggtttgcattgaaacatttgtatctttctcttgtaccgacacaaatataacgaggggccatgaccattcaaaagccatttccacataccgtctccaagcagcagtgctgtccatcggcattagttcccaaaaataaccttctgttgcacgactcactacaatagagatactgacattgtgtagacttcttggtctattctaaatcctctcaacaaccaactataaattgactgaaatgttctctccgcaggcctatcgatgcccttagatgtcattacaaaatccgacagatcagcaccatctggaccaaatctaagatttccttcaccgtgaactatatgaaatgtgaccttatttgatattgtgcctgatgaaaacaataactacgttaacctcgcatttctgtactacgcactaagttacattctctacaatattgttctccaaaattctaaaagtaggttacgttttccagatcaaactaaagtacatcttacaattaacactactgtctatgtctcaattcatactattatattctgtgctctagatctacacatatgtgctgtgtgctacagatatgctaaaatatatggaactaaaactaaaacgcaacatatagtactcaaacataatatattagtacaaatgcaaaagaagtatgggagcaaacctgtgatgaagtgagcaaaccagtagggcttcgccgctccccttctgctgccatcccctctctctctttcctttttttttggatttttacagattataatgaaattttagagaggggggacggggttatataggagagaggcaaaaatcgccctcccccagggcggcaagggggccgcctgcaaaattccaggccccctcgccgcccatttgcaggtggccccccgcacagtgtaaaatcgccctcccccagggcagcaagggggccgcctgcaaaattccatgccccctcgccgcccatttgcaggcggccccccgcacagtacaaaatcgccctagcggagggcggcaagggggccgcctgcaaatttcgttgacggccgtcgcccgaaagcgaacggccgtctgccacgtcattttcgccgccctctgggatggcgatttttaaaaatcgccctcccagagagcggtaggcgactacttccgtcaattttcaaaatggaaaattatttttgtaaaacttttaataaaaaaaattaaaaataaaaaaaattccagttgctggtaggtt

SEQ ID NO: 52048 - DNA, 1501 bp, Oryza sativa
aagttaaaccttttcgccgcgcagctctggttggcaccaggcttgtacaggagaaatttcattccccagattgtttacacgagcaaaaacctggagaacagatctcttaaaaaggtcaatttcaccgaaagcacttaaccgattccaattctctgcaattctctgcaaaagatgcaatggcgagggtacatacattggctatatatatgtgatagcgatctcacctgttcggaatcaactggaaggatgtgcatcagcacgtcctccatgggaggagggccggcccgtgccagcagctcatcatctccaccatgaacaagtgcctgtttctggattggatttgggaggagacgaaatcaatcaaaaacccccctcacagcacagcatctactacctcgcacgggaagttgcggagaacagagtggaaatcgcgagttgcgcgcgtcttcgaccgtacctcatacatgtcgggaggagaagaaggcatcatcactccatagcccgcacggcgttcgttcgtggacaccccacctcccgccgccgccgccgccgccggtgacggagattgcgccgccgcgtgaggaggcagcagcgggtagggagggcggagatgaatcgattcccttcccggagaagggcggaggagagggctagggttcgcggttcccggcggcgaggatgctagggcatcgagaagggaacagcggccgcggctgccggggggacaggagagttttttcttttttcttttttcctttctcttcttttgtttttttcgtgagaaacaagcccatacatctggcttggtcggtggatgggccgggccgcttgtgcttcgtgggccgttgccatctgcggccgaaataagtccaccggcctttcctcaactttacgtcgagtccgcatgcgagaatgctattgggcgatcagtcgcgcgcctccctccccgcgcgactggagatgagagggggcggcgacgcgccgcgagcgagtttttcgttttttccttttttttcgtttctgtttgttttgtttttttctccggtttttatttttctgtttggatttttttctctggttttttctggtcggtttgttttttcccagtttatcttcttttggttttttctttttttaagatgtataaatataaagtttgtattcgtatatataccaagtttgtattcgtacgtatagaactttctatacgcgcatacaaactttctatacgcatatacaaactttctatatgcgcatataaactttttatacacgcatataaactttctataggtgtatacaaactttctataggcgtatacaaactttctatacatgtatacaaactttttatacgtgtatacaaagtttatatacgcgtatacaaactttctatacgttatgtattttctattttttttattttttagtacgtatacaaactttgtgtatgtgtgtatatattctttatgcattaaaatatattcgtatatatatatat

SEQ ID NO: 52049 - DNA, 1501 bp, Oryza sativa
cagcggctgctcgccctcgccgctgcctcgggaggcccgcctcgatgacgacgacctcgacgtatggctgacctcggcgagctcgcgacaacgttgacgggctcgggggagacggatccgttgacggtgggcgtagtagaagcggatccgtcgccgatgagcttgcggtggcgacggccggatgcgggtgggcggcgattttcgattttttttttatttttggtatttttggttccgtgcgggcggcattatttgactgcacgtgataatcgattatcccgtgcggtccacttaacccgaccgcacagaaaaataattatcccgtgcgggtgggtcgtccgcacgcgaaaatatttatttttccagatgcatggctctagacgggggaaacctccgtatggaaaaatcaatttgaccgcatggaaaaatagttttttaagtagtgattcgccccgctgtcagggaggaaaataatccctgcaaatggcaaaattcaaaaatttggccgcctccttagctaactggaccgccaccaattctgcctgcaaagagcattgtgagtagctggcgaatgaaaaaaaattccaatcctgtcgttccatttttccactccgcatcaaacctaccagcaactggaattttttttatttttaattttttttattaaaagttttacaaaaataattttccattttgaaaattgacggaagtagtcgcctaccgctctctgggagggcgatttttaaaaatcgccatcccagagggcggcgaaaatgacgtggcagacggccgttcgctttcgggcgacggccgtcaacgaaatttgcaggcggcccccttgccgccctccgctagggcgattttgtactgtgcggggggccgcctgcaaatgggcggcgagggggcatggaattttgcaggcggcccccttgctgccctgggggagggcgattttacactgtgcggggggccacctgcaaatgggcggcgagggggcctggaattttgcaggcggcccccttgccgccctgggggagggcgatttttgcctctctcctatataaccccgtcccccctctctaaaatttcattataatctgtaaaaatccaaaaaaaaaggaaagagagagaggggatggcagcagaaggggagcggcgaagccctactggtttgctcacttcatcacaggtttgctcccatacttcttttgcatttgtactaatatattatgtttgagtactatatgttgcgttttagttttagttccatatattttagcatatctgtagcacacagcacatatgtgtagatctagagcacagaatataatagtatgaattgagacatagacagtagtgttaattgtaagatgtactttagtttgatctggaaaacgtaacctacttttagaattttggagaacaatattgtagagaatgtaacttagtgcgtagtacagaaatgcgaggttaacgtagttattgttttcatcaggcacaa

SEQ ID NO: 52050 - DNA, 410 bp, Oryza sativa
gtgtcaggcgagtgatgacgctgggcctcactcaaagacaagctgtgatttagcttctaggcgagggcgcaagccagttttttttttggaagatagggtgagtccccacccaaaagaagagtaggtagaagtggtgcatgtggtatccccttagatataaaaggaggatcttgcccacttaagaaaggggggcgaaaagagagagaagagaagggaagacgggagctcggagagaagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccac

SEQ ID NO: 52051 - DNA, 680 bp, Oryza sativa
ccttaggtgcggctgacgcgtgggacccacggcgtcggccggtgagcccgggtgcacccagtccaccgtggaccgtgaggctgccgcgtggggtggacccggtccgcgcgcccccttccctcggctgacgcaataaacccttttaaaattagagtaaaatccttttcttttccgttggtcgtgtagatgctgcagcttcggaagatacgctcttcgtggaagttgaagccgacgtttgggaaagcgagcaaggcaagtcacatcatccttgaacatattgaatcctagtttataaagttattttgatttaaaatattgcattatcgctttatttgaatggcccgcgttatcactgttttatctagccatgcctatgtacctttgttatgaccttattattgttattgttattattaccttgttcaccctagaataaacaaaaccccaactagtggacactctactcatggtaccactagtatgattttaggtagatgcttcactggttaattaggcaacattaggtggttttacaactctagactttgggatattcatatcacctggacactatggaatggttggattattgtagaattggattcacacctccccctctattcaaaatcctcaaaatggttttaggctgggctcggggtgcatggttttgttagtagcac

SEQ ID NO: 52052 - DNA, 1501 bp, Oryza sativa
ttataaaaacaaaacctaacaagaaaataaactctacaaaccataaggtctaatttttaaatgttacaaagagatgaatggtagaccaaacaagcaaaaaaaaaagaaaagaaagaagaggtgacagaagtaaagagtagcaactggtgtgtcttttaaagactacgaaagtagaaacacaaggatgataaggtttggtcaatcaaatccttaagtcaacgagatagctatttaataaattttaagtaaaatcatattaaaaaaatgattttgtatgagtgctaccgcgcaattgtgcgggccacccagttagttatatatataatcaaatttaatccacgcacgaagagaccgaaatagcaaaaaccaattacgagagtgccagctctttctgttctcttggattggatttaaacttatactacaaaccactaaagttgtattgtagcaaatttaagatgtgattggaggtggctcaactgccctaaaagtagggggttgttttcattcttccatttttttttccttgggcgatcgtggcttcataggttggtgcaaattaacgacatgggaagggattgtggaaggccgagctacacaatcacaaaggaaggggatcaaaccgatagaaaatatttttgaaaatatccatttttgaaaaagatttacgtttatatacactagtataaagaatttgtgaaaatataactaatccgcatatcggttccgccggagcgcaacaaaagtatggcgtgacggcgcggagtggacggccaaggcgttcgcgcggaatggggcagcgggaccgagccagtcccgcatgccggtaacgcggagccagtacgctcccgcagcgccagtgtgcggaaccgcggcgcaacatttttttactgcgtggcgccgtgtttaatactgtttgacactgtttccagtactgttttacactgttcccgtgtcagttccgcacaatggagggacaccgagcatgaacagtgtgtgaacagtgctgcacagagtcaaaacagtgtataaactatgctgcacagtgctgaagtcgctggccactgcggttccgcgttttggaaccgcgggaccgtcgtggttccgcattttggagctgcgggaccatgacggttccgcgcgcagggccatcgatcctgtgttttgaatctacggaaccgtcgctgtcccgcatgtatataaacatatattattaaaaaaataagtatatttgtaattttttcctcgggttattagtttaatttaactttagttttttttttacgatcgagtgccaatagctgttggaggagtcaataattaataataccaacattttcaaatttaacaaaaacaatagtaaatatagcgcaaattatcaacttgatcgaggtggaccgatctagtgctcgcccctccctggccatccccatgccgagcgtgtagtagcactactacactaaatatttttttggacaccagactagtttgtttccaggcg

SEQ ID NO: 52053 - DNA, 153 bp, Oryza sativa
ccttaggtgcggctgacgcgtgggacccacggcgtcggccggtgagcccgggtgcacccagtccaccgtggaccgtgaggctgccgcgtggggtggacccggtccgcgcgcccccttccctcggctgacgcaataaacccttttaaaattaga

SEQ ID NO: 52054 - DNA, 1501 bp, Oryza sativa
cgttcccgggtatggtctctgtgtgagtctactgttgagctgtgtgctattgtagtttggcaagagttcttggtcaattaaggacttcacttcataagtcatggatctgagcctaacgtgcaagcacatgttctcatgggaagaacctggcccagtaggattccgagtcttggcactatcggcccaggtggctagatgataggagtttaggttcgccatggggactttcttgtctgtgtgagggaaaggtgtctcatgggggaaggcagtgttgggacggagtttctaaaaagccttgttacagtctccttggccacacacaacctgaagtgtgacacttgcgcatggccgttaaaaggacgatgtatcttgtgggtcaagctgtacaacctctgcagagtgttaattaatctattcgaatagccgcgtccacggtcatggacatgcacggtgatatctcacgaggggtcgtttgtgaaaactagaaatgaactgtgtgcaggttaatgaatatagctatgtggtcctgtgtggatggatagttggtaatacccattatttataactattattttaaacctgtttataaattgattataactacaaattgctgtgttatgcaaaatagccattgcctttgttgtcagctttgcatatgcatatttctgtgtgcttgctgagtattccatgtactcaccttgcaattcccctaattctagaagaatggttcccgctgtttcctgagtcccagtttgctgctgaagacgaggaataggtcatgagtcccagttgactgcctatggcaagttgaatggagctactacgcatttattatatttccgctgctactttaatattgtccttaggccctttgtggcagaataaatgtaaactttagccataaggcttaacacagtcattattattgttaaatattaggattccttcatgatgttggctgtgatattatctttgagtctgtgtgtgctagcttgatcctggactagcacttatacacaggaggtcctattttgggtcctcacagagttggtatcagagctgcgtcgactgtaggccgcaaccttagttagcctggtcttatttcaaaactgttttcaagaaacgcaaaacaatataatgtgttcttcctttccttgctctttcttgtcttcctcctttcggaatatcttcttatctgttttaatctctaccgtcagccatgggaggatgttctacatcagtgctgctttggagtcttgatgaagttttgtcggaaaccaggtttagttgtagaagtggtttttgtcgtaggaccactttgcctctagttagtagttcacgttagtaagacgttaagcttgggtgttagaagcgttgcttgtttttaatttttggttcttccggtttgttgtacggtatgtttgaagctcccggctttcaaacaatcgtacgtgtgtttcgttaggatgtgtagttctacccccttaggttgccttcttct

SEQ ID NO: 52055 - DNA, 1501 bp, Oryza sativa
actaaagttaaattaaactaataacccgaggaaaaaattacaaatatacttatttttttaataatatatgtttatatacatgcgggacagcgacggttccgtagattcaaaacacaggatcgatggccctgcgcgcggaaccgtcatggtcccgcagctccaaaatgcggaaccacgacggtcccgcggttccaaaacgcggaaccgcagtggccagcgacttcagcactgtgcagcatagtttatacactgttttgactctgtgcagcactgttcacacactgttcatgctcggtgtccctccattgtgcggaactgacacgggaacagtgtaaaacagtactggaaacagtgtcaaacagtattaaacacggcgccacgcagtaaaaaaatgttgcgccgcggttccgcacactggcgctgcgggagcgtactggctccgcgttaccggcatgcgggactggctcggtcccgctgccccattccgcgcgaacgccttggccgtccactccgcgccgtcacgccatacttttgttgcgctccggcggaaccgatatgcggattagttatattttcacaaattctttatactagtgtatataaacgtaaatctttttcaaaaatggatattttcaaaaatattttctatcggtttgatccccttcctttgtgattgtgtagctcggccttccacaatcccttcccatgtcgttaatttgcaccaacctatgaagccacgatcgcccaaggaaaaaaaaatggaagaatgaaaacaaccccctacttttagggcagttgagccacctccaatcacatcttaaatttgctacaatacaactttagtggtttgtagtataagtttaaatccaatccaagagaacagaaagagctggcactctcgtaattggtttttgctatttcggtctcttcgtgcgtggattaaatttgattatatatataactaactgggtggcccgcacaattgcgcggtagcactcatacaaaatcatttttttaatatgattttacttaaaatttattaaatagctatctcgttgacttaaggatttgattgaccaaaccttatcatccttgtgtttctactttcgtagtctttaaaagacacaccagttgctactctttacttctgtcacctcttctttcttttcttttttttttgcttgtttggtctaccattcatctctttgtaacatttaaaaattagaccttatggtttgtagagtttattttcttgttaggttttgtttttataattcttagaagtcccgtcaaacgttgtcattatactcatctacggtctatccgatgcctcatctatttattgtcattgggattttaaaaattgaatataattatcatttgggtttatttttttactttctagaagtcccgccaaacagtcagcggctttgtcactgtatttccctacggctcacccattgcctcctctctgtattgtcattgagatttttaaatcggg

SEQ ID NO: 52056 - DNA, 213 bp, Oryza sativa
caaaatagaagtgccagactgaaattcacatattatggcaccaaaaactaagggtgattctattgttttttttcttttgaattgctatcttatacctagtgagtcattggacattattgtaaaattctatccctttctttagaccatcatatgcctgtagctacttgtttttgaattctatttcattattcctgtaatattgtactttgcagg

SEQ ID NO: 52057 - DNA, 464 bp, Oryza sativa
tttctcccacaccagagctgaagatcttcctagttggagctgtcttgttagggttggtttcgtcgctgccgtcaaggttgcctgtggagtggagtcgcccgttgcagaagtcaagcttccaagtttagctcgttttatcttttccgctgcatttgtaatcttttatatttttgtaagacgtggatctgtatgtcaacaattatcgtttgtataccctggctggtcctggacagggatttaatgcacattcagcttagaaattcttgtttgtgaatttctgggcatgacacctgtgctccccccttctcccacgtagccggcgccctccccttctcccgcctcgccccggcgacctcctccccgcccgccggccggctgccaagagaggagaaaagtgaaaagtgagagagggagagagaaagaaagaggggaaagagaggggcgctgatgtggacaccctaaca

SEQ ID NO: 52058 - DNA, 755 bp, Oryza sativa
aaatcgccctcccccggggcggaaagggggccgcctgcaaaattctagggcccctcgccgcccatttgcaggcggccccccgcacaatgtaaaatcgccctcccccagggcggaaagggggccgcctgcaaatttccatgcccccctcgccgcccatttgcaggcggccccccgcacagtgtaaaatcgccctagcggagggcggcaagggggccgcctgcaaatttcattgacggtcgtcgcccgagagtgaacggacgtctgccacgtcacatttgccgccctctgggagggcgatttgcctcccagagggcagcggacgactacttctgtcaatttttgaaatacaaaattatttttgtaaatcttttaataaaaaaaattaaaaataaaaaaattcccggtttttctgggccaattggtgggcttccaagcaggccaattggtgagcccctcatacttgtcaatctggtcgtcgtcaccaacgacctgccggccacccggccgcgcgcgtttgatgacggacatgacatccaccaccaaccaaccgatcaatcgtgtcgcgccgcctcaactccgccagttcgccccctccacgtcgacccattcttgtagtggcggccacgacgacgcgcccagccatggcgatccatacaatatcccctcccgatcgaacttgctgccggccggctgcattgtctccggccttaaaactccagcaacacgtacgacgaacaccccgtcgacggcatgga

SEQ ID NO: 52059 - DNA, 1501 bp, Oryza sativa
cgcaaggtctccatttttttcttcaaactttccccacgctgtcctattttgtgtgatttttataggttggacctttgaaactagtaaggccgaccctatttgatttgttttttacttttgaattaccagaaaaaagcccgtgtattgcaacgggtaaaatccattttaatcttattattgttatatggtttagttaagatgaaatttatggaaattcacttggatatatatttttagaaaataatgagctgcaattaggagtccgttcgtctaaagttaccatgcgagttttcttatacgactccttctgtatttccaaaagcgaacgaacttaaaaaccgattcaaatacgtatatgtatttctaacagcaaacgaacttaaaaactgactcaaatacggatatgtatttccaaaagcgaacgaactaacaaccgacttatacatggatgacgtaccaaagtatcggtaaaaacatcttcaatttttataatagtagatattataatttatttatttacttttatgatgaccaacaaacatataataatatcatatttaaaataaaattttatatgtataaaattgtatgcataaagtttacatgttcaaagtatcaacgaataaagtttatataccaaatattttattataaagtttttttgtcaatttttttaagtataaagtttatatacctaatgtttctattttgtatgtataaactttttatatagagctttgatgtataatatttttgggccaatgtaaatacaaataaatgtgtgggtatttttcctagtttacacgtgggccacaagggagagggggggagtgggcagagcggtcaaccgcataatagacccttcaaagaaggctatttagtgtcccaaaatgttagcattgtggttgatttttttttccactggaccggcaaaagccagccaaaactttattgagatgcaaggaataaaaggtaacaaagtaacaagcaaggctattgaagaaaaaaatcgagaaaacacagtaaaccccctcccaacgctagaagtgaacactaaaaaaaaaaatttacaccgccatcctgatcaacatagcttcgtgtcaactccacaactcttccatgatcttatccacaacagtactaggcgaggaagatattgcccgaaaatcctttcgcttcactcttttcaaatgaaccaagtgaccaagattactatcgagttgaaaaaacttctgggttagtttggttagtggcctaaattgactttactaattttcttgtcaatgctaaattttagaaaatttagcatggctaattttaacaaagcatagctctgttaggattgaagtcaattttttgtttttttcaccttcatgttgatattctatacatcagtttaagattcagatcaccaagacatgcaaaagccaacatcttaattctttgataattctatgttttgcaactaataagcaattggttggctatcggcaaatgtggt

SEQ ID NO: 52060 - DNA, 1501 bp, Oryza sativa
ataagtggtcaactcgtaaacctacttagagcaaatttaatagtaaaccccactactagctccaattcatttatagccaatctaatagccaattcatacaatagttgcttactatactactaatatatggtcccacctgttatacacacattgcgtcttggagtccgtgctgcagctggctacagatctgtagcccgctgctcttctctctcatcttttatctcattaaaatatgtttacagctggctaatagcctgctattgtatctgctcttatagataaaattagtaggcaacctgcggattaactcacggttacctactaatttgatctattaatggttttaagggtcgatccacttgatgcgatacgccaggtcacaatgtggaaacctgcggattaccatttatttaacatataaataggtttatgagttagcccgtttgtatgcctagctaattttgtacactgatccgatcgaaaagaaaagaaggaaagctagcgcactgttaggttctttaaagaccaaaaggttaatacagtgcaccatcaatttaaatatttttattttgttgttcgatgtcgaacaatattgacttaaaaaaatcaattgttttatcaaatgtggacagactaacaaggactttgcagtaagaacaacacaaggcaaatgaacaatttttttttactgctaacagaactgattttacttctacatgacccaagggaaaaggcaggtactaacattagacctagaacaatcattccatcggccattcctaccgtcagagagtcttaagaaaagaaaaaactgtcagaaagttgagtcaggttactcacatgaccatgaacggtggcagccagcagccgatcgatcgaggacgcacagctctgcgctgagacacgcgactgctcgattgaaatcgaactacggttccctgaatttggctcagtgatctctcataaattagatttatttaatttttagaaaacttctatgcatatggttttcataaggcatatcgtttatcagtttaaaaagtagcatatgccaatagtgagatgttcatgatgatttcgttaatattaaaatatactgattcattgtttcagatgcgctaataaaagtaagatagtattaccatgtttttttaaagagaaaaaatgtacttcctccgtacttataaaggaattgaagtcgttttggacagcgactcgatctacaaaacacaactttgactttttatttctataaaaatatttattgaaaagtgatatatgtactacctccgtcccaaaatataacaatttttagctaaaaatgtttatattttaggacgaaggaagtatacttttatgaaagtatttttcaagacaaatctattcatataatttttatattttcaaactcaacaacttaagagttatttataatttatattcttaagatttgactcaaatattattttaaacgattttttttttaaaaaaatatggaggg

SEQ ID NO: 52061 - DNA, 1080 bp, Oryza sativa
cgtattgggttcttatatggactcctctttcaatattgcttatttttaattccaaatttcagttatttttcagattgtatttctacttggactcttttttttctttttctctgattaatgtgggaatttctagcctccacagcgaacgtggtgccttcttttcgagctgtcttaataatataactagctaggtggcccacgcaattgcgcggctagcacccaaataaaatcatatatttttagtatgattttaattaaaatttattaaatagctatctcattgtcttaagactttgaaagaccaaatcttatcatcgtcgtgtttttaattatatagttttttaaaagtcacaccagttgctacccattatgtcatttccttctttatttgcttgctcgatctaccactatttctaatcattctccttagaacctttaaaaattggatcttacagtttttagagtttattgtcatgttgggttttggttttataatttctagatgtcctgtcaaacgttgccattatactcctctatggcctgtccattgtttcttttctttattgtcattgagattttaaaaatcgaacataattatcgtttggcttcatttttactttttaaagtcccgccaaaccatcagcgactttgccattgtacttctctacggctcgcctgctgcctcccttctttattgtcattgagattttaaaatcgaacatgattatcatttttttttactttttagaaattccgaacctttaaaaattggatcttgtagtttttagagtttattgtcttgttgggtttcattttttataatttttagaagtctcgtcaaacgatgccactatgctcctctacggcccgtccgccgtctactattatggtcattgtgattctaaaaatcgaacatagctatcgttggaattcattttttattttctagaagtcccgtcaaccgtcggcggctctgcaactatactcctatacaccccgtccgatgcttctcctttttattgtcattgagattttaaaaatcaaatatgtttatcaatggggtttatttttttttacttt

SEQ ID NO: 52062 - DNA, 1501 bp, Oryza sativa
ctagtttgcttcgcgtagtttgttaatagtaaactgaacgctcgataaatacttttaccttaccaaattttttggagaactagtacataaacatgattctgacatcaaactaaaattcaaaccaaaaatcggtggcactgactagttcaacccaacaccactggacatcattcagaagttttttttttttttttttttaactaggagagccaagctctccccatttctattaccagaaacggaagctacaaaaaattcagaggatttaaaacaacatcgaaaacgacctgaccaggtgccatccaaccatagttgggggagacttcaggcatatacgaaaactatcttacaaccaactaatcaactactgcaaagagaaaaacaaacatagacatcaatcccagagtgatccaaagcagatcaccacccagatcagatcgaaaagcagaacttcagcttagcacacaaccacccaaagaaaaaaaaaaccatcgagcagcttcatgccttcatcccctacccttctcgcaatctcatcatcttgggactccagcaatttaaattcatctgccattcagaaaacaaatactcctagtacttatctaaacatgccatgctaatttcaaataggaaattgctatgcatatgacccaactatccgactgaatttgatcgacggctgtaaaaggttgcagtgcatatgaacatgctctccttcgattaatctatcgttgcatatatctagttatatatatgagttgtacaattgaggccacattcgtttcctctacaaagactagatgaagttttggattttcgcggtacgcatttcaaactgctaaacggtgcgtttcgtgcgaaaactttctatatgaaagttgttataaaatatcagattaatccatttttcaagtttgtagtaattaaaactcaattaaacacacattattaccacctcattttgcgtaaaacacttaatcttcaacttcatctttagaagattcaatcaccacctgagtcgtatatatagcagtactctttcaaataatctgtacataaccactgctgctttgctaacaggcgccgaaaggccgtccgtccgacaagtgggccagaccgataggtcggcctatatgggtcttattgggcctatttctccgcccaaagcccatctcagcgcacccgctcaaccttccccattttaccccctccactcgcccttcaatctcccactgccacctcggccccaccaccaacttacccaggaaacacccgtccgattcacatccaacgatccgcaacccaggggcaaatccgccattcgttccccacctcaaaccctagcctcgccgcatcccgactataaaaccctcccctctccgcgaaccctaacaccatccggcggcggcgcagcagcagcagaggtgagctcggcggcggcggcggcggcggcgaccaaccacaccggcgaaggagaaggagatccgtacagccgccgcga

SEQ ID NO: 52063 - DNA, 1501 bp, Oryza sativa
gataactaattggtgacagaaaataaagactattgaaagaaaagaccacctaaaacatatgacaagataaattaagtaatatgcctataaaggagtagagtggtggcggttgatacgacatataactgttaataaaataccaaatagaattctaatgacgattaaaaggagggacaacaggtaggtcgtgaagcaaatggactagacggttaccaggacgtctagaaagtaaaaaaaataaacaacattgataatcatattcgatttttaaaatctcaatgacaataaaaaggagaagcagcgggttgagtgtataggagtatagttgcagagccactgatggttggcgggacttctagaaaataaaaaataaattccaatgatagttatgttcaatttttaatcagagaaactcccacattaatcagagaaaaagaaaagtagagtccaagtagaaatacaaaatcaaaaatagctgaaattcggaattaaaaataagaaatattgagagaagagtcaatacaagaacccaatacgatattagttaatattcagaagaaaaataaaaataaaatctaaaattagcaaaaagaaaataagagttcaagtaggaatacaatttaaaattaacagaaattcgaaattaaaaataagcaatattgaaagaagaatccatataagaacccgatacaagattaattaaaattctgaataaaaaataaaataatataaaaaaagtaaaagagggttgagtaggaatacaattttgaaacaactggaattgaaaaataaaaatattaaaagaacaatatacagtattggttaaaatttgaaaaaaaaaataaattctgaaattagaaaaagaaaaaaaaatttccataaggaatacaatttattgataactaattggtgatagaaaataaggactattgaaagaaaagaccacctaaaacacatgacaagataaattaagtaacatgcctataaaggagtagagtggtggcggttgatacgacatataactgttaataaaacaccaaatagaatcttaacgacgattaaaaggagggacaacaggtatgtcgtgaagcaaacggacaaggcggttgctaggacttctagaaagtaaaaaaaataaaccacattaataatcatattcgatttttagaatctcaatgataataaaaaggagaagcagcgggctgggtgtataggagtatagtcgcagagccaccgatggttggtgggacttctagaaaataaaaaatgaattccaacagtagttatgttcgaagaatcccaatgataataaagagtaggcggcgggtgggccgtagaggagtatagtggcatcgtttaacgggacttctaaaaattatgaaaattgaaacccaacaagacaataaactctaaaaactagaaggtccaatttttaaaggttcggaacttctaaaaagtaaaaaaaaaccaatgataatcatgttcgattttaaaatctcaa

SEQ ID NO: 52064 - DNA, 1501 bp, Oryza sativa
acgtcgacgcgcgcttgtcaccgagccgtgtaccgctccgccggccacacgtggcgtggcccgtcggccatcgcaccgtacgtggaggcgaagcatcgatcgccgtctacagagactcctccggccggggccgcgcgcgagcgatgggtcccgggtcccgggcatgcatcgatcggggccgtaattcattcgccggcgtgcgtgcgtgcgtgcgtgcgcgcgcgaccgtgtgaacggcccggcgccgcgatagtacgatggctggtaggcggcatcagtgggcgcgggaccgggtgggttattccaggccctctcccgatcgagttccgtgattccgtctggtttcctccgctgatctccagggatttccgagcgtgcgtgcgtgcgcgcggatcggacgagatcgacccggggccgggccggggagcggctgcgcgtgtcggcaggcaggtcaattgagttgaggtgatatgctgttggcgtggtgggtcgtggacgcgcggggggatctcggatcgatcttgtgcgtgttcgtgcagcgcgcggcgcggggtggccggtggacgcgaacgcgacgtatataggtggtgtagcgcgcgcgggtggggttgggttacgtggtggagctgagcccggcggcgcgcggtttgttccgccgcgtgcgcgtttcagctcctttttcggcttcttttttggcgatttgattttgatgcctgctccccgatgtgtccatcgggtgtcggttctaccagagacagcggggccgggccgtgactcggacaggtttggagtttttcgcgggaccggtaacgtacgtaggtgctgcttccttcaaaaggtgggggtgagccggccggcgaatatgcacgcgcgtgtacccgctcgaatactcggtcagctaatgagatgatttgggcgtccgtggctcggtggcggctacgttcagattcagcttcatatgcataccgtacgactgtcaattgtcatgataccgacggttacctttttcgtcgggttgaaatataaatgctaataagatgcggcaatggtgttagcgtagcaaggcgaggtatctgtgtgaaaatgaggaggaattcatgacagagatgctgattgctgagcggtacatatgggctggcattgccgaccaaccggtgactagactaccatactggtacagtgctactcatttctgagcgactgttgttttgtcccatgcaggctgcaggctgacctgatcaattgggctgtcaaaaatgtccagcccaaactctatggtaacgcagcccaatataactacgctcttttgggcccatcaggtctctcctcaagttagagtcgaagaggcccacgaacaagccaatattaccccccaaatcaccgaaccggaagggatcatcaaaccccagaacgacacttccgcacagccctagggtttctgttcagcgaccccccgaatcgaatcaagagggaggtgccatggcgtcgcggccgtcgctga

SEQ ID NO: 52065 - DNA, 1501 bp, Oryza sativa
ccagaataattagttctgtcagtacatttgagtcaacataggctagttctgtaatcaaatttcagtcaaaaagattagttttgttagcaaatgttagtcagtaaagatgagctcaattttatatacaaacattctaatcaatggttagatctttctagataacatgagagctccaaaaaagtaccgaaattttgacaaattgacccttttagaaaacttattttaataatagaccatgccaaaaacttattataaaaataggccgtcgactcagcgccatagagattgacgctgaaatataactctttagcaccatatatattgcgctgacgtttcatcctaggtgataaaaatttgccaaggtcagaaggggtcagagctggcttgcttggcgctgagatattggctatctaaagtagtttgctggatcaaactagtcaaatgtgctcgcttcgtgtggcggctagaagcctaccatctcacctcatggtccacagttcatggtccacagttcgagttccaggttgtgtaatgtttgataatttgtttactaccaatcttatatattacagaatatttaagtattattaacttatatatttttcaaattattatattttaacaaaaaacgaaatacaaatatctaatttgtagttaatctttgattacaataatacgtatactatattattagtttctaattcataaaatattatattagtcttacaaattaggaacaacgaaatttgaaaacatatattgtatagcattaatacttatattcatcaaagggaaagatcttcataaaattttgaaagtatacggcatttaacatttcctatgtttcatgtttagaacaagaacattacgtaaacataagacatgataattttaaaataaacatcaggaggtaaatgtcaacataaattatatagtacatatttccatacttaggagtgaaaaaaccataataaaaatacgagagcatgtagtatatagcatttaatacttaaaatatatagttccagggaaaatgtgtagtttcaaaagaaaacaagagttagtaccgagtaggatttggtgaaaaaagatgaaagaaaaaaaacattgaaaaaagtaagagcagtagcatctaaccaccccaccagcagtgtacatgcagcagagtgttctgtagattttttttattgccaataactcagcgccaagtacattggcgctgaccccttctgacctgtcaaatttttgccacgtcggatgaaatgtcagcgccaatatctatgacgctaaaccgttatacctcagcgtcaatctctatggcgctgagctgacggtctatttttgcaataagtttttggcatagtttattcttgaaataagttttctaaaagggtcaatttgtaaaaaaatcggtagaaagtacccaatcaatataagtatgaatagacgaacgatttagaagaccattgtatagtgcaatggatagaagcagcttgacagt

SEQ ID NO: 52066 - DNA, 333 bp, Oryza sativa
cagtaggccaccgtaccatgcacagcacatgtaggaattatagcgttttacttccacatatgcatgagacagactctcctctcagttcttggagaatcctcccacagtggctgcacgatcagaagatccaacttttctagaaaacgcccaaaattgcgtgcaaatggctacttgcaaccttttgttggtcctaggaagaacgtccttcttggtgcatgcgtgacaaaatgattgattgatttgttcacgcccacgtactggccgtagctactagagtagcagctagctagccgcggacctcccttttcacgaactaatttccttgtccttaga

SEQ ID NO: 52067 - DNA, 517 bp, Oryza sativa
tgtgttttgacttttgaaagactactgttactaggttattccccatagtgtgtgcagtcgcagcgaggaagattggccatttctttgcgtggctcagtcattagttagtggatctcaggaagaaaggggagtgttctgtacagggtgaaattacatcaactactgaaaaaaaaaatccacctctctgaatacgcccgccatcttccatctccttgatgtccccaaacatccgaagtggcgttcgcgctttctgattgaagatcatttcgttcctttcgttccacaccgctcaggttaccagcgtcaagttacatttgttttggacctctaattgtttcttgaattctcttctcctagtcagatatcgctgccgccattaatttgttcccccctttgggaaaaaaaaatattttgagcttgtgccaagttagtcatgggtgccaagaggagctcaatgatccccgcactcttgctcctcgcttccttgtccatcttcaagctaccttgcttctccaga

SEQ ID NO: 52068 - DNA, 1501 bp, Oryza sativa
gggaactactatcttctttaacttggtgtttgaaaatgtgtttcctatcaaagaaagaaagccttctattcatgctttattgccaatgtagtgtatatgtgttttctagttccatattgtacttgctgagtatttttatactcactcttgtgttttatttggttttaggtacgcattgagaccgacatgcacgggcgggaagtagcacccttatatacacattacttgcacactatcaaactatattgcttatgtccataatgacacttaaattatatcatggttcggtcttgtaataatcttttagatatctattagtttctttccatggaattataaggaaggatcgcaccgtgggaatgatattattattagtagaacttataattgcctgtcgtggatgtccgtatttacaggggagactgccgaaatttctaataattttgggagttagtggtttgagtgtttttttggtgtggcactttaggtacgtggttacatggggtgttacattggcggtatagaattggcatttaataactaccagcatggatcgagtcaacttgggagaagataacgtccggacgatcaggatatcatacgggatacttaggctaaataccaatgcacgtggttggtgaagattccatatggcatacgatggagatattgtgtgcatatcgtgcatatggaatacgatggagattccatatgactcccttgtatacctctgaattttgatttggatcccttccatacccttgccgtcaattgaccgttagttgaccgtttaataggtatagaaaagtcagttttacccttcaatacatgaggaatatgtaaaaatttgtaaactatattgttgcaagtatagaaatttgttgtgtgattataatattcgtaagtttgttgtacatagaaattttaataaatattaaaaaaagtatgtgtagcattttctttaaatgataaacatatttttggaaagcattcctatataatatataggataggaaaaagtgttgaattaccgtaaaaaaatgctacatatactcttttaataagtaaataaatattagttttatgtcatgatgtaaaaataaactttgccatgaataataccttgtacaataaaatcatgaatacaataattttatatataacaaaattatacacttccaacaatatagctagtctgcaatttcctgatttctttcatgtgtaagggcaaaatggtcattatcataggaattaaacattcaactaacggtcaacaaacggaatgtgtatgaaagggatcaaaaccaagattcaagggcatataaggtagtggacaaaactcgggagcatagaagggattagctaaactttcagaggtatagaaggaattttctctatatacagagagggagggtgtgtcctcccggtattgtttcagagagagttgagttgagagaatagttagggtttcgagtttagtcgagattttggtgaggagtgc

SEQ ID NO: 52069 - DNA, 1501 bp, Oryza sativa
acggctttaccttttgtatagcatggttcattatagtgtgccagactgtgaagtggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttccgggcatggcaacatgtgtggaatcgtgtcttgtgggtacagtggtacacctctggccagagtaaaactattcgaatagccgtgcccgcggttatgggcgagttgagcaatgtttttcgtgattagtttcacactactcatcaatgttaataatgtgagaattaatttgactcctggtttggaatggataattcctagtttggaggtttgatctgtacgaccggggttggttgttcaggtttggttgggcctgagcagcatgggtgtgctgttcagtgttgattaaaattgatgattaattactctattgttttactactcttaaatctttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaaggatccagaaggaaaagacgtttggcttataccccagttgagctgcctgtgggagtggagctgaagccatcgctagaccgttaattcctctgctgtttttcttttctttgtaagtatgtaacgttattattaagatggatttgtatattaaattgtcagtttgtgtacctcggctgattcctggacgaggattttatgcacaaattagttcggaaattactagtgaatttccgggcatgacactaagtaatcatataagtaggatgtatgtatactagaagtataggaataggatctttctattttcctttccacttagcttagatagttatgaataagagtataaatactttttcttagtgtcactctaccctttgaatgatattaacccctgcctagactttggttattacaagtaatatataattattagtgtggttctctctattataatcttcccacgggattactcaaatatgattcccttggaatactcttgggtgaaaagctacaatggtatttccatgcacttgcggatgaactctgtaaccataatataccagaagtatttctcaaccattgctaggaattatatttcgagtaatataccagaagcatttctggcgccgttgccgtggaagattcataaaaaagattactataactaatactttatatttacctctgtataatcactgtcctttgtaggctaaccttggttgttttcacttctattgtggaaatagggtagtgcatgactggttttaacttgccggaaaatttcaaggaaaatccagaagttttctttcagagcttcaagccgcgag

SEQ ID NO: 52070 - DNA, 1501 bp, Oryza sativa
accactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgctctgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgtccatcgtgaactatcattaagccatcattaaattatagtgattcataagttatcccaatagtgtgctaatgtttctaagcagagctaagcaattatatctaatatctagttgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagagttgtttgggatctgtgtgacttgccttgctggccttggaattcttcaaattcttctcctgcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagatttaatcggattaaaacacttatattgattttaattgaattatgacgcaataatgaattatttttgaaaaggaaaaggaggattattgcgtcagcgggctagggtttcggtggaccgggcgcacggcggcggttcacgcgaacggacggccgagatcgacttgatccaaaacggacggccgagatcgatcggtccacgaccagctcacgggagagggcgacgatgacgtcagcggtgacgtcaccaccggcaacggcgactcggcggctcgggcgcgcatgctcgtcggcgaacggcgacgcttcggcacgaacggagggcaccaacgggtagagcgcgacgcggcgaactcaccggtgaccaaaggagcggcagaagaccaacagacggcgacggcgacgaggttaaaacggcggcggtcttccgcttgacgacggcgacggtgcttcggcggtctacagcgacggcgaaggggcggacgaggacggcgacgacttggcgaccacgacgacggtcttcccgagcgacggcgacgtctggaacggcggcggcgc

SEQ ID NO: 52071 - DNA, 1501 bp, Oryza sativa
ggattaatggtgctagagaaaataggcggcctcacacgaaaaaattttgctaactttgttctggggaggtgcatggttatttccctggttctgctggttctggagttgctgcatcatcatgttcataagctgtgcctgttgagccaagacttgggcaagtgtgggattctctccattgttgttgttattgttattgttgttagggccattcccgttgctgcgagtgagcaccatctggcatggacaggaccacaagaagagaaaccggggaaaactacttaggacagagaattaatttaacttttattgatcttaagtgggtttcattattacaaactgaagactctcacaccaccaaactcaccaactacctaacactcgaaagcaaacaaacgcatgcacttacatcccaccactgatgtaaatcacatgcgagacacacacaaccaaacttaaaacaagcaaactaacacaacgatctaagacaacgacttgacatggcattctagttcttccgagcatcggagttgattgaaggctcgttcggctcgtcttcatcatcttgagtggctccccactcgatcttggaatgggtgcgcttggattcttctacttcattatcacttatgttgacgaccggaggatctgctagggctggggtaacttccttctccaccacacggacctttggcgccaattgataacgagggacaaataaagctctcttccttgcggtaagccgaatcctggccttctgcggtggtgcttctcccttcaacgcggctagttccttctccaaacgatccaccttgtcttctagtttgcaaatcttaccacgattccggtcttcacgatcttgagccgctaacacagtctccgcacgggtttcatccatagcccacagcatctcaaccaaatgccttgtggtagcatcattctcaattccttcaatctcaaggtagctgccacgatcacttccctgtggttggcgaggatggtagcgatactcagtgtcggccaactgatcacaatagcgatcgcggagttctcctatagcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggctgtcccaaatcctatggcaaaggacatcgtacgcaactcctggacaaatccctcaacaccaaagaggtactcaggcttgtagcgcggcatctaaagacaagtgaaaggagggagttaagacatttatcaaattaatagcacaagtttttggattaatttgaataaagttagaaaatcaaagtaaaaggtaagtaaataaagtaaaccaaacttgcaagataagttgaaacagttggaaacaaggtcacaaattttgtacttttgaacaacaagtttcaaaagaaataaaag

SEQ ID NO: 52072 - DNA, 1501 bp, Oryza sativa
gccctctaaaaatattggaaaagtagaactgttctcctccctttctcttttaattaaaccaaactaatggcacatgcacttcataatctcttttaatggttctcattcaaaatttattccagtgtaattagtactgtacatctattactgtactaatggctcattttaccagcaaaagttttacaatattgctttatttaatcttgctgcaattaaataaatttcgcatgttaatttataactttcttttatttcttttggaacctgttgttcaaaagtacaaaatttgtggccttgtttccaactgtttcaaattatcctgcaagtttggtttactttttactttgattttccaactttattcaaattaatccaaaaacttgtgctattaattggataaatgtcttaactccctcctttcatttgtctttagatgccgcgctacaagcctgagtacttgtttggtgttgagggatttgtccaagagttgtgtacgatgtcctttgccataggatttgggactgcccctttttatgcccagattcctcatgatcgtcatgaagagaagtgccgagtcaaagtcactttgaacagtaatagtgatgaaatcccctcagtgatgttcgaagctggaggaagaaactacatccatgcgtgtcaggaggtggcaaggatcgccataggagagctccgcgatcgctattgtgatcagttggccgacactgagtatcgctaccatcctcgccaaccacagggaagtgatcgtggcagctaccttgagactgaaggaattgagaatgatgctaccacaaggcatttggttgagatgctgtgggctatggatgaaacccgtgcggagactgtgttagcagctcaagatcgtgaagaccggaatcgtggtaagatttgcaagctagaggacaaagtggatcgtttggagaaggaactagccgcattgaagggagaagcaccaccgcagaaggccagggttcgtcttaccgcaaggaagagagctctatttgtccctcgttaccaattggcgccaaaggtccgtgtggtggagaaagaagttaccccagccctagcagatcctccggttatcattataagtgatgatgaagaagaagaatccaagcacgcccattacaagatcgagtggggagcaactcaagatgatgaagatgagccgaacgagccttcaatcaactccgatgcccggaagacttagaatgccttgtcaaaccgttgtcttagatcgttgtgttagtttgcttgttttaagtttggttgtgtgtgtctcgcatgtgatttacatcagtggtgggatgtaagtgcgtgcgtttgtttgctttcgagtgttaggtagttggtgagttcagtggtgtgagaatcttcagttttgtaataatgaaactcacttaagatcaataaaagctaaagtaattctcggtcctaagtagttttccccggtttctcttcttgtgctcctgtccatgccaga

SEQ ID NO: 52073 - DNA, 1501 bp, Oryza sativa
ctttagacttcggtggaagttgggataagaatttaccttatgcggaattctcgtataacaacagttatcaagctagtcttcagatggctccttacgaagcactgtatattcggaagtgccgcactccgcttttgtgggatcaaacgggagaacgtcaggttttcgggacggatatcctgagggaagtagaagaaaaggtgaaaatcattcaagaaagattgcgagtggcccagtctcgtcataagagttatgccgacaatcgccgcagagatttgagttttgaagaaggagattatgtgtaccttcgtgtcacgcctcttcgaggagttcatcgttttcacaccaaagaaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctatcgaagaagctaatcttgaacaaatagaagtccaagaggatctgacctatgttgagagaccaatccgtattttggaaatagatgagagaagaaccaggaatccagttatccgtttttgtaaagtccaatggagtaatcattcggaagaagaatcaacttgggaacgagaagatgaattgaagtcagctcatccgcatctgttcgccagttcttccgaatctcgaggacgagattctgtttaagggggtaggtttgtcacaccctaaaaatcctaaatatataaattgttgtttaattggaattattagaatttattttaaaaagtctagaagagaagatctaattttaattaataaattccaatataaaatggggccagataaaatttcattaaatactgtgcttaattctataattcctagatttttctgggatttatatgagctaaggaagtatttttaataaatggaattgcatttcatgaataatttaaattgaaaaaggattttaaaagtctgttttggctttgggccgaaagtcggccgaaaaccttctctctctctccttcggcccagtcggcccagtccagccgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatctttgggatctcctctaccttttctcttttggaatcatcgtctaactcgctttggaagttcatggatttgaggtcgaatcggattcctctttctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagc

SEQ ID NO: 52074 - DNA, 1501 bp, Oryza sativa
gtgctcatgacaattaaggaccggttcacgagtttcggttgtgaaacattaaccgtgccaaccacaagccagcgtgggcaacggctttaccttttgtatagcatggttaattgcgggggcaccagactgagaaatggcggagataagcccacaggggtcgctggggagtccatgccttgtttataagggggtgattatgatccaggaatggtgcgctgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagatctgtacagccgggtgtggttgttcagaatggttgggcctatacaacagggtatgttgtatagcgttggattaatattgtttaattattacttaactgttttattaaattctcaaatgtttattaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtcaagctgcctgtagagtggagtcgtctgcgccgtttatcttatttttccgctgcatagatctttattgattgagaggaactatctacctctgtaatgacattttattcgcttattatttagagtaataattgaactctattatcaatttgttattgtgtgcctcggctgattcctggacgagggttcacacagatgtaagcgtttggaattttggatagaaattccgggcgtgacaagttggtatcagagccaggttgaccctaggttatgccaaatggttacccatagaagccctctaaaaatattggaaaagtagaactgttctcctccccttctcttttaattaaaccaaactaatagcacatgcacttcataatctcttttagtggttttcattcgaaagttattccagtgttattagtactgtacatctattactgtactaatgactcatttaccagcaaaagttttacaatattattttatttaaccttgctgcaatgaaataaatttagcatgttgattttataactttcttttatttcttttgaaacttgttgttcaaaagtacaaaatttgtgaccttgtttccaactgtttcaacttatcttgcaagtttggtttactttatttacttaccttttactttgattttctaactttattcaaattaatccaaaaacttgtgctattaatttgataaatgtcttaactccctcctttcacttgtctttaga

SEQ ID NO: 52075 - DNA, 418 bp, Oryza sativa
atgattattacaattttaatatgagattagtagccatttaatataagattattagacttagcatatatatatatatatatatatatatatatatatatatatatatatatatatatgattattacaattttaatataagattagtagcgatttaatataagattgttatacttagcatacatatattattattacaattttaatataagattattatagattaaatataagtttgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtatgcacaga

SEQ ID NO: 52076 - DNA, 249 bp, Oryza sativa
agcatttggcaggtggaggagaaggggatcacgatgaaccggtccatctgcttcttctccttgccactactactcatggctagctagccactgctagctaagctgatactatcttcgaatcaaatcgcttgccgcttttggctgaacctgtactggtatgatcatttctagtaaaagaaatgggggtcttgacccttgctcaaaaaaaaaaatcttggaatcaaatcaatgtctgcgacagcggccaga

SEQ ID NO: 52077 - DNA, 1501 bp, Oryza sativa
tcggtctcatttttgtacccatgtcaacgatataataaaatcttgcttgtgaatctattctctcgatgcttaaatatatgtttgctctggaaatagtcatattatatatttttttaaaaaatccatattgggtttaagaagatgttaagcatggccatagactgccatctatgggggtatggcttaaattgacctcaaatgttacctctaatcattttcatcagttctaaccaattactatgaagtttctctaatagttgaagctgcacactttggtgcttggatggaacatcaaagctccaagatgtgttggttgggtcgatagcccttgtgtcctagggaggtcgttttgtttgtttttttccttctttttcatttaagagttagggtgtgttaatgaaatgatacacttatcttcggcgtgttctaacaaaaagtatatatatcagagtatatatgctgtgggggttcatatacaacatgtcttcacattggcatgcttataagctaataacaatatgtctatttctaactatctgcaccactaatttgtttaatccataccaattgttaatttgtttaatccacaccaattgtttacatcactgattttggtatgtcataaatttttatattactatggatgtcctttatattttgatgttattgtatgcttggccttttaatgtggcactaaggggtggaaaacgtgctttgcatgtgcacgatgttttttaatgatctctataaaaatatgctttgcactcatatggagctttggaatttctgttaatataggcggatggtgcattgcatcttatattgtcactctaggaatagacgttgcaagttttatagagatcattcaaattatcatcccactatggtctatggagtgctgcataaaaaagtatcatttaatgttctattttgtgtatataatgtcaaaacgtgccttgcacgtgcacgataactagttatattttaagtaggaaaatctgccagatccgaagtggctttaataacatatcacataaggataagatatatgtatgctctgatgtgctattaaaactatatctcagcatataatctaccagattctgttagagtaaaatcctcaagatatgaaagtaaataatcgttaaactcttccatatataacatctactatgttctacgtatatatatgtgaaccatatataacatctacaccatatataaggtgttcaagaaaaggttcctttagtttttagcttcaattctagatatactataagttttgtcccttataaaccatgatttgtggaagtagtttatttgttctaatataaaatttcttagaaaaatattttatttatgcataaagttatttagtataatgattctaagacttgcaagggtccattgattaacagtaaggcatgcatgcataagcctgcctgtatgtagtcacgaagttatgtgactttagtatggcggtgattctagcatgatggaa

SEQ ID NO: 52078 - DNA, 238 bp, Oryza sativa
cgtggaatgacacgtggcgacacaaggcgatgcggtggtactgacatggttggatctagggctaaggtggcatatgttagggattatgtagatccaacggttgggatttgatctagggatttggacggctgtgattattttgagtttttggatggcaggtcccacacgtcagtgtcacagggaagaggaggagtagctgctccaccacaggcctgggcgtgctctggccatggcgcca

SEQ ID NO: 52079 - DNA, 451 bp, Oryza sativa
atattgatgttaatgaatctaggcacacatatatgtctagactcatcaacatatatatgaatgtggattgtgggcaatgctagaaagtcttataatatgaaacggaggaagtaatacttatcaattgccaaaacaaagccccaaattgggtgaaaaattcacaataattttcaaaatgttgcagttataaaagtctattgcgcggctacgggaaaaacagttctactaatgtaagttcaaagttaagaagctcaacagtattttcatcaataatgtaggttttcttgtagtaaactagtaatttagataagtgattgtggtatgctgcagatgagtggctctatcaaaattaacttttatagttttatgaccaagacaagccaatccattcagtgaaactaaaacaaatacagcaaactgccaaacaatttgttactatagcaatcactca

SEQ ID NO: 52080 - DNA, 302 bp, Oryza sativa
tccgaaactacacgcgaaacgggacaactcaacaaacggcgaaaataaggccctattaatgacctctcagcgtgccattagatagatctcgagattcgaggaattttggaagttgaacagagtcaaacggacttacggttgggaagatattgaatttctaagattattagatttttggtctaaaggaaaaaggatttaattaaacccttttggaaaagaaaaggaagatggaggggaagtagacttccctcgggcggctagggcgcggcccgagagaaaaggggcggctcggccgagctaaa

SEQ ID NO: 52081 - DNA, 362 bp, Oryza sativa
aaaaatgtaatcaatttcaacgccgtaccgcgcgcggtaccggtggctaattaaatctgctgactcttttagtcagctttttccaaatgattagacatctaagtaggcgctgagttaataatcaatctgatcagttgtttatccacctcctagctatcttccatgtgctgacagtgctggccccctcatggcctcatgtggctcagagtttctttcctaccaagaatttgcaaattccacatagatgctgatagccatggcatgcatgcacagttcattccaaattatatttttgtccatagattatcagactaatatctaagtagatccattttatgccggcaagtacggattactgaaca

SEQ ID NO: 52082 - DNA, 436 bp, Oryza sativa
ttcgatggagaaaaaccaaggaccacttagctactacctccgtcacattataaatccaactttgaccgtccatcttatttcaattttttttaaaaaaattaaaaacataagtcacgagtaaagtactattcatgttttatcatctcataacaacgaaaatactaattataaaaaagtttcaaataagacgaacgatcaaagttggacgcgaaaacttatggttgcacttataatgggacggagggagtaatacaaaagggaattatctaattcgatcgatcattttccgttttaagtggtgtttacgtagagcagtattaagcgagtgaaagaaggaaggaatgggcagatgcccccacgtacgtctgaatgaatgaatgaatgaatgaaaggcccaaattattagggaaggagaggcctaattaatctaaatcga

SEQ ID NO: 52083 - DNA, 940 bp, Oryza sativa
tcacctaaccacatttattgcggtttggctgagcgtgtcacgccgcatgtaacgcagtgcagtgcactagtttatccggtcagtgaccagtcacagaccggtcagatcgcgggttaggtggcgacaggcgatctgacacacgcctcgccccatcccgtcaggacgagggcttctaggcgctcgtccccagctggagctagcgtgttacctcccagagatggcacgttagtcctggtcagatatatgccaggcttcatcctaaccattgcaggcaagatgctgtgtgaagaagggcgaacatgtagattgctaagctgacacgtggtggacaagaatgaccgacgtgactggtctgacaccggtcatgtcgtcagcagacagccacgattccacatcgcacctgctcccggcgaaagtggaggtagttgtggcccgtctcatcagaaggtgactcggacggcaactatacaaatctccgtccatttatgaaaaggtggggtaagtccccacaaaaaaaagagagaaatggtgcatatggtatccccttaagatataaaaggaggaccttgcccactgagatgtggactggacttttccagattgggaacccagaacaagggagaggctggctcataccttgtagctccttcatacgcagatcacccaaaacacaggagtagggtattacgcttctcagtggcccgaacctgtatacatcgcccgtgtcttgtgtgttttcggtctagcgaaccttccacatacagagagcttagaatctcaccctgagtccccggccgaaccggcaaaggggggcctgcgcagtctcccggtgaggagcctcacgctccgtcatctggcgcgccaggtagggggctctgcgagggattttctgagctctcgcactctttcgtgtgcgccaagcttttcctgttcagcccaa

SEQ ID NO: 52084 - DNA, 302 bp, Oryza sativa
caccccctctcccgccggcctcatctccgccctctccggccggcaccagctgctgccgcgccaccgccgccgcccctcgcccgtcgccgccgcgctcaccgcagccgaactcgcgaaccgccgctcgcccaccgcgccccgctctgcctgccttggacgcgcgtcgctgctgctccccctatgcgccaaagaaaaaagcgattgagaagatcagtgctgactaggaatgttgagctcacatttttgtgtcatttacatgtgggccccacatattaattttttatttttttttgctaactagg

SEQ ID NO: 52085 - DNA, 1501 bp, Oryza sativa
ttggcgtagcgagccatggaaatggcgacgaatgcattgatgtatcggcagcatgccgcccgctgcgtgggatcagagcacgcggctgaagctaatgtgaagttggcccaactaaaatccaaagggcaatctgcagagaaacgcggtggatttagtagagagaaaagtagtgctagtaattgggaagcaacagaaaatgggtaagcgtctgatgatgtgcattgaatcaagtgagtaggaactcaggtagaagaagaaaacgtgcagttatcaagtgagtagcaattaagcggcatgaaacactgggcattatattcgtactacagaagatggggatggtatatagggttgggaagatcaaatcgggcatgagcagtatcgaaagcaggaaggcaggtagtgattagtacagtaatcagtcgcatggggagcggatcacaaatactgctactctgctagagtaaataaggcaatcgatggatggagaaggtaactgacctccgacggcggttgctgcggggttggcggagaagaagaagggggaggcgagcaggagcaggacgacggagacgaggccgccgcggaggaggggcatttggctggatggcggcgcggagtgtggagctcagctcagtgttgaaggagagagagtgaaggagggttttggctgcgccggccgaggttttcttcttcttgttttttttttttcctgaatctctccctctcttctcttgggtgtggtacaggtactacggtggtgacaaggaaggatttgcttttggggctctgcgcttttatgtgggtgtctccccgtgacaatccctatcttttgctaccacctgctcccaacacccaattgaaggcatgtgccacgctgaggattgaccaaagtttgttggaaacctactagtaataagtttgcctccaaaatttgttgaatttaagtagggtttgtcctgaactttggtgcaggctaaacaagacgggccggtatttgggccatggcaaacagtagaggcgagaaagtggagtccagcagagacagcgggtgggggcagcaggcaggcagccattctggcacaccaccccccactcagcgcagtccagtatcacatgcattgcattgcagccacctaatttagctgccagtgccactaacaatctctcgctcgctgccttggcttgattaattaagaccgctgtaataatgtacaccgacttattaccccacgcattagtgtgtgtaatagtagtatgccatcgtcccgtacaagcagtacgtacgtacaacaacggatcggagctagctagaggtagaagaagaaatccgatcccaacaaccgggcggccgtgtctatttctagtacgtgtgctccccggcttccccgcgactttgtcacagttttcaaccaacgatattatctgtgtgtgtgtgcgccgcgcgggcatgcaccaacgcgcgcaacggatgaaccatccgcctgcatcgatcttcctgcga

SEQ ID NO: 52086 - DNA, 1501 bp, Oryza sativa
attatttatttttttcatatcatttgattcattgttaaatatactttcatgtacacatatagttttacatatttcacaaattcttttaataagacgaatgttaaaatatgtgctaaaaagttaacagtgtcaaatattttgaaatggagggagtatacgttagctcagcaaaagcaggttcatgacctcaggtctcagtaggagatcctgaggacagatacgcctagctcaaagcctcaaacacacttgaccaggtacaagcatagtgagtagtgagtagtactatcaaacaagagaccagatcgagcaaggagctgaggccggagctagctagcatcgatagaacatggcatggcagctagagcatgagaacatgccacatgcattgcgtttatattcgagtgcattgcatctttcttttcccatccatgctagcttaggctgtgtttagtttcacgctaaaattagaagtttgaagaaattgaaacgacgtgacgaaaaagttggaggtttgtggtgtagaaaagtttaatgtgacgaaaaagttagaagtttaaagaaaaaagttgaaatctgtttgcctaagccatatatgatcatgaccagccccacatggagtgatgatggggatcgagatgcatggactggactggaattatttctccatctccgcgcgtcactctcgctcgtcgtcttgaacttcagagtttacaataggagtagtactccagataaagagtactagttattacttcctccgtcctaaaaaaacctaatccattatgtctagatacaaatctagaattagattttttttggacggagagagtactcctttacgaacacgagctgcctattatcattgcactgagatggttgtctctgttcatccttgttgactagctaatgacgacaagggttaagattagctgattcggatgcactgattgcgtggtgatgcatgttagctagcgtacgtccgtctcggctggagggaaggatatatatattcttgaaatcggttaattagtttgaggatgcatggcgacatgcatgcatgattgaacctgaaaaaagcttaattatggagtacaagtatatagcattgttggttaatcgagttatgcttttgtttcttttaagagcagcagaggagaggcaggcagcatctttggaaggtgttcctggccaaaataaataataaggggttgaatgccaccaccattgagtttaccttgaaccgggttaataggtaaccattaaccattaaggtgaaggcaggcttgtatccggttggtttttatccctttctcatctcaaagggctgaggaagaagagcctctgatgcaagctagctaggtaggctacctatggaatatatatattgggaatattgggatggcaagtgaaaggcaggaattgggaacagtgaggcacagtagagggaaacttccccaatgcaaggagaacaaagaaaaaggagaagcataaagcccatgca

SEQ ID NO: 52087 - DNA, 1501 bp, Oryza sativa
tgtaatttagaaatggataattgagtacacattctgcatttaacacgagtaactataaccgtaagcgcgactggagaactattatgcgcttgcccagcgttgttagtccaagtattgtgtttgtagcaggacagtattttgggatcttgatgctattgcttaccaggaccaagttgctgttgttttgatcttgtaacatggcattgatgtgttttgtttgtgttttttctgccagaatcaattggaagaggagaaggagctggcaaagcagcaacaggaattactcgatggaaattacaataagtacgacatgctggagaatgtcgtacagaacggaaacatgaagagcctagctcagcattatggagtcagtctggccgatgagttttgacaatccaatccatgagctgctcgctcactcataagtccggtctagttcccgccttcccggtgcagcaacatgcctaataaccttttttttttctctctccctctccctctccctccccacctctctctttcggcctttagggcagtgataaatcatgtcaatgtgtgagatgaagtaataatccaatgactggtttgaggcacgcattaggcgtgatcaaaggcatatcctttgtgtaaagatagttgcctgcctgctataatttatctggaggggctattgacaacagcactggtttcttccttgtgattctctgacgtcctgcgagatggttaccataagtatgtcttaatttatatgatgaagcctgcttaattaccaagcattgaactgtgctgtcgtatactagaagctgatgcttttcttgcttagtttcagagactcgtggatgtattgataagttatttcgaggaggagaaggcgtctgttgtaggcctgactgaagttagctgtagagtgtatggaactggaagtcttaaaattttggccttgtttacttccttgccattctcaactattcgaaattttggtgataccaaaatttactaagataacaaactaaatatgtcattaccaacacaaccttgcgaattattgataattctagaccattctactcacaaaactgctaccaatatttggtcaagtgtcaaactaaacactactactacacatctccacctgacctcttgaagtttcttttgttgaacgaagtgaacaagccaatcctttattttatatcacgggaactgatgttaaatatatatatatatatatatatatatatatatatatatatatatatatatatatatatatatatatatatatatatacgcgactagaagagtaattttttatccatctgaaacaatattaatagtggagtgaaaatgagaatattaaaacctgagcctaagccgtaatgggctgcattccgttcaatttgtgttgatgaaggcccagccgcccagggcaaggcccactggacatttggaacgccttaagaagtgaaagagaaggaaactgatctcatacatttagcgatgg

SEQ ID NO: 52088 - DNA, 1501 bp, Oryza sativa
gtgtacagtcgtcagtatacatatgccaatgattgttgcaaactaccagaccagcacatacggagtactactatacaatcaatcggtggatgtagatccattgatgtgcatagcgaggctgactaggacccgtccttccccaagtctccacaaatcccaagggcctgtttagatcacttgaagtttttcaccccgttatatcaaatgtttggacagagtattaaatatagataaaaaaaataaagtttgcatataaattacgagataaatattttaagcctaattgctccatgattttataatgtggtgctacagtaaacatttgctaatgacggattaaattaggcttaataaattcgtctcgcagtatacagacggattttgtaatttgttttgttattagtctacgtttaatacttcaaatgtatgtccgtacatccgatgtgacacggtaaaaattttcacccctgaatctaaacacagcctaaatcgccgccgccgatccatcatcagtggaacaccttggagacgttgtcaagcgcgtcgtctcgctgtcgactgaagctgctctgcccggacgtcaggcggcgtgcggtaggtatgccctgtcccatcaagatgatgggagacacagcagccggaacgtcattcccgcgcatccaagcctccattccacaaccattaaatgaagaatgacagggacccccctccatgttggcttgcgtcagccggcgtgatttgatggcctcgctcgacagctgatgctcagacgatttccaagctgtagcgcaagatacacatttaatatagagaatgtttgctctcttgctggacggcacgcccaactcatataataacctcttggagtaaaaaaggaggtagacgtctagtgagagggaggagaacaagttagaataggaacacttaaccctaacttgtacaccagagatttagaggctttcaaatatcagaaaaatcatcatacacaggagtagggtattacgcttcttagtggcctgaatctgtataatcccttccgtctcgcccactagatcacgtggtataatcccttctgtctcgcccgctagatcacgtgcccgaccccctcgatcccttctaatattcccagttcctcaacctacactcgctacccctagccgaactgaaaaaggaggggcctctcggtccccgaacaaggccttacgctgattcaatccggaccgggaatgaaaagtatagcaagaaatttatttatgatagatacaatgagatgccgggatttattccgggccaggaaccaatttactcataatagggacaataagagaccgggaatcaatccactagtcaagaggtgtggaactaattccggtctcttattgtccttatcataagtaaattgttttccgacccaaaataaatcctgatctctcattgtatctatcataaatttcttactgaacttgttattcccggtccggattgaatctaagcgtaatcg

SEQ ID NO: 52089 - DNA, 915 bp, Oryza sativa
cctgcagcccggagatgcataaactacctttttatggtcagcggttggtgccgcacaattgtctttaaattatttgtgtcaagtgattaatggtggttggaagaagagactctaattaaacacataggagtatgcaacatgtggttgcttgcaatgagggcttttgactgtgacatgtatactctgtaattacaagcagtagatggtaggtgtatgtgggggactgggagggaatggtagggtagggcagggcagaagaggtgagaggaaagcaagatccagctgcgagcgagtgcgagatggtgagctggctgggaatgggaaagccagcctcgcatgaactgtcggtccgtccggctctctctctcatgccgcaaccgacgaatcccggcacatcaccgtcacatggccataccagtgctctgctcacttccgtgtaacatgcaaccacccactttatacggaaaatttgcattttcattttcaccccccacattagcctgttaataatcctacagaataaataccagtagtactttcctccaatagatagtagtaggatataacttcatttatatagactaaaaatgattcttttttgaaggtataatgtgctacaaaccaagtgtaaaactaaatactaattatgcatggtagtgcaatgtttgtactccactagtagtgctgctagctagtatctgaaaaagaaactaaaaattagttggcctccagagtccaaagagcaccgacgctttgatccaactaacacacgctgcttcctttgctttcctattctttaattagccgcggccttcctgcctttgtcacgtactactagtgctagtcatcactgtattagatttaggaatctcttctctatagttattagtattactcctaccacggagtggtcat

SEQ ID NO: 52090 - DNA, 1501 bp, Oryza sativa
ccataggtagcctacctagctagcttgcatcagaggctcttcttcctcagccctttgagatgagaaagggataaaaaccaaccggatacaagcctgccttcaccttaatggttaatggttacctattaacccggttcaaggtaaactcaatggtggtggcattcaaccccttattatttattttggccaggaacaccttccaaagatgctgcctgcctctcctctgctgctcttaaaagaaacaaaagcataactcgattaaccaacaatgctatatacttgtactccataattaagcttttttcaggttcaatcatgcatgcatgtcgccatgcatcctcaaactaattaaccgatttcaagaatatatatatccttccctccagccgagacggacgtacgctagctaacatgcatcaccacgcaatcagtgcatccgaatcagctaatcttaacccttgtcgtcattagctagtcaacaaggatgaacagagacaaccatctcagtgcaatgataataggcagctcgtgttcgtaaaggagtactctctccgtccaaaaaaaatctaattctagatttgtatctagacataatggattaggtttttttaggacggaggaagtaataactagtactctttatctggagtactactcctattgtaaactctgaagttcaagacgacgagcgagagtgacgcgcggagatggagaaataattccagtccagtccatgcatctcgatccccatcatcactccatgtggggctggtcatgatcatatatggcttaggcaaacagatttcaacttttttctttaaacttctaactttttcgtcacattaaacttttctacaccacaaacctccaactttttcgtcacgtcgtttcaatttcttcaaacttctaattttagcgtgaaactaaacacagcctaagctagcatggatgggaaaagaaagatgcaatgcactcgaatataaacgcaatgcatgtggcatgttctcatgctctagctgccatgccatgttctatcgatgctagctagctccggcctcagctccttgctcgatctggtctcttgtttgatagtactactcactactcactatgcttgtacctggtcaagtgtgtttgaggctttgagctaggcgtatctgtcctcaggatctcctactgagacctgaggtcatgaacctgcttttgctgagctaacgtatactccctccatttcaaaatatttgacactgttaactttttagcacatattttaacattcgtcttattaaaagaatttgtgaaatatgtaaaactatatgtgtacatgaaagtatatttaacaatgaatcaaatgatatgaaaaaaataaataattacttaatttttttaataagacgaatagtcaaacacgtactaaaaagttaacggtgtcaaacattttgaaatagagggagtatatcctttcactgatatctcactctcatcaatagatcttgcacca

SEQ ID NO: 52091 - DNA, 1501 bp, Oryza sativa
acattaatcaaataaaaaaagatcttgatcacccaatatccataactaacgtaccatgtgaggatatacttatatagtacgtgtcgcaccttgtgaggagatacttatagagcgtcgcactatgttaatgcagaaaggatccaaaaaatatatagtgagtcatggacctcatggtagttgagaaaatggcccatgccacatgcgcacggcaacaaaaaaatttgatatatttgttattgggtttgattcgaaaaacgagttcaattttaagaagaactttggttggatacaagtttttccaaagcgtttaatagattctagttgttccttctttcttaggtacattcatccaactagagcttggagtctattctcttcattagtgatcataacaatgttttgtatgcatggttcctatactcctatgcacattgatgtacatgttctggtttcttaataacaaacaaatggaatgtagattgattcattgtactctccttttaacgcaaatagacatgcagcttatggtttccaaggagtcatattgaatattgagtgaattagctcctgccaaatctcatgcagcagcacataacaataacaagaatattaatctgacgagatattgatactaacagtaagagcacccgcaatggtaaagtaaggtgctctctataaaatatgtacatctcagcaatagacttagattaatagtaaactacctcaatagtatgtctacatgggtatctatagctctctaatccattgcctcgtttttctctatagactatctccaggttagtagatagttttgctctctctcttcatttaatctcttctaagtaggaaaatatgctgacatggatctcttgtagagaacatatagataaccattgcgggtgccctaataaaattggattacgtacttgtgcattggaagggaccataacgggaagacaaagaggaatcccaagatgtacggtagttgcgaatctgctcctcctcgtccacctcagtgtacttgtcctgcaactccaacttcacctgccgcaatttttcctccatctgcaccgggtccagctcctcctcctcaccgaacaccaattccgcgcacctcgaatccctacacccatcctcctcttcctccaacataggagtataattgttcatcctttcttcgtcatcctggtcatcgatcctccttgacttagcagcaaaggcctcctcctcctcacggcggcacttccggccttcgccgcctcctctccccttcgtctccgccgcctccatcgctaaatgtatgagatcagtttccttctctttcacttcttaaggcgttccaaatgtccagtgggccttgccctgggcggctgggccttcatcaacacaaattgaacggaatgcagcccattacggcttaggctcaggttttaatattctcattttcactccactattaatattgtttcagatggataaaaaattactcttctagtcgcgt

SEQ ID NO: 52092 - DNA, 1501 bp, Oryza sativa
cattgacatgatttatcactgccctaaaggccgaaagagagaggtggggagggagagggagagggagagagaaaaaaaaaaggttattaggcatgttgctgcaccgggaaggcgggaactagaccggacttatgagtgagcgagcagctcatggattggattgtcaaaactcatcggccagactgactccataatgctgagctaggctcttcatgtttccgttctgtacgacattctccagcatgtcgtacttattgtaatttccatcgagtaattcctgttgctgctttgccagctccttctcctcttccaattgattctggcagaaaaaacacaaacaaaacacatcaatgccatgttacaagatcaaaacaacagcaacttggtcctggtaagcaatagcatcaagatcccaaaatactgtcctgctacaaacacaatacttggactaacaacgctgggcaagcgcataatagttctccagtcgcgcttacggttatagttactcgtgttaaatgcagaatgtgtactcaattatccatttctaaattacaatttacaatgtcccggcgaaaaaattagtggcctaccccactattctcctgagcaatggtctgccaactgattcataactgcatatcactacgcagaaactatgctgtttaaggcgtactgagcataaaacaaacataagatggcgattcttagaagcagtgaaataaatagttcatctaaaaaggagtcactaatttacctttatgagtgccatattttctacttcttgcctttttgctaggatcctcaatttcttcattccttgatactctgttccatcttcttgttttacccaccggaactctttcctgatgccagggtgaggagggcgctcccgaaacatctcgggctttgcacatatagctcttacaggccttggcatcccgccaattatgaaagggaaatcattcatcaagtctagtgcagccttagcttgtatttcgtcatccaattccaccaatgcagcagaaggaatgtcatacgggactgtgtaattaacaatgaactccacatcgacaacatttggacattgggcaagagctgctttaattactgagctcgtgacttgaggggaaagatgatcaatatagatcgtcctcttgaccttcttctcgaaatcagcatacgccttcttagcatcttcatcggatgtcaccatgggagcaggggcggatccaacttgagaacccccaaactgttacttgtattctgaaattaaaagaagagtctcttccagatctagaagagaagctagggttaacgaacgaacgcaagaattatccagacaaaagtagtcccgatgggagagaaagatgaatcagaaaggcgcctctcctcccttgttttgttcagctgcgactcgtcttggcggcgcaaggagcggaggagacagattttccttcttttatgccgccaaggtaaggagaagatactcggagaatagcga

SEQ ID NO: 52093 - DNA, 1501 bp, Oryza sativa
agatacaatgagagatcaggatttattttgggtcggaaaacaatttacttatgataaggacaataagagaccggaattagttccacacctcttgactagtggattgattcccggtctcttattgtccctattatgagtaaattggttcctggcccggaataaatcccggcatctcattgtatctatcataaataaatttcttgctatacttttcattcccggtccggattgaatcagcgtaaggccttgttcggggaccgagaggcccctcctttttcagttcggctaggggtagcgagtgtaggttgaggaactgggaatattagaagggatcgagggggtcgggcacgtgatctagcgggcgagacagaagggattataccacgtgatctagtgggcgagacggaagggattatacagattcaggccactaagaagcgtaataccctactcctgtgtatgatgatttttctgatatttgaaagcctctaaatctctggtgtacaagttagggttaagtgttcctattctaacttgttctcctccctctcactagacgtctacctccttttttactccaagaggttattatatgagttgggcgtgccgtccagcaagagagcaaacattctctatattaaatgtgtatcttgcgctacagcttggaaatcgtctgagcatcagctgtcgagcgaggccatcaaatcacgccggctgacgcaagccaacatggaggggggtccctgtcattcttcatttaatggttgtggaatggaggcttggatgcgcgggaatgacgttccggctgctgtgtctcccatcatcttgatgggacagggcatacctaccgcacgccgcctgacgtccgggcagagcagcttcagtcgacagcgagacgacgcgcttgacaacgtctccaaggtgttccactgatgatggatcggcggcggcgatttaggctgtgtttagattcaggggtgaaaatttttaccgtgtcacatcggatgtacggacatacatttgaagtattaaacgtagactaataacaaaacaaattacaaaatccgtctgtatactgcgagacgaatttattaagcctaatttaatccgtcattagcaaatgtttactgtagcaccacattataaaatcatggagcaattaggcttaaaatatttatctcgtaatttatatgcaaactttattttttttatctatatttaatactctgtccaaacatttgatataacggggtgaaaaacttcaagtgatctaaacaggcccttgggatttgtggagacttggggaaggacgggtcctagtcagcctcgctatgcacatcaatggatctacatccaccgattgattgtatagtagtactccgtatgtgctggtctggtagtttgcaacaatcattggcatatgtatactgacgactgtacacaaggggaaatctcgaaagataagcatactcagctcctgatcgatcgatctcatcaatct

SEQ ID NO: 52094 - DNA, 1501 bp, Oryza sativa
aataggttttcatttgcaaaagcagcatttagcaaacatttgagaatttaataaaaccgttgagtaataattaaacaatattaatccaacactatacaacgtaccctgttgtataggcccaaccattctgaacaaccaaacccagctgtacagatctatctccaaaccaggaatataccattccaaaccaggagctaatcaaattattaccagttatagcatcttctaatatgatgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacattacccctcgtacaacacaatccactgcagtgcaccactcccggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggatttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccgaaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggtttattgcgtcagcgggctagggtttggtggaccggcgcatgggcggcggttcacacgaacggacggccgagattgatccgatccaaatcggacggccgagatcgatcgggtccacggcggctcacgggagaggatcccga

SEQ ID NO: 52095 - DNA, 1501 bp, Oryza sativa
tgaatttttaaagattaaatcggattaaaacacttaaatcggtttaaattgaattatgacgcaataatgaattatttttgaaaaggaaaagaaggtttattgcgtcagcgggctagggtttggtggaccggcgcatgggcggcggttcacacgaacggacggccgagattgatccgatccaaatcggacggccgagatcgatcgggtccacggcggctcacgggagaggatcccgatgacgtcagcggtgacgtcaccgacggcggcggcggctcggcgggcggggacggctcgggcggcgcatgctcgccggcgaacggcgacgcgaggacgcacacggagggcaccaacgggtagcggacggcacggcgaacacaccggcgaccaaaacgacggcggagaggcaacggacgacgacggcgacgaggaaggggcggcggctaccttcgggttgtcgacggcgacgatgctccggcggtctccgacggcagcgaaggggcggacgaggacggcggcgacttggcgatgacgacggcggccttcccgagtgacggcgacggctggaacgacggcggcgcacggctggagcggcggcggcgaaggcaaagctagggcacatggcgctagggctactccggcgacgagaggcgaaggcgagggtggcggcggaaagagaagagcacggggatccttttaaaggggctcggaggcgacggcggaggcccacggcgacggcaacggcgaaggaaactcgcggcttggaaagagggaacccgatccgaatcgaacttgattccaacgctttccaaagcgatttagccgatgattccaaaggagaaaaggtagaggagatcccggagattgtttcccctcaaccaattcggccggagaaggaaagaggcggccggatttggaagggaaacggcggcggcgcgaactagggtttcggcagcggcggcggctcggcgaagacgaacctgacaggtggaccccacctgtcagcggcagcgggcgcgcgcgcggcagtggactgggccggctgggccgaggagagagagaagagaggttttgggccgactttcggcccaaagccaaaagaagactttttaaaacttttttcaattaaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatattatttgaattttcagggtgtgacaacaaataaaacattggctttcacatcaagaagagatacatgatgaggcttgtgaaaataatatatcgttgcctttatttgttggtaagttcaatcctacagattatattgattgggagttagtagtggatgaataactt

SEQ ID NO: 52096 - DNA, 1501 bp, Oryza sativa
tgaatcatttaccgtgccaaccacaagccagcgtgggcaacggctttaccttttgtatagcatggttcattgcggagcaccagactgagaagtggcggagataagcccacgggggttcgctggggagtccataccttgtttataagggggtgattatgatccgggagtggtgcactgtggtggattgtgttgtacgagaggtaatgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatattagaagatgctataactggtaataatttgattagctcctggtttggaatggtatattcctggtttggagatagatctgtccagccgggtatggttgttcaggatggttggcctgagcagcatgggtgtgctgtttagtgttgattacaattgatgattaattactctcctgttttataattctcaaatgtttgctaaatgctgcttttgcaaatgaacccctactatgccatcctttgttatcctgtgcacttgcatatttgctgcgtggcttgctgagtatgtcatatactcaccttgcaatcattcatcagaggaggagatctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagccaggttgaccctaggttatgccaaatggttacctacaggagccctctaaaaatattggaaaagtagaactgttctcctccctttctcttttaattaaaccaaactaatggcacatggacttcataatctcttttaatggttctcattcaaaaatttattccagtgttattagtactgtacatctattactgtactaatggctcattttatcagtaaatgttttacaatattgttttatttaatcttgctgcaataaaataaatttagcctgttgattttataactttcttttattttatttcttttgaaacctgttgttcaaaagtgcaaaatttgtgatcttgtttccaactgtttcaacttatcttgcaagcttggtttactttatttacttaccttttactttgattttctaactttattcaaattaatccaaaaacttgcgctattaattggataaatgtcttaactccctcctttcacttgtctttaga

SEQ ID NO: 52097 - DNA, 961 bp, Oryza sativa
atatgcatactctcctttaccttcatgcatgaagccccaatttctttttgcaaatcaaattaacgtgcaatctccaatattacttccaatattacttgatctgaattgatgggctgcaaaggtcttatatttgcacatcgtgctccatgtggctggctgcagaggatagggtgaagtccgccggtgatggaggttgtttgctatttttcttttactcgtcatatctatgacatgaacgagaatgtttttgtatttttttcgtgcttgctagatgatggatgtctgctactgcacaacattgcgcccatctctataccatgccgctacacccttccatgattccatcgtcgactaccacttgccatccggttgccctcttcactacctgtcacaagacacggaccagcctctccatccttatagcaagatccagcaaagccatccggatcctagtttcatgatggatttttggctaagtcattttttcttttctagtttgattcacctgtgactattttttatcacttgtgtgtgattgagcctgtaattttttcattcatacgaccattttgtgatacagattaataatactattagtatcagtttttactcttatagtatgtactgaatacatcagcagggacggatttaccatacaaggtgtgggggccctagaccccactcataaaatactggcaggtatatcactaattgtatgacatatgggcccccagttcaacagataagaggaccccactctcctagtttttgttccttgcatcgaatccacgcgggtgttgaggacttgaggcgtcgaacatccactaccatcctctcgttaatcccgcaaattagctcggcaaattaggaatcaggcgttaatcccgcaaattagctcggcaaattaggaatcagggaacggaaagcgagcccactgtcatctcgtcgccctatgggcagg

SEQ ID NO: 52098 - DNA, 1501 bp, Oryza sativa
ctaaactgaacacaagcatcacaactcgtcctagtagtgtctagtgatgacttagtctatcgttgtccttggttactacaaactatatatttctagtatatagttccatcgactcggtgctttgcttggctctttctaatactgaacccaatcttcccggcataggtgttgtacatatcatacgctttctgctttgaatcaaaagccattccaacttgaggcaagatcaaagtttgtgcaactttatcattggcctgttgtacgataaatgagttatattaccacagtatgagatattctgttttccatcgaatttgctattaaattatcgttacctgatttggtgctttatctgccatctcttcaggtactatgcgacagagtgtgttgtcatcaccattagcgttggcatcgatagcgccggcaacatcttcttccatggtcataaactcggagatctgtgcaagatgatcatgcacgatatgatcacacatcggtacgtataagccacacatcagtatttgcgatgagggcatgtaagacgatcactcacgatcatgcatgcatgtactgatgaaaaagcatgagtcaattagctaggcaatgtacctgcgttctctgcttgccatcggctccacgatccccaacgattacatcgtgttcatgtgaagattgtcctgccatgtcgtgcgctacggcaggcaaaggctgcaccagatcagacgacggcaccagaagcccggcggcgcctgtgctcttctgctggactcctcgtcctgccatgtagcgaatctgttttgctctaatcgtccgcctctaatcacgccctacccaatgtaatcctgagccgcgcaagtcgagctgagggagaacgacctgagtcgagccgtgcaggatgcggactcgcttgtgtgggccggccgtcggatgagcgcctcatccacgcgtcatgcatccgcatcggggctgcacggactgctgtttgcatctggtttgcaccagatttttttttccaaaaaaagagtgctaactcagtgcgatggatcctgcatgcattccacgtttcattacgtactctctttctattggtatcctctctacccaagtcaccaactcaccaccattgctttctacatcgcctctcgtttgggaagacaacttccacactcccagccatagcggcatacacggatgcatctagcgcacccaccgcagcaccgctacggcgctccctcatctcgatcccccgacggagacctggaccgaggaggtgaccgtcgccggcgcatccccggcttccccgcacgagtgccgactgcgcccgtgcatctcccgactcggctgtattctcttgtccctccacagatccactcccgaagatgcttgccttctgttgctgaagatacgtgctggttggtgctgctaatgcattcttgatgttcttgtgtacctgtatagtgtgtccgtggatccggccgcgtagatcgagcagccatcgccc

SEQ ID NO: 52099 - DNA, 1501 bp, Oryza sativa
tgtgagccgccgccgtgcacccggtccaccgcaaaccctagccgctgacacaataaaccccttttcccttttcaaaaataattcattattgcgtcataattcaattaaaacccatataagtgatttaatccgatttaatctttgaaaattcataactaattcatcttagctcggatttagttggttcaagtctctaaatttttctaaaattgggatctacatgttaaaaatatccacatgtactgttcatgcttgtttatgtgctgtttggtgattttgatcctttctgtttagattccgacgtttccggagagtccgtttttgcaggagaagaatttgaagagttccaaggccagcaaggcaagtcacacagatcccaaacatccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatacgattgcttagccatgcttagaaacattagtacactattgggataacttatgactcactattgtttaatgatggcttaatgatagctcatgatagttaatcgtgattggttaattaattaatttgtcaactaaaacttgataatggtgggttgtgagcacatggttttgatggtcgtgctcatgacaattaaggactggttcacgagtttcggttgtgaaacattaaccgtgccaaccacaagccagcgtgggcaacggctttaccttttgtatagcatagttcattgcggagcaccagactgagaagtggcgaagataagcccacgggggtcgctggggagttcatgccttgtttataagggggtgattatgatccaggaatggtgcactgtggtggattgtgttgtgcgaggggtactgtcacagcccctttctgaggtaccgtggtggtattgaggcgcatggtgacatgttgtggggctgtatcttgtgggtacagtggtatacctctggccagagtaaaactattcgaatagccatgcccgcagttatgaacgggtctaacaatgtctttcgtgattagtttcacacttctcaccataataaaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattactacttaactattttattaaattctgaaatgtttattaaatgttgtttatgcaaatgaaaccctactatgccatcctttgttatcctgtgcacttgcatatttgctgcgtggcttgctgagtatgtcatatactcaccttgcaatcattcatcaga

SEQ ID NO: 52100 - DNA, 1501 bp, Oryza sativa
gttatcctgcatttgataattattgattacctacgatactttgtcaccttagtctttatgagttgaatattgggctcaactcaaagtaaagtagttatgcttagcctttctgaaggttgttttacaagcaaaatataatttgtattaatcatatacttataattacttttatatgaattgtgtggctgtgtgctatctttttgtaaacaacaggtggacaaacgtattggattggggtgatgggtggttctgtgtgaacctggttaggtagtaatgtatgtgtgtgattgttacctggtatggtctctgtgtgagtctactgtcaagctgtgtgttatttagttgctcaaagggccaactaagtgtccttaagctgctaccctatgctattgtagttttggcatgttgtcctgatcaattaaagactttatttcataagcgattgatctgagcgtaacgtgcaaccacatgttctcatgggaagaacctggcctaataggattccaagtcttggcattgttggcccaggtggctagatgataggtgttaaggttagcgaaaagtactttcttgtttgtgtgagagaaatgtatcttatggcgaaaggaaatgttgaggcgaagtttctaaagagccttgttacagactccttggccgcacataacctgaagtgtgacacttgcgcatgaccgttaaaagaacgatgtatcgtttgggttaagctgtacaacctctgtatggttaaattaatctattcaaatagccacatccgcggtcatggatgtacttggtgatttctcatgaggggtagtttgtgaaaactgggaatgagctttgtgcaggttaatgaatatagctatgtggtccgatgtggacatgtcttgtgtggatggatggttggttacacactatttataaatgttgttttaaacatttgtttataaattgtttataaaatagtcattgccttctttgtcagccatgcatatgcatatttccatgtactttttttattccatatactcaccttgcaattcccctaattccagaagaaatgtttccgctgtttcccaaggagtttgttgctgaagatgagtaggacatgtgtcccagttggccgcctgtggcaagttgaatagaacctctattcgtttatcttatttctactgctactttattattttcttaggcccttcgtagcaaaataaatgtatacactactagaaaaatcatttgttgccacgaaaaaaatcatggcatcaatactaaaattgtggcaatagatacatgttgccacaattgtaaaatcgttgctagccgtggtaataaacagcatggtaataggttattgcaacgatttttattttgtggtaataaatttaaatgttgccacggaatggatgtggcaaaaattcatattgcaacacttcacattgttgcaataaaaattattgccaccactccatatgtggcattagttttacgtaccaaattaaaagtt

SEQ ID NO: 52101 - DNA, 1501 bp, Oryza sativa
gactcttagtgtttataaaagaaaacgttgttccatgccgatggatcggagaaaagaaaaaatataataaaaaatgttttagtgcattaatttttagtcttttatcgtctcaattgtattgtcattaatcaccaaaataaacttaagtgcatagattgattttcacttagaacatgtccttatctcaattattttcagcacatctaaaaaaaattatgcatcagcttgcctaattcttttaagatcttttattattacactttccagtttaatatgatgtataaggaaaaattttagagattagctaaaaaactgtcgagtgctttttaagggggaaactttcaaatctagctatagtatataatttcactacaactatactataataataataacttatatatatattaaaataatatatgcaactttatatctaatttatatagagataacaatgtagtatgtagttatagtgtagttacactatagttacaatgtaattacaatgtaactacaatgtaactacagtgtaactgcaatgcaacaagcatgttactagaatgtaacttagatgtaacttgaacagatctaccataaacatgtgatgatgggactagcttgtgaaaagaggatttagatccgatagcaaaatatctcagcacaaatcttagcgtgaaatcaacggcaaaaaaaaaatgacagtttttagtcctgaaaactgtcacagttagctagcaaaaccgaaaattttattgtactctcccaaactattatattcttccatatcctcataaactactattttttgcctcagttgtactttaagttgaattttctctttaggataaactttatcttgagatttttaatcatttttttcacatgctagaaggagacttatttaaatcaaggggagcgggggtttctaaaacaacaccaagctgccatgacaactttaaaaaatattgttctaatgtaggatatacttggtcatataggatctataaaatttcaacttaaaacatatcaaggagaaaaatatatgtcccagtttaggggtacttttaagtagtgttggaggtaaaatgagataaaaatatatattttaaaaagtcaaaacaatttttttgtctttaaataacttttggtatctcaaaacttatagcaagtactgtggacatctaattacatatccctacatgacacatagaattaaatggtgaggtgaagggtagcagagaggagtgggagaaatagagtcacctctcatgtaagaggcacgctctacacaaaatcaaaaactgaaaatgaatagagtagttcttgtgtattagataattaaataactattgtgtatgcaattgtattgggtacaaatgcataattaaaaaaaactatattgtgaattggagttgtatattatatgtagcggtagtgtattgtatatgttacagtagatgatatggataaaattagaggcaacaattatctctactataaa

SEQ ID NO: 52102 - DNA, 1501 bp, Oryza sativa
ggcatagtagggtttcatttgcataaacaacatttaataaacatttcagaatttaataaaatagttaagtagtaattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgttcataactgcgggcatggctattcgaatagttttactctggccagaggtataccactgtacccacaagatacagccccacaacatgtcaccatgcgcctcaataccaccacggtacctcagaaaggggctgtgacagtacccctcgcacaacacaatccaccacagtgcaccattcctggatcataatcacccccttataaacaaggcatgaactccccagcgacccccgtgggcttatcttcgccacttctcagtctggtgctccgcaatgaactatgctatacaaaaggtaaagccgttgcccacgctggcttgtggttggcacggttaatgtttcacaaccgaaactcgtgaaccagtccttaattgtcatgagcacgaccatcaaaaccatgtgctcacaacccaccattatcaagttttagttgacaaattaattaattaaccaatcacgattaactatcatgagctatcattaagccatcattaaacaatagtgagtcataagttatcccaatagtgtactaatgtttctaagcatggctaagcaatcgtatctaatatctagctgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggatgtttgggatctgtgtgacttgccttgctggccttggaactcttcaaattcttctcctgcaaaaacggactctccggaaacgtcggaatctaaacagaaaggatcaaaatcaccaaacagcacataaacaagcatgaacagtacatgtggatatttttaacatgtagatcccaattttagaaaaatttagagacttgaaccaactaaatccgagctaagatgaattagttatgaattttcaaagattaaatcggattaaatcacttatatgggttttaattgaattatgacgcaataatgaattatttttgaaaagggaaaaggggtttattgtgtcagcggctagggtttgcggtggaccgggtgcacggcggcggctcacagaaacgaacggccgagatccatccatccaaaactgacggccaagatccatcggtccacgaccgggccacgggggacgacgacga

SEQ ID NO: 52103 - DNA, 1501 bp, Oryza sativa
aggtgataaatttttcatttgaaatcttttagatattcaaatctcagttagctaggctcaaatggaacgatatgcattttccaacagaattgatgcgtaggtgagttggtaaaggagagcatgcgtgaaggataggtcttgagttcgaatcctagccaagacacaaaatcaaaaaaaataagtagataaatagataggatgatagattaatatttgaacttttaatttggtacgtaaaactaatgccacatatggagtggtggcaataatttttattgcaacaatgtgaagtgttgcaatatgaatttttgccacatccattccgtggcaacatttaaatttattaccacaaaataaaaatcgttgcaataacctattaccatgctgtttattaccacggctagcaacgattttacaattgtggcaacatgtatctattgccacaattttagtattgatgccatgatttttttcgtggcaacaaatgatttttctagtagtgtatacatttattttgctacgaagggcctaagaaaataataaagtagcagtagaaataagataaacgaatagaggttctattcaacttgccacaggcggccaactgggacacatgtcctactcatcttcagcaacaaactccttgggaaacagcggaaacatttcttctggaattaggggaattgcaaggtgagtatatggaataaaaaaagtacatggaaatatgcatatgcatggctgacaaagaaggcaatgactattttataaacaatttataaacaaatgtttaaaacaacatttataaatagtgtgtaaccaaccatccatccacacaagacatgtccacatcggaccacatagctatattcattaacctgcacaaagctcattcccagttttcacaaactacccctcatgagaaatcaccaagtacatccatgaccgcggatgtggctatttgaatagattaatttaaccatacagaggttgtacagcttaacccaaacgatacatcgttcttttaacggtcatgcgcaagtgtcacacttcaggttatgtgcggccaaggagtctgtaacaaggctctttagaaacttcgcctcaacatttcctttcgccataagatacatttctctcacacaaacaagaaagtacttttcgctaaccttaacacctatcatctagccacctgggccaacaatgccaagacttggaatcctattaggccaggttcttcccatgagaacatgtggttgcacgttacgctcagatcaatcgcttatgaaataaagtctttaattgatcaggacaacatgccaaaactacaatagcatagggtagcagcttaaggacacttagttggccctttgagcaactaaataacacacagcttgacagtagactcacacagagaccataccaggtaacaatcacacacatacattactacctaaccaggttcacacagaaccacccatcaccccaatccaatacgtttgtc

SEQ ID NO: 52104 - DNA, 887 bp, Oryza sativa
gaagaaaaattcaaaaagatcaaccacgtatacacttacatgtatggttccgatgaagaggatgaatccaaagtagcagcagccgagtgggtcaggagcaagaaggttgtgccatgtcaatgggtgagaagttctgggaaaagaggaaaatttgattttgatatcaccaaggttgataagattttcgatttgtgcttcgggaaaaacaaattcaacttcctgctggtcatgtaattccatcggctgaggaactaggcaagaggaggtattgcaagtggcataattttggttctcataataccaatgattgcaaagttttcagacagcagatctaggtgtccattgaaggggggaagattaagtttgatgattcaaagaagccgatgaaggttgatagtaatcctttccctgttaatatggtgcatacagctagaagatcagtcgatgaaaggaaaactcgaggttgtcagttgaattcaaccaggattatcaacaaatatcaaagaaggtatgccaaccagcaggagaggtattgcgaagaagatgatggtggatttgatcctcattgggactgtgggttctttagattttgctggaatgaggagatgaggttgccatccatcaatgattgcctgggtgcagtaataacgcagggagtttaagccgaccttacaatagaggcaatcggctgaatcaggaaaggatgtctgttcgttagagattgggcccggttaatcaagattgctaccaggatggatatgagggcaggaagactcaatgggtccttctggtatttttcacaaaaaatcagaagagaagggttcagagaataaggaatagagaacgctttcaagaagtagagcaggaaatcaaccatcggggttaga

SEQ ID NO: 52105 - DNA, 369 bp, Oryza sativa
ttagatacgattgcttagccatgcttagaaacattagcacactattgggataacttatgactcactattgtttaatgatggcttaatgatagctcatgatagttaatcgtgattggttaattaattaatttgtcaactaaaacttgataatggtgggttgtgagcacatggttttgatggtcgtgctcatgacaattaaggactggttcacgagtttcggttgtgaaacattaaccgtgccaaccacaagccagcgtgggcaacggctttaccttttgtataacatggttcattgcggggcaccagactgagaagtggcagagataagcccacgggggtcgctggggagtccatgccttgtttataagg

SEQ ID NO: 52106 - DNA, 1147 bp, Oryza sativa
catctggtcaccgccttggagtggtttgacgggcacatctcggcctgaagttgattggcaggctaagggcttaacaatgtctccaatattcctctctcgaggcgtcgtatgtttcattatgcttgtttgatgacttgaattattcacttcatctttcaaatataatggaaggtctgaaaagcctccgataatgtgaaatgaaagggaaaagtgttgcaactgcatcggtaaacatggtttttatgctaccggcagaatttgaagccaggcaagccgatgttgatgaagttgaggaaacctctgctagattggttttgtcgccagagcaggcagtttttgagaaaccagaagggacagaaaattggcatctcaagccattgtacattaatggttatgtcaatgggaagccgatgtctaagatgatggtcgatggtggggctgctgtgaatttgatgccgtatgctacattcagaaagttgggcagaaattcatatgatctcataaagacaaatatggttctcaaagattttggtggcaacccatcggagactaagggagttttgaatgtggagctgacagtcggcagcaagaccgttcctacaacgttttttgtcatagatgggaagggttcttatagcctgttgctaggaagggattggattcatgctaattgttgtattccttcgaccatgcatcagtgcttgattcaatggcaaggcgacaagattgagatcgtgccagccgacaggtcagttaacgttgccagtgccgatttagctctttgggagatggatgatattgattgcctgtctggaaaagtttgggatggagattttctaaaagttttcgattgtgatatacagccaattgaagacggagagcccaaattattattttgagggcgtcgtggaggcttcaaacgtctacaccaaggatacagtagatgatctcgatgacaagcaaggacagggtttcatgtcggctgatgatttggaagaaattggtataggtccaggagatagacctaggtcgacattcatcagtaagaatctatctgcagaattcataaccaagttatagagcttttagaagaatatagagattgcttcgcttgagagtattatgaaatgccaggactcagccgatc

SEQ ID NO: 52107 - DNA, 222 bp, Oryza sativa
catctggtcaccgccttggagtggtttgacgggcacatctcggcctgaagttgattggcaggctaagggcttaacaatgtctccaatattcctctctcgaggcgtcgtatgtttcattatgcttgtttgatgacttgaattattcacttcatctttcaaatataatggaaggtctgaaaagcctccgataatgtgaaatgaaagggaaaagtgttgcaactg

SEQ ID NO: 52108 - DNA, 1501 bp, Oryza sativa
agcacatcatgcccagtacccgaagcccactcacaacccgcaagcaatgatgaaagaagcttcgaccttgcaagcacagttccaagcttttccgcaataactcaatcaacaccacaacaacataccaagagcttcgcctccggctcaggccgagggaagcccaagtcagggtgtatcggcgggccagctgttgggacagttcgccttgctaagtcaaattcaagggccctcgcctcaaggtccaccttcattgttcgacccaagtacaatggcccaagcaccaacgactttcgcacaagccgtacctccagagtacagaatggccccaccatcgattcaagtctggaatcaacccatgtccgacccagccacggtgatgcaagtcacttcgattgaccagcaaaaccaggcaatgatattcggcacagcacactagtcaacacccgcagctcaaccacctgttaaagctgtggcttcgccgttcgcacttccataccaacaattgagctggcctgctcaacaaggggatatggtcaagccgggggctgaaaagggtttgcccctcagctgaggaatcaagaatcatcccatcccaccctagtttaagtctctccagtcccacggtattcgggagagatggatccgaaagagttccagtccatctacaaatctgcaattgaagctgctcatggcgatgagaataccaaggcgaaggtaattcacctcgcgctcgatggcatagcgagatcttggtatttcaatttgcctgttgatagcatttactcatggaagcaattgcatgatgtctttgtccttaactttcgaggtacctatgaggagctgaaaactcaaccagaccttatgggcatacaccaaaggccaggggaatcgacaagggagtacgtacgccggtttttgcaggcacggtgccaggtgcaagatataactgaagcatctatcatccatgcagcttcggccaacctgcttgaaggcgaactcacaagaaagcttgcgcgcaaggagcccagaacaatcaaacacctctttcgcgtaattgatggatatgctcgaggtgaagaagataccaagcaaaggcaagagatattagctgaatatgaaaaggcaggtgcggccgtagcaaccaccatacaagccaacgcccaagctcaggtccaagcttaaattgtaagttcagcacctgtctaggttcacccaacacccatggctaaccaaggaccgtatccaaggccgaaccaagcacccatggaagaaattcaggaccgagcgagctagcaaggtggtgatggtggtagaagaggtacaggctctccacaaagagttcaagacccagcaggcaggcggacaacaacaacccttttgcaagaagatcaagaaggacctatactgcgcctttcatggacgctcttcgcacacgactaagcagtgtcgaaacattcggcagcaaggcaatgctgaagtgccaaggcagcagtagccaagg

SEQ ID NO: 52109 - DNA, 153 bp, Oryza sativa
ccgtccctatccggggttgggtccgcgggatttataccggcgcggcgctgcgctgcggttgtgtgtgtgtgctgtgtgtgtgtgtgccgcgccgtgcgcgtgatgcggtggcgatgaattggacgggatggatggatgggggccaggtggtga

SEQ ID NO: 52110 - DNA, 1106 bp, Oryza sativa
caccccctaacagttccatcatggttccttctatcaaagtactccgtatcaactattgtgttgttctgaaatttgagcaaagagctagctatagataagcacctaatccaatgcaaatcctattaataaagtcaaatagatcacaataaactaatcacttatcaaaaagaaattctcattaacacttcctatgcttctgttgatcagtaaattgctgcgcttgctaatgctccttgttacccaaaaaaaatgccgacttcgccagcatagcagagcaagcattccactgcttcaggctgaggaacacgagcggctgcctgtgctggccggatcctagatccgcccctgcgtctgccacaatacatctggttgcgttgacatgtgacatatacatacggttatacctaggggtgaaaacggtcacagaaattcccgatcaaccaggcgccgtttccgtttaaggggtaccgtttctgaccgtaccggttttggctatttttaaattttgttttttctaatttctttccgcatcgtattaatgtcgatactgagtagtttaagggtccctttgaatcgcggaattgggaaaacataggaataggaaaaacgtaggattttgataggaatgtaagtgtaaaacaaaggttgcaaaacgtaggaaaaacacagaaatgccgtttgattgaaccacaggaaaaacacaggaattggatgagagatatagactcaaaggaaagttagcaagaggttgaagctcttgttaaatttcctccaaaatctctatatgattgtccattccataggaatttcaaaggattagataggattcaatcctttgtttcaaagggcttcataggaaattttcctatagaattgaaatcctctaaaattcctatgttttttctccaaatcaaaggggccctaaatgataagggaccctttgaatcgcaggattgaaaaaacataggaataggaaaaatgtaggaattgaatgccatacttattggattcctatgggattttgaagcacaggaaagtcttcaaactgtcgtttgattagcacacaggaaaaacgcaggaatcttagacacatgaagaggaaaaca

SEQ ID NO: 52111 - DNA, 1501 bp, Oryza sativa
aaaaagtatccagtcgatttttttatttaggtaatgaaaacaacgcattcaattgataccgaccatgttgcatcgccgtgaaatcgacttgtggtcaatgtagaaacgaacttgtatgattgtatgaacatcatcctagactgaaaatatttttttaattaataaaaaaagacaccttcggtgtggccgcagaacaatgagcacatcactttcatcaaagttggttgaaagcttgtactccgatttatacacacgcatactccctccatcataaaaaaaaaagacaatataggaggggtcatacttcatcttccaaaaaaaaaaagtaacctataaggggttacaacgaatctggataaccctccgtccagattcattgtattaggaggggtcacgtgttatctttttttagacagagggagcacgtatttcagtacgagtttttttttaatatagagggagtacgtatttcagtacgatgctcgctcacctttgagggaagtgttctgttcaggcggtcaggaggagtggggccagaaatcaagactacggttaagctagggttaaattaatgtgttaaatggttttctaaaaattacgtggtgatttaagaaaattaaacataactgtggagagaagtctagagctcagagtcctcagacacagacaaaaattagacataattgaacatctgtatggccactcagacaaacaagccgtgggctgtgagctagaccccgcagcctctctccatcaacctataaaaacaagaaataagttcacattaggcctctcatcttgacgaggagtttaaatttcatcatcaaattccaatactatatataaagtgtccatcaatttattgtcagcggcgatctcatgctggctaccgtgcggccacctgtaccactctaattcccttcacccgtcccccaccggctacctctgtcccttccccaccgttgatggggaatagaggagagagagagagagagaggggatgttggaggaagaagaaatgggcctgatatgtggggccatataagtttccactcgacacgtcaagtaaaaccgagtactatattacttggacctcaagtacactggttttaaagttaagggacgcgttatatggttcgagaacgaaaaattagaacctggcgtcaaaatgagggacctttaataaacttatttcctaaaaagcaaaccgatatactgagctatccggcacaatcaaaatgggccgcacgctcgtgccggcctacatgagttgggtgtgcagtaagaatgggccgtaagtagcagtactaaagtcgcaacgcgttctcttcctcccccctccgtcgtccaccaacctgcctgcctttctctctctgacttctctccccacattcgccagccgccgcttccctcgccgccgtacgacacctcctagtaggagggagagagagagaggcggcgcacgagatggcgatggtcctgcggcgcctcgcgggcgcgt

SEQ ID NO: 52112 - DNA, 316 bp, Oryza sativa
catgtagttatgggtaaacaattagaaagaaccatgtcaaatctgagacggtattctttaaatcagccatctcattgagtttaggccagatatctagaggaacaatataagttgtttatctgcactatattaaagtagcatttgacaaaaggaacactattttgcatttaaagattcgtctagattagggacacagcactctggataacagggttacatgaactctctctagccaaggatataatctggtctcaactttataatgattcttggatttccctttttttattgttagtcttcctttgttttattaagg

SEQ ID NO: 52113 - DNA, 1501 bp, Oryza sativa
gaagtaagaacaaaaggactcaaccaatatacaagtctactctcatgagctgtctagttaacttgttttaaataatcaaataatacatccaagtgaaaagatctattatgtgcaaatatagaaaaaaatatcccttcttatattagagtacgtacaagttgttactgttgaatacaagtcttttgtggacataggggtgggcattcagtctgaccaaaaaatttggtatcagtcttcggttcggtctttgaaaagtgaagaccgaatttcaacgcaaaaatgctaggaccgacaaattcggtctcggtcctgatcggaattcaacaacattttcatatatgaaaaaaataatagaaattttcaacacaaaaatcaaaaaaaaattcataagcactacgaggtatatgctttttttaagtgtttaattataaaggaccgtaaaagtataaccttacgacgctttttgggtaattggtctggctagacccttaagtgttgtactatctcatcaatgaaatatcgatatgggacaactgaacaagctaacaatacttatacactgttcacaacacttatcaaaacagtccgagttatcaaccaaacctcacggttgcatcacccaggatgtgtacatctgggtttggatatgagggaaaatatgtagtgtaaaacatatatatgtatataaagtgaaaacttagaaactaccgtttgatcaaaaatggacgtccgaaattcgtccgcgtcaccataagtaaaaattttactcccagttcactcatgagtaaaaattttactgaagtgacgtgaacgaatctcagatttttaattttcgatccaatggtaattttcaggtttctatttccaccacatattttagttttaatccatcttttttttttaaaaaaaaaggcactcacccatttacttgccaatgtgtgggggccgggttaggtatattgggctagtctggtgtaccttttctttccatttacccctttacttgccatagcacgtctaggttcaatgaacctgtgatggtctcacccggttcacaggttaaacttaggccctcaaccccaaacactaactaatcgcaaaggtaacccatgaaaggaagcaggtccagattcatgggagagcagcgctgtgtgtgctgctgcctgcctaattatgatttattcccacacaccctgtacgtagatgatgcaaaaatttacgggatttgagcgggatatgatacactcgtcgcaacgttcgaattctccgttgatagtgtcaatcaccggccggcgaaatctctttgccggttgcatgcacccctcgccttacatataaacccacacacctgcgtccctgatcacacccacacacccacacacctgagtacctgacctgttaatttctcctcttcctccggcgtcgtcgtcgaggagatcgttcgatcgactgatcagcgattaggcgtgagatagaggaggaggaacggattgtggttttc

SEQ ID NO: 52114 - DNA, 470 bp, Oryza sativa
attttcatgttaagattcagtgatgctcactcatatatatacgatgatgcaaatggcagacgagttagctagataagggttggtgtcttagtgatgtccgagcaagcatcaggttggtttgtttccttatcacacctcatctggtatcaaaagcttttttttaaaaaaagatctaatcaacaactctgcattctgcaataagatgtgtgggctaaccggctaagtgtggctccatttggatccaactagatgttacgggtgcacaaactgctgctactgaaccaataatgctctactcatgagccaatggcatgcaatctgtcgtcataattcataacaagagttggtacactaatataatatacaaacaagagttggtacactcatgtaatatataaaaagcgatgtatccagtgagggtgctgggggactcaagtttttcctaacccactggatcacaattgagagaa

SEQ ID NO: 52115 - DNA, 675 bp, Oryza sativa
tcagggacgttcggtgtactttttcctttttagaaaggattgggagtttagaggatgaggctattaactactttgtttggttgggatgcataggaattttggtaggatggggatgagtaattgaggaaggaactccctccttttcaatatctgggtagggggtgataattgggagggaatttctcctttactttgcctaaacaaatctcagccatccgtttattaatggcttaatctctaactaaactccctatcaatttccaccacctctactaaacaggatattgggattaaaattcaaattcccatcttagtctcaccatcaattccctcgtgtaaactcccaatccccttccctcgagttgccaaacaagctgtatgggcttttccgcgtggatatagtagagaaataagttcaccagaggtctcttaacttaacagcgagatttttagaggtccctaaaccacaaaaccaaatatgtgtacccctaaactcacacaaactgttcaaaagaggtcccatggcagtatatgtgggtggttaaactgacgtggcatcctagttagcaaatttttttaaagtatgtgggacccacatgtcagttaacatcgttttttcttttcttttcttctccttctcttctctttctcttcttcttcactaagtgagcacga

SEQ ID NO: 52116 - DNA, 234 bp, Oryza sativa
cacatcacacacctagcttaaactccctctgagagagagagagagagactgcacagacacattgcacagtgctttgcttttttttttcctctctctctctctctctctctctcttcttcttctgttaatttcgtactacgagcagagagaggacagcgcgcgctagctagatgccaacctgcgagtggctctagcgaagttcacatgcacgagatacttgtaatgctatagcgg

SEQ ID NO: 52117 - DNA, 1501 bp, Oryza sativa
tgcctagtgtggcccaaaaccatgtacagctcagcaacatattccctgcatgcaccctaacacgggcgagagagagatcgatgaaaagggttgtttgcccaataaaataggggaatgtgtatgtggaatgttgctgcgcatatgccatcaaagacagtgatacaaagctagcttaggtcacctcaggttgatagacgatggatgtgaaaatttttctgtgcacacaagaggtatagttagggggtgtttggatgggtctgtcatatcgaatatttagacactaattaaaagtattaaatgtaaactaatgataaaattcatttcataattctggactaattcgcgagacgaatctattgagcctaattaatctatgattagcctattttatgctacaataaacattctctaattatagattaattaattaggcttaaaaaatttatctcacgaattagctttcatttatataattagttttgtaagtatagtttatatttaatactttaaattagtgtcaaacatccgatgtgacagggagtttagtccctaaatccaaacatcacattagatatgtgtagccgtgtaggaaaggagggaagggggatggcggaggcatatgcgtcacattcgattctctccggcggcctacacaaacagcttttcagccagcttacacgacccctcttttcatttttttattatttgtttttttggaaaacctacacgacccttcccctcttggtggccgatctggccggaccgggcaacagtcaaatctatcgatccaggatcgatcgtatcaggcataatagaatcttacttacttaagcttacttaggtggtgtttttttcttctaaagatgaagataaagattaagttttttacgcaaaacgatatggtattaacgtatgattgattgagttttaattattacaaacttaaaaaatatattaatatgatattttagagtaactttcatatagaaagttttcgcacgaaacacaccgtttgaaaatttaaaaacgtgccacaaaaatcttaatcttcatccaacttttgttggagaaaagaacaggaacttattactcctaccatatgtggcaacttaattactggccggcagatagcttaggtttagctggttaataaaaaaccgcctgtagcttggttctcggtgcatgacggtactgcatgtaagtatatagtagagtactccccctattttaaaatgtttgatatcgttgactttttagtacgtatttgaccatttgtcttattttaaaattttaagtaattatttactcttttcatatcatttgattcattgttaaatatactttcatgtacacatatagttttacatatttcacaaattattttgaataagacgaacggtcaaacatgtgctaaaaagtcaacggtgttaaacattttgaaacggagggagtatgtaatagtagcccgaccgatcgagagttaaaaactgtcgagactgca

SEQ ID NO: 52118 - DNA, 1060 bp, Oryza sativa
gaaaatgccgcgtgatttttgcaggcgccactagttatggtccgtttgcaaaaatcatggggtctcgtatagaaaaatcacttttgtagtagtgaccgtcagtcttcgtcacaaactgatcatgcattgcatgcatgccccatggtgacccacgtgacggcgtctcgatccatatcgtgccatgcgtgcgtgcttgctcgacttgtgtgatagctataagctgcatattaaatattgtttgttctgtatttctgttgccatgcctgagcggtaccgtaggcgtcatccatggtttaattatccttccatggtttaatttacgtatttttccccatataattaagacgctagtgttgatccattacatcagcgtcgtgtactctaatagtaatacatatgttgtgcaagaaattaattgctccattccctagttgaatacctaaaaggaatattaattgctttcgagaataatctttttctttaaatcaaaacacctagctccctccatttaagaatgtaagacgatggctatattttgctataaattaaccttctataagattgatcaatttttttttaaaaaaacaaacatagcaatatttttaacaccaagcaaatataggagtattaatatattcaatggtggatttagttcactttgttaccattttcaaccctaccaatatttgtcattatcaaattttggatgttttagtgtgactaaattttggtaaagttttttttttgagtggaagcttccgttttttttcaaaatttggtatagtagcaatggcaagaatgtgtttagtttgttgcccttctaaaatttagcaatacgaaaacttggtaacattaaaaatgaaacaaagtgaacaatctcttaataaaattcatttgacatcatagatgttattacattttctttgattaaacttatagaagtccgacttgagataaaaccaaaacatcttaccttctgaaatggaggtagctagctaggtagctagattgcaagaacagaatatatatactccgattcatatatatacttacgtccagc

SEQ ID NO: 52119 - DNA, 258 bp, Oryza sativa
tatacatgatggtctgtaaattaaataccatggaaatagagcaatttccatatttgtctctgatggagccccactaacatgtagtaggcctgtactgttggcacttagctagataccattgtagtaagaataaataagaggcaaatgaagaaaccagtaaactttaggggagaaaaggaaatttatatgatgaaaattaataaccatgcatgcaccataacttgctaatttgcttgttctttgtttgttttttccagg

SEQ ID NO: 52120 - DNA, 1174 bp, Oryza sativa
taagttttaaatatatagtacacaatttaattatatgctaataatgtatctcgttttacgtgcaaataataagccaaaatcaaaccagaaagaacacgcccttactagttttcctccaaaattatatcgaaacgggtcattccatataagttctaaagaattttgtggaagccacacaatcatttgttgcaaagaactgattaggattatttttcataggatttcagcctcatagattctctccacttctcaatgttccaaaggagcacttataatatatatatatatatatatatacgagtataataaactgcgtgcgtgatgatgatgtgcaaatgcttaatgttgtgttggttaaatttgcattctcggctggccgaactgcttggttggtgcttggcgaatcggatgagagatcgtcagtactgaaagagtgacaggggataggtcgatggtgtcatgcgcttcgctttctgcgcgcggtgagtcgatgcctcgatggagcacatcagatgggatccggattgattgctgattaggtaggccaggatgatgaaagaaatcattattggaagcaattcatttagcagctaggagggtgactgttgacggggatgtccacacaacacgccggcctgtgcagagggcaatcagtgcgagcttgttgatttcccaaattatttttaaagagggaattaggggaatttggatgtgtaaattcgtcgacagtgctatgcaacagtcagaaattaaaccgatatgaaatcaagcttgtttccccagaagaatatataaaattcaatgaagtgtgcctttagttgatgtcatttgaagtgagtattgtaaagaatatataaataatcgtttaatttcaagcgtcaagcgcatctggtgtagtggtatcatagtaccctcccacggtactgaccggggttcgattccccggatgcgcatcaattttgcacttctttttttcgtcacattttgttagttattttttcttttcggccacatttcgtaaggtttgagatgaaatttgaaagcccattgaaatcgttgccacttttccttttatcttcgcaacgagcctgaaatgcaacacgaagaaaagcaagccctcacgtacgtttcgttagttcttttttcttttcggccacattcgtaaggtttgaaa

SEQ ID NO: 52121 - DNA, 1022 bp, Oryza sativa
ccaaattggatgattctttttcctaaatgtttctaaaatcatgctctatcatgttatctgtgttgctactgttattatttaggccattttttcttgtaactttgttttatcaatttaaaatttaaatttcaaatcttcaaataatattatgaagcaataaacgatttcagctgaaaaagtcaacaacaacaaagttgtataactcatcgatatctataatttctattttggtcatttcttcatttgacaaagtgatactaacattttcacaaaatttacatctctctcttatagttataaaactatataatagatatgtacattttgtgaataatcttacaaatcactttgtcggatgaataaatgaccaaaataaaagttatagatattaatgagttacaccaatttgttattgacgactttttcagttgaaatcatttagtatctgaaaatgttgtttgaagttgttataatttgaaattcaaattcagactgttcaaacaaagtcatatagaaaaatgaccaatacaaaagttgtagatcttgataagttatacaactttgtttttgataacttttccatttgaaatcatttactacctaaaaaactatttgaatttcttatattttaaaatttaaattttatatagttcaatcaaactcggatagagaaatgaccaaaagaaaattggtagatctcaacgacttctacaactttatttttggcaactttttcatatgagtttatttaagaccataaaattttattcgaagttctcacatttttaattaattttttaatgcttatttttacatgcggaccacttaaggagccgcatgcaaaaattggtccacatgcaaaaatatcaacagttttttcagttttttccctcctcaccacttcaaaaattttcatctcccctcctctcctctctctctgtctcctctctctgatatcctcacccctctctttttctttctcttcctctcactctctttctcttcctctctctctctttctc

SEQ ID NO: 52122 - DNA, 294 bp, Oryza sativa
caggttgagcttttttcataacctcaggagagcgcaaatgcgaggattctaatagcatatatattcgtccatgtaaagttctgtcgatctcttgtcctcctcaattgtctatagttaggccaagaaggctaatgggtagcaactaattataccattgtagttcttttaccttaagtttaacttgaaagaagaaaaaatcgggggaatatgttagcttaatcttaagcattctcttgttgctctattttgatgttctttgcttgatgcttgaatcccatttgtctctaccaaagg

SEQ ID NO: 52123 - DNA, 490 bp, Oryza sativa
tttttcacccgagtatgccacgttggcaaaagtggcaaatagttaagagacttcctcttaagaggggaaaaaagtggcaaatagttaagagactatctcttaaaaggaaaaaattaagtgcaaacctaataaggatatttggataattatcgaatctaaaagtggcaaatatttaaatttcccggaaaacgggctgctggtgtccatcatacccagcgctcgccatccaacggtcgagcgctgcagatgttcagacccaacggcgctcaagcctgcacgccagtatcgagcaacttctgttcgctccattgcatgtgcctccatcacaaggccgccgcaagcaccaaaacccagatgacgctgtgctcgccgccgccatctcctccgccttctaacccgcgccgcgcgcttcctcctcctcctcctccagagcaactacctcctcccccgcctctcccctctctaaaaccctagtccttctcgcccgcca

SEQ ID NO: 52124 - DNA, 1501 bp, Oryza sativa
tcaaggtacaggcaagtcggtttcttgcacttaattttttttcatgctatttgtgaatgttggggatttctattcatggagaaacaatgtttttattttccttttatcagtgtcatagcgttcttcaaatccagggtagtattatacggattttatctattttgcatacattgtgcctgtaaatttttgcatgaaaatgtatccaagagcacaagtaatttcgagtgtagtaaattagtacaggtttctcttgagaaataaaatcttttctctcaagaagtccaatattagaatgtctacttagataaatgtgtgttttcttagaaaaaagttaatttgtaatatagtagtaaaatcaattaggattgtcaagtcaaggcataatagtaagatttagttcgcacagctagccctcttaatttctattagtgccacctacttcttaatttcttacgctgatgtctgacaaaattctgtttggttcctttctgcagtagaacatcagcttatgagatctgaaagcaacaaaagggtaccaattttacacccatgtaaaatccagtgatttcagtccattctttgtggctattttcatactgcatcttggcatttgctatccgtttaatatgcttggcaaatgaacttgaattagtacaagtggatctttagatttgtatgtagaaggtcgagatgtttgcaaatgacatatgagttgagttgagtgatctagaatttagttcctatagtggaatatggatagctccagaaattgatttttttagtccatttattttaagctctactatttgttaagtttattctcaaaatatttaatttatagtattatccacaataattggagggcaaaactgaccaaattaaagttgccatatgttcatctggagtctgaaagctggccttggtctgcttcattttggtgttgttgtgactccaaccggtgaccggagcccgtactcaccgctagctaccatccccaacctgccccaatctttctccaggttatgttgctagcacttgatctgtacacgctgtgggataattgcttgttgacaaggaagatcaaatcctgatggtggaagaatggcaccccctgtgctccagctaacaatctgattagtttcctagatgcttgattattgattttatgtgtgatcattttattttgtttttgtatcagggctgcatagagtataaaagctttgcccccctatgcttgcactgagagactcttccgtagctgtcatcgcatatagtgttgcaagtatgttctctattatctcaatgtgattgcacgggtagcatatgtattctcactaactgctcttacactaacaatgatgaatcagactagcagagagagtttccaagcaaatttgatggcacatgtccacgaattgtgatttttaatagtttgcattataaatgctcatctttgtcctgcctcctttttcccttaaatttatttacatggtgtggcagg

SEQ ID NO: 52125 - DNA, 1501 bp, Oryza sativa
ccgcgattggcttaatttttagttatcccagaccaaaggtccagtgcatgtacaacttctttcttttgtacaatttactcctatattcaatgaaattggcggctcgctgattcgtttaaaaaaaacatttaacttcattctccattctctgctagtactactcttctactggcagagcctctctacattctgaacactttcgtgcctccgcttgccactcacctctcacaaaaatgtgccgctttccaaaccgaagcagccaacacatccacatcaatccacccctccagcttcaatttaagaaagatataatgccaatgttgaactgccattctctatttctctccacacattattgatgtatatatgaaccgattttctgacggaatgattcatgcaaaattcctatttataaatgagcgtttagttgtagcttcttacatataaaccgtggccaccaaagtgatgtggttttattgtctttgagaaggtatacagggtaccacaatttataatgcaaatttttatacttctcccatatacaactttgctatgattacacaagagaagcgtatgtgcacatatcactgtatacgcacaccaccagcgaatgaggccctaaggacaaaacatatgctcaaagatataaaaccatgcagtaaatctctaacctcaattatccttgggcaccaggttaaaggactttaaccttgatgaatagggccatgcacccatgatacaattgccactccttgctctagatctagcccgattcatcttcatgatagttggagccgccgatggctatagccaggtgtgtcgttgtcctttgtctttggccttatgagctcgaggcaggatgcgcacatcggcatcagctcatgtgcttatcacctccaccaggacaacctactttctcttataggtaccaggtgcaacattctctcaccatggatcacctctttttcccttaagccacccatatccttttcaagccactatgccacactacaaaccactcactcctcccccctcgtccgcttgctttgtcctacacggcagatcactgctggcgtggagccgtgagaactgaggagtgttgtaaggtcattcacagtccgtagatgtggcattcagcgccagggtgccagtgaggagattcccctccatgcgagtataggtcatgcaataagcaaacccctcaaacccccacgaagatgcatgagcctcgccagggcgtgttagggtgaagtatgtgacgtgcggggcgatggcttgaagccacgttggggaggttgtgccctcgcgatgcccatatcacaccacggcgtctcgctgacctctagtggccagagaagaagctccagatcattgaggaagaggaagatgaaaactcacctcgccactctagatccatacaaccgcccacgcgcgtcgccatcaaggtcatcgccccgatatgccacctatgtgggctccgaattggagcttggttcacagc

SEQ ID NO: 52126 - DNA, 273 bp, Oryza sativa
gttcaggtttgctatcaggtccaggcatagaaactgagggttgaaactaaacaagctctgaataccctgatagaagggacatcccttctgagattttctgaagagataaagagcgtgttagggcatgtactatggagaccactactataagtggtctcaagtcaccggtggaagcgctcccgttccccttcactgctgcgcgctactcttccctttcttcgcctctccctcctctctgcccgctcgagctcgcgccgcctccccttcttcagt

SEQ ID NO: 52127 - DNA, 1152 bp, Oryza sativa
atttacttctgcaaattattcccataccaaactaattcagttgtgtgccttcttgcttgcagtaaggaggtgctccatgtaaggactttggagttgctggcatagcagagaattgaatgactctgcttttctaagtgcaagcaattgtgttctttgggttttatactaattctcaaacttgatgatattgggctggtcgcctctatatttgctaactcaatagagcccttttccgttatagcatctttactttccaaattttttaatttgtaatttctttttatatgagcaattggtactatgaatgtacgagacatatggtcctacatcctgtatgtctggggaacgggaattggttgggaaaaaaagttaccatgtggacttattttttgttaggctcatgttgttcaactagccctgatagtttcctaaaactttgtttaatttaagaagctatgtaatgattctatttttggtgtacaagatattggcattatgttacacatagatgtgttttgaaagctaaataaaattacatagcaacatttggtcaacaatagctatatgtttaacagtagctttgcttaagctgttaatcatatccttgtgtgcgcagctgcgcgcggcgtggcgccgcgcttatacttctagttccatccatgcccatgacaggagccacttatccgaccaattcaagaccagcacataatttaactcgcctgcttatgtggacaaccatgaattgattgataatccctgtcaaattcaggacttgacccgcctgtaattcaagtggaataatcgagtctattggcatgacaattttgctcccaggtatagaaacaccatataggagtattgagcataaattttaagagtaactttacaggatgccgcactaaaatttgaagagtaactttactgaaacatacaatacatgaccggcaggagttctggtgtcgccgctccacatgtcaacgcacgtgcaagtcacgtgctgattaaagccctataggggctttacatccaacgataggattatattatccggaagctatgtgaatgcaatgccctctccaaaaaaaaatgaaaagaaaagaatagaaagaaaaatgcaatgctgtgccacaactatgggcaaacccagatatg

SEQ ID NO: 52128 - DNA, 153 bp, Oryza sativa
agagggcaagagcatcgatttctgcagggcaaattggctcccaggtggaagtattgagagcacaaggcccactctcttcagctatgtcaaaataacaggcctgacactgcacaaggaactacagaatcacacctgggttcaagatattgatgg

SEQ ID NO: 52129 - DNA, 1501 bp, Oryza sativa
gtccctaaagaaaatactaaggttgttcttcctccataattcaagaaaataacacttgttatgagccttctctccatgctgtctgtcaaatgagcatgatccactacccatgaccttgggaagatgatcctttgacttacttccctcagactttaagtcactgacataaaggtctactgggtagagggcccatatgtcagtaacacaggttagagagaaataggttagatgattttaatcccttgaccttgtagtacaaggtaagggtatagatatgtaaatggaatagttcctactacacgcccaaaagtaccagctagttgttccaccttttacttctagtacattacgaggtattacactttgacttatgaaaattcagtttgaggccagtgggctgagcaaaatattcaacaaagctttaaggcaaaaaaaaagttcattatgtgaagccctcatcaggattatagtatcacgagtatattgactaattggtaatccgcctccatcaggctcattgataggtttgcatatcagtcccatttgacatgccttgttgataatgcttaggagcaaatcagctcccaggacaaaaaaacaggggcgacagtggatggatctccccatgtggccaccttactcctcttctacactaaaggttgtgttcgttggagtgagttgggaactaatccctccagcatgtaaaacgaagtgactcattagcgcatgattaattaagtattagctattttttgaaaaatggattaatatgatttttttaaagcaacttttgtatataaattttttgtaaaaacacataatttagcagtttgggaacatgcgcggaaaacaaaagggctgagttgggaaagccagcaaaagaacacactataaggagtttggaactccattgagaagcactgagttagaggcagttacaataatgaaaatgctatatgccaattagaaccatttggatggaaaccccatatgcttcataatctccaaaacaacttcatgctcaatggtgtcaaagggtttttcaaaatccaacttaagattacaatcaaattggtaaaaagaaaaataaaactaggccagcgcatatgacatgtggctcactataaaaaaaaggcctaacacaacttgtatcacgtacatccgcatgagaagagtatgggtgaagtatgcgcccacagttatgtggatgatttggtggcacgcgatataagcgtagcatttagttatggaatcttcaatgttccatccaaaaaagtagggttaattggatccatgccattgcaaatttgtcatattagaaaaataccaaaactatttgcaatattgactgggtactagtacaattttgtaaaattagatccatgccattggtgtcacgttttccatcttcatatagaccaaaatacccttagacattggacctacatatcagtttcatcttccttctccatcctcccctcttccctatctctctcctagc

SEQ ID NO: 52130 - DNA, 1215 bp, Oryza sativa
atgaagatgcaaaaatggtaggacattgtctgatgaccttgccttatgcacaatcagctcatggaaggttctcgaataatttttggacctttcaacattcttttactgagacttacctatggtctaacggtatgtatgatatcaactattgtatccaatggcccatattttcagttgacgtggcttaatgagacgttgcattttgagttttaccgttcacttttggctgtgttcttttctcccctttcacaactcacttctctcgttttccgcacgcacgcttttcaaattgctaaacggtgtattttttgcgaaagttttctatatgaaagttgttttaaaaattatattaatctatttttcaaatttgtttaggctaaaacttaattaatcttactataattgtgtgcttggttttctatgttgggaggcaaggttgccaaccttgtctaccgaacacagccgaggatatagtgtcactgtaattaaaacaataactaacagaggatcaaattatcaatttttactacatacccttccattacttttatttagatgacactgtctagtttaatataataaataaataaaaaaagatcagaggtagtaatataataactgatatttctttttgggccattctttaaccaatattttcactttcgactagataatttaaactttgtttgtactttggactacctatactctcgattcgagtatatcaatttctatttgttaataaactctcactgtatatgaaccgtttctttcacgtagaatgacgagttagatgtagatgaataaaagagtggatggtggtccaaaataacacagaggtaaaaacccggtttaaattgaaaacattggataaaagatagtccaaaacgaaacatcattaataaaatttgacccaagataaaattctctctctaataaataccaccaatttatatatgtccatacacgcaattcaccgtcggttgctattaaagctgattcaacggatgggaactaatcccttccgcatggaaaatagagtggtccattagcacatgattaattaagtattagctatttttttcaaaaataaattaatttgatttttttaagcaactttcgtataaaaactttttataaaaaacacaatggttagtggtttgaaaaacgtgcgtgtggaaaactagggagaggggctgggaacacagcctaaaa

SEQ ID NO: 52131 - DNA, 1501 bp, Oryza sativa
atatatgccttatattatgtaacaactataaaaattagttgtgccttatattatggaatggagggagtaagatacaatatacgctcccattgtaacatatttgcaaacgagaaataatttgtgaataaaacttttatgtatgtgtttttagcgatctaaaatcaaagactgaaaagtaaatttcgatgaaaaaaccccaaagtcaacttcaaattaaaggttgagaattcaaattttggttcataagtataagcataagcggaaagatgggttgatagtatactcctaatagaataattaaaaaaatcgaaattaatgatatttgagtattcatattccatcgtagtacctttttcgaatgctttctattatcctaatttaaaattttaaaatcagaattaacagataaaaagttacatagtcttagacttgtttatcgatcttggtttaagaattctgaaaaatgacaaagacaaaattttatttggtaagaagtctaagttatgcctttttggtaatatagagtattaaatttcgaatcgataagtaactagtatctatttactattttttcctgatataataattttgaaattataaattaataactatttataagctatctaacatggaccttagtttaatgtgtcctgtgataactttggtcttgcctatatgcatgactagatttattcactactctcctatccgaaaagctaatacatcttaaaatttagaattaatggagagtctttgttttgtgtgggcgattattaattagcttgtgttaatttccttcagcttaatttgttggtgtttttttttaaaaaaaacttgtatatgtgcgctagtttgcataaatttgtgtaataattggttgtatctcgttgagtaaaggttgggattctattccattatctaaataatttatttgatattaacatacctagcctttttctttttaaggacaggatggatgaatcaaacgaatgctgcccaccaaaaatgttgatatgacttgaaatttctaatgttggccttttatattacagccgtgtttagttgtttggccaaaatttttaattctgacgtatacggacatacatttgaagtattaaacgtatactaataccaaaacaaattacagattccacctgtaaactgcgagatgaatctattaaggctaattaatacgtcattagcaaatgtttactatagcaccatattgtcaaatcatgacgtaattaggctcaaaagattcgtctcacaatttacatgtaaactgtgtaattggtttttttcgtccatatttaatgttctatgcatgtgtccaaatatttgatgtgacggaatttttggaagtttgaagggaactaaacactgcctacctcccgatttatctatcttctttggcaattactaccaacctatccttcacccaacaagctaacaaccaacttcccattctctaaaatctacaaatagtgttctacatagagat

SEQ ID NO: 52132 - DNA, 1501 bp, Oryza sativa
ttctttgtatcatttaagaattgagctctgaaaaatccgagaaaatttcagagagtatacttaatcacagagaatttaataaaaattaaattcatccatgctttatatttaggaaattttatttcccacatttaacttcacttgtaaattaatgaacatttaatataaattctattaataatttattaaataatttataaatcctaaaacgaaaattcaggctgtgatcggccaagcccgacggctgctccccgcgccgtccgattggcggggaggccgatttgggccgtcggtcctgtggaccggaggtggaccacccgcgtggtcccggtccacgttggaccgggccccttgagccgctgccggttggggcccgcttgccggcacctctcccctccccttgtgtcgctgatccatggggcctgcttgtcggcgctgcttcccctacttgatgatgtcagccctggaacatattgcgcaataaataattaaggcattttcttttatagtaaaaaacacagataatcttctaaaattcataactaattgatccgagttccgtttaagtccattcaactctcagtaaattcataaaaatgcatagaatccattaaaaatggttttgtttcctgtttcagtagacttatagcatgttttgcttgtgtgctttgcttgtcgcttagatttcggctgtttcgtcaatccgcggtttctcgaagacgttgctgaggtcccatcagtgcgagagcaaggcaagtcatgcattacaattgatcatattacacccaatttacaaatgtcccgcatttctattaaatgttgcattattttacaatgtcatgtggtatgggtcctattagtcagccatatattgtttaccttatgccattgataacttgggtattaaaatgtatagatgttggattaggaattgcttagccatgctgtcagggttatggataccacatacctaatagtagttgactaagctcgacggggcccaccatataccaagtcttgtacggaaacataccttgtatatagaaggagttccagataaggaatgacaaatagagttctatatggaaatgacatggactacgcagactgtattcatatttgtctccctagttctacttggacaagggatcatgtatgggtataaatacaagcctcctaggaggagaggagagagaccaatacaagccgcaaagccgatacaagccaacacacaccaccaaatatcgacattagagattagtctagacataccccatcaggtgtctacgaagatcggcaagagggatctagcgctatctctgatctcgacgagttcatactcgaggaggaagactaccatgtcatcgactacaagttggttatctagccgccaagtcgacgacagttagataggttatcccaattattgtactcggtggtatctatatcaatcctatataaacaggatgtagggctattacctgtcagataaggggctcga

SEQ ID NO: 52133 - DNA, 368 bp, Oryza sativa
aatcgacatttgatcggaatcggccagtttcaagttcagacttcggttggtgtgtagtctggctgtgtgggcttgggctgttagaaaggcctgatgggccagcactttattagaagaggaataagtctactttacgtccctccgctcatgccacaaccgcaaatcaggtattacttatctccaactcacaaagccgtcgcaaatcactcctcaaacagtttgggagatagtttcgtccgatgggcatctttcaccggttcaccccgttgactagctgagccagcacacgggccccacatgttagtgtcttgtagagaaggtgtggctggtgaaaactcaccgagggaggaggcagcacccaccgccca

SEQ ID NO: 52134 - DNA, 168 bp, Oryza sativa
cattttgggacaaaaaatgacttaaaataaaaaaaaatcaactacaaagttgtagattgcgtcgatggctacaagtttcatataaagtttgtcttcattagagttcacatgaaaaagttatgaattatttttaatgtaaagtctttagaccatcctatttgacccaga

SEQ ID NO: 52135 - DNA, 1501 bp, Oryza sativa
ctataggaaatttttctatttggccctttgattcaaaggattgaagctttccaaatcctatgaaattcctatggaatgacacattgcatgtggattttggagaaaatttagcaagagctccaacctcttggaaaatttcctttactctatctctctcatccgattcctacgtttttcctgcgctctaatcaaacgaccattcctgtgttttttctatgttttgcaatactctgttttacactttaattcctgtcagaatcatgtgtttttcctattcctctgttttttcaacactgcgatttaaagaggccatatagttttattaaatttactctaacttgttttttcgtgcgggaatacctctggatgactgatgacgtcagatcacctagaattgtcgataattaatgcggtcccttttcccgtcatgatatgtgaatagtgaaatctcaccgttcggtgaaaagaacatcagtacttcctccgtatcgtaataagtttatttttattttatttatttcaaaataagctcattattaaataatcattacatcggagtttataagaatataaataattatattgtgagaagataaaataaacaaatagttgtaataaaatttgataaaatagggaaaaaataaatttgtttttgaactgaggtattaattctggaagaaggaaatctcctaaagaacattagtattcacacatacctttcactccttgttttctctctttcgatgagtcatgaccgacccgtccttgatcacttaatcatgatacggtgaaaaacatactagtccacacgagttcaagggggagttgttgaatgcttctccgtcttaaaataaaatcatcgttaatcctttgtcctaaaaaagaattaactttggaattatcattccttcaaagtttataaaaacagaaaataaatatattgaaactagataaagtaaagaataattgtatttggatttaacaaataaggggtattttagttttttttaattttgtgttgatataattaggatgaataaaaattaagaatattctgagactgagagtatggagtgaaagggtagcttagctatgaacccatgatcactactagtatttggagattttaggagtactgttatacgtacgattcagctgtataacttactagaaaagtgtccgtgtattgcaatggtaaaaaaaaagaaaaaattgaggaaaagttgagaaagataatgtacattgtgtaattaattgaaataccaattttccggaatatttgggtattttttaagtacgtagtagtataattaaattaatttacaagcaaagtaagcgtgagaaaattaaccatgattaataatagtctttgaaaatttcttggaatttctagaacttaattgctaattttgataatacaaacatcatctttatttaaataaatctaaataaaagtccacatttctcttcgggtcattttccgcccattttcttcttcagc

SEQ ID NO: 52136 - DNA, 785 bp, Oryza sativa
ttctatcaataaacaaatattctagctcaaaaaaacctgctgtatgtttcgcgtataatgatttgtcttattttcttcagtactatcactagagaacatatgataacataggagtgtatatggaccataattaattttctgtactacacaaattggctagcaatcatatttgggtggtagaatctcaatgtagaatagaaagctggttgttagctagttgggtgaaagataggtcggcagaagccgccaaacgagatagataacgcgggaggaagaaggccaatgcaacatttgaaacttcaagtcctatctacatatccggttgatttttcaatgggaagcattcattggaagcgcatgctggtttggatgaattctcgtcaatcagatatagcttgtctggttcatttgggtctaactattttgatgcttatatgtcatctctttgttgaatataatgtgtcatctttgacttcatataaacatcttctatttttggatgacaatgacggataagacattagatatggtagtccttcctaagaatgcagtttttgagtattgactagaaatttgtgttgtcttcggttgttttatttgtgagtccttgtttaattaagttttcttttttcttttttataacactgtgtgcatctgatagatatgtaggccgggtgtaattttattttttaatgaaatattttcgattagaaaaaagaactacatagttgctgacccaatggaacgtcaatatagtctactcttttggacaaaacatgtcagca

SEQ ID NO: 52137 - DNA, 1501 bp, Oryza sativa
atattgatgagttatacaactttgtagttgatgaatttttcagttgaaatcatttagtatttataaatgttgtttgaagttgtcataatttgaaattcaaattcaaattattgaaacaaagtcatatagcaaaatgaccaaaataaaagtgaagaatcaaattatataatatcgacaattgtttacagtgaagaatcaaatattgtatattgctagaaaaatgcccgtgcattgcaacgggtgatgctagttttatacggtttagctaggatgaaattcactttgggaatttgcttggatatttttttaagaaaataatgaactgtaattaggagtccgactttcttctcatgttagcatgcgagtttttttaaagatatttcttatacgacttctttttatatttccaaaagaaaacgaatttaaaatcgactcaaacaaggatatgtatttccaaaaacaaacaaacttaaaaaccgactcaaatacgaatgacgtaccaaaatacaggcaaaaacatctttaatttttataatagtagagatgatgtcaagaaaaagtatggtacaaaattaaatatctacacaaaactgatgtaaaagttttttgaaaacacaaattaatgatctacacaaaatctatcatccatatataatcttagaataaaaaacacaaattaatgatctacacaaaatctatcatccatatataatcttagaaagaagtgccaatttcaagtcggtaaattagaacattaaagttagaagatgagtatgtgttacaatttgctaattatcacattttccgctctcaataagtatagaaaagacatcgtattcaaattgtattaaagactactccctccgtttttaaatatttgacgccattgacttttctaaacatatttggccgtttgttttattcaaaataatttaaataattatgaattcttttcctatcatttgatttattgttaaataaacttttatgtatatgtatagttttacatatttcacaaaagtttttgaataagatgaatggtcaaacatgtactataaagtcaatggtatcagatatttagaaacagagggagtaattagttactccatccgtcccaaaatgtaaaaacctaaaactgaatgagacgttttcgtactataaaatgtttcatctagtaatagattcttatattttgggacggagttactacaagatatatacttcctccattctcgaataaaattaacgtggacactaatctagtttagactttgattgcctggcttttttttctaaagaaaactataaacacttagaaatatgttatagatatgctatattattgatgtctgtaaaagcttcatgaatatgagcatccatttttcatcactcataatataatcatcagaagtaatttatggtcataatcaattataaaaatttttaaataagtgatggggcagcaaaatcaagttgagttaaaaaaaaacattgacaacca

SEQ ID NO: 52138 - DNA, 1501 bp, Oryza sativa
tgtaccctcagcttgtcctaaaagaaattattgaggttattcttcataattcaagaaaataacatttgctatgagccttctctcaattttatctgtcaaatgagcaagatccactacctttgaccttgtagttcccattggaagtcctagatatgtaaatgtaatagttcctactacacaccaaaaacaccggctagttgttacacctttttttctagtacatttagagatattaaacttcggcttatgaaaattcagtttgaggccggtggactaagcaaagtatttaataaagcttcaaggaaaaaacaagttcattctgtgaagcccacattaggattatagtatcacgagcatattgaataattgggaatccgcctccattattctcattgatatgtttgcatatcattcccatttgaatgccttgttaacaatgctttggagcaaataaactcccaggacttggagcaaataagctccccggacagtggatttccccgccttactcctcttctacactttaaggagtttggaactccatcgagaagcattgaggtataggcagttataaaaataaaaatgatatataccaattacaaccatttggttggaaaccccatatgcttcataatctctaaaacaacttcatgctcaataatggtgtcaaaggtattttcaaaatccaactttaagattacaatcaaattggttaaaaaaaatgaaactaggccagcacatatggcatgtagctcactataagaaaaaggcctaacacaacttgtatcatgtacatccgcacgagacgagtatgggtgaaatatgtgcccatagttacgtaggtgatttggtggctcgcaatataagcgtggcatctagttaatggaatcttcaatgttccatccaaaaaagtatgcttttggttgaatttcattgctaaatttttgagccttcctagaccactcggtcttcgacaatttctactcaagattctaggcatttcaaaatttgtcatctcattttttttaccgggaatttgtcatctcatttggctagatttcaaaattgcaaacaccaagtgaagtgagcatagctcaattgtttaagttcctaagtggaacctggccactcagtgaaaatatctatgttgacttgattaatcttaaaatataatggtccaatcttcgaatgtactcataaagatttgctaatgatagattaattaggcttaataaattcgtctcgcaattttctagcgatatctataatttgttttattattagactacgtttaatacttcaaatgtataaatgtatatccgtatatccgatgtgacaaccaaacctaaaacttttccctaactaaacgaagcctatatttcgaaaaaaaaaaaacttgcaaacacccatcgtaagtaggccctcccgaaatacttatttcatttctttcctcgataagttttttttttctcgctggcgccaagctcgtcaattcaaaaaa

SEQ ID NO: 52139 - DNA, 1028 bp, Oryza sativa
agcagagaagtattatacttgaccactttttgtgttagacattgatttgtttttatatattttttttagaactgtaggagtagtagacttcttcggtggtagagaagaatctcaaacactgtgcttgtactagtagcactgcattggatcgtgggactgtacatactactagcactgcactgaactgtcgttgctatggatcactaggtgtttggatccagggacataactttagtctatgtatttagacattaatttagagtattaaatatagactacttataaaactaattatataaatgaaagctaatttgcgagataaatttttcaagcctaattaatccataattagagaatgtttactgtagcatcatataggctaatcatgaattaattaggctcaatagattcgtctcgcgaattagtccaagattacggatgggttttattaatggtctacgtttaatatttataattagtgtccaaacatccgatgtgatagggacttaaaagtagtcccatataaacaaggtcttatgtagcacttctttttataggctttgagtcttaaatatatactccgtactgtgtattattatgaatataattgtctattttgttatttgagatagtggaaattaaattttcttattaatttacaatattgtgatggtagtgattattttatatggatttctacgatgatgatgatctccttgctcaatggtgggagcaggaggaagcgtctgacgacgatgactactatattgcagctgctcttcttactgacatagagcataagagaaccaaaaggaagcatcgtggttcagtcatgggtcaagagataatttacagggacagatttgctggcaatttgcgcatagtggctgattattttgcagatcctcctatatatagtgcaaaattatttagaaggaggttcaggaggatgtcaagggagctctttttgcgcatagtggctagtgtggaggcacatgatgactactttaggcaaagaccaaacgcgg

SEQ ID NO: 52140 - DNA, 1501 bp, Oryza sativa
aggacaccttgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtccttgtgcacttcgatccccaggtagaaggagagaggcccctgatcactcatctggaaggtggccttcatctcctccttgaacgccgcgacctccgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgctgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgatgatggctccggcttcatccctctttagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgttgtacgcgtcgatgcgctccccgtcgtgggagagcggagtagcgaactccaccgggctacgctcaacacgagctggcgtcagagtagacgtgcttggaggagtggctgttggtactggagcatgtggagtcactggctggggtggtgtcgacgaagagctcgtcgtagtcgaagtcgtggcccgagggtgtgttggtgttggagtcggtggagattcaggggctagggtagacacgctaggtgaagaagagctgcctactcccccagctccctcgaagtggacgtactcgacggtgaagtcgtcgtacgtcggaatcgaaccatcgtccaccgcc

SEQ ID NO: 52141 - DNA, 1151 bp, Oryza sativa
cggttgacctcaaagttagtgaaattggctgtctggtggttttgggtgccaatggtttttcattctcgggtctctgaggccctgtttagatgggactaaaacttttttattaaatgtttaaatactaattataaatattaaatatagactattaataaaacccatccataattttaaactaattggcgagacgaatctattgagcctaattaatctatgattagcctatgtgatgctgcaataaacattctctaattatggattaattaggcttaaaaaaatttgtctcgcaaattagctttcatttatgtaattagttttataagtagtctatatttaatactctaaattagtgtctaaatatagagactaaagttaagtccctggatcaaaacaccacctcactgggttgggaaattattactactttatgtgtctcttttttaaaaaaatgttcagattcataacagtagattgtgtctgatatagtattagctatgttgttagtttctagaacagaggaagtaaaaacttttatttgtcatccattatgatattgcttgtgattcctactacactccctctactgaggtgtattatttagatatttaatattttcatgtttatctataacctctctaaatcacatactactagaaaaacaatttttaccaacatatttttattttctcaggtggagagaaaaaaatactctcttataaccgtttacaaaaatagagatttagcctcgcctggcaaaatcaatttttatgtttggagtcttaagagatccgcctataaaaacatttattttcataacggacgtccgaatatatgatttttgcaagccgtccgtaaaatatggggatcctattaggtcatggctcctctcctccatcccctcttctccctcagctctctctctccctgcacctactcccactacctcacactccttccccacctccatccctatccccccaccattgcctccagccgataatgacgacaacggcacaatgcttggatccgccaccggccacgacgacggcagcaatggcgaagatgacggctgcgactggctgcgacgatgacaatgacggtgcttggacaatagcaatgggattcgcttcctgctggcctcgggtgca

SEQ ID NO: 52142 - DNA, 488 bp, Oryza sativa
tcaaaaatatcaaaattttgatatgtgaaaatgacattagtagatttgtcatagaaaatctttgatttagttatattttaatagtttttatgaatttatgattagaaaagaattgatcaaacatttcacaatttgtgtcagattttactgatgttttaaacatcatctagaaaagaatggatgtataatttgtaagtaggcataatgcttcactaacatatcagtatacatttgtatagctgcccagcacaacccagaaattcgttgtacataaaaacaatagcggaaaattaaaaactttttaaatatggcatggtgtgtcactaacatgtgggcctagggcttagctccacagtgttggacatgtgttatagatatcaatggactcaccgtctcaccgaatacaacctggatttatctttccgatattgatatctgtcattgaccaacgacatctactgatttctcagtcaacaattaatggcagg

SEQ ID NO: 52143 - DNA, 878 bp, Oryza sativa
aataaccaatgatctaatcgctacatataaactttgaaatttcgcttcttgtctacccacttaactagcatatcattatataaactgagctggtattaatctagcaacaaaaaaccaagaaccaaaaccaatgaagaacagacaacttcaccttctgttatagctaggaatatttgtgttccccctttggttgcaaccaaaggccaaatctcgtcatacacaaaacaaaaattgctgagattagtttacgggttggagattagagagagagagagagttgaggtctgaggagtaggggaagagaaggactggtaaaggaacatagctgttgaaccgaggggagcaccgccctggatctggcctgagggagaagccccacgtactagcacatctggccatcgcaagcggaactagtcaccaactcacctttgagctcgtcgggatgcgtgacgccgccgagcgctgctgtggggaggcgccaatgtgctgccaagatcttcgccatgggggtggagacggtggctgagagctcgatgacctggctacaggccgggagacggcggcgtgggggccggcgggtaacgacgactgggggggagcggaagaaaaaatggccattttgccatgttcaaaacacggtttcgctagaatgccattccgaaaacgtgattcgataaaataccaatatgaagcgtgcgtctaccaccactttgctattttcaccattttattcattttcgaaaagattttctctcctctactaggtgttgagacaaaattgccccttatcaacttagagaacaccgtgagagaggagacacagagaaggggcggcgacgccgctattgccggccggcgcgccgcctctccgcatcatg

SEQ ID NO: 52144 - DNA, 561 bp, Oryza sativa
tgcggcagagccagccatgcaatgtccctcatgcttgtcgtgctccagcttaggctcctcttcctcctctccagcctcatcatcaacaccatcctggcgtgccctccctccatcccgaatcctcagctggattggtagcaaaatcttttgttgttctcaatttatcaatagggtgttttaggcgatctgatgcagccacatgcttgcatagctcatcagaggagatcatgcgaatgccgccatcgttgccctcgccacggtggtcctccatggaggacaccacatcactgttgtatgttgttgtgtgggtcatgtgaaacgacggcttgtttctttttctttctcttttttacctgcagacaagaggaaggagagaggtctgaggggcattatcgtcttttaaaaaattgctctctccatttgatccaagaaataataaagtaatggcttcagtatcctttagcaaattacatcttttttaaagtgtcctaaagccaagtcacgtttttatgatgtcccacagctaattacatattttttgagtgtcctgtagcaaatttt

SEQ ID NO: 52145 - DNA, 465 bp, Oryza sativa
ccatgccggcgctagccccttgcctctgctccaccatcgcgggtggcggcatttacaggggtgcagaggtcggccttcatcgagtcgacgacgttcttgcggagcttcatcatgtagagggcctcgtcgatgatcgatcccgttctcagcgttggcgccggccccgagtaaagcatgcgaaggccgccgcggcggacgcgcacgatgttgccgcgcatgatgcggagaggcggcgcgccggccggcaatagcggcgtcgccgccccttctctgtgtctcctctctcacggtgttctctaagttgataaggggcaattttgtctcaacacctagtagaggagagaaaatcttttcgaaaatgaataaaatggtgaaaatagcaaagtggtggtagacgcacgcttcatattggtattttatcgaatcacgttttcggaatggcattctagcgaaaccgtgttttga

SEQ ID NO: 52146 - DNA, 1501 bp, Oryza sativa
aggaccggttcgcgagctactgttgtgaaacatttatcgtgctaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagctgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgttgagtatgtcatatactcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtatgtaacgttattattaagatggatttgtatattaaattgtcagtttgtgtacctcggctgattcctggacgaggattttatgcacaaattagttcggaaattactagtgaattttcgggcgtgacaagttggtatcagagccaggttgactgtaggataagccaaatggtcaaaccttaaggacaaatcttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaatctatcttagaacctatgccgccaaagtgtctttgaagaatagttagtagggtagaacacttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaa

SEQ ID NO: 52147 - DNA, 173 bp, Oryza sativa
ccaagggagggaagggggacttttagggtttttctttttataaaatcattttaactttgtttatttcttaataattattatttgtgtctgaaaattccactaaaatttatttacgcattttaggcttttaggaaatttacaaaaatcctccaagccttatttgacttttaact

SEQ ID NO: 52148 - DNA, 1501 bp, Oryza sativa
gcaaaaaaagtacaccgtgtagtagtttaaaaagcgtgcgcgggggcaaaacactgtagcgcgcgctgggaaaacgtccaaacgaacccagcctaaattttttcctatcaactctatctgctaactatatttactccctccctctccctcgtagaaaccgttcacccactttcccctccatctccactttttatggatcggcagcgacgattacggcctgcgggtgcggcaggcggtcgccggcttgggcctcctcggtgtgctgggcggcaggcggcggggtccctccagcttcctccggcggcgggcgacggcgacggcctgcgccagcagcgagcgacgacgatggcctgcgccaacggtgggcgacgggctcggcggggctgtccctcgcccggatccggcgacggcggtcgtcctccgcctggatccagcggcgggggtttgaggtagagctggcttcgacgccgccgagatgaccctccccgtccacatcggtgcctcccttggtgccgccacctcccccgtccataaagcgccgccaccatcgccttctactcctgtcgctgtccaccccttttttttaggatcggcgaacggcgggcgagatccgggctggttgtcggcgttggaggtgtggaggcgcgtcgtccagttgtgagttggcaacaggacggtggacgccatccaaccatcaggcgccacccttgcccccttcctgttgcatcatcctccgctcctcgtcgccggatgtgacgaggacctcggcagtgccgatgcggaggtctgcctcaacagatcgagcggcggcatcgacctcgacggcaacgttgattgggctacatcctcggcggcggatcgagcgcacatcaatgcagctcctctctaagcgatagcggcaacaactggatcaggaggcctctccatcgtccgcccggccatccaccttcggcatcagcttcgtcgaacaggaggcggcagcctaggcggcggcgcggcagggggcgaccacctcatcgcgtgcctgtgatcccccgccgccggatccaggcgtcgcctccggcatggtcgaggcagcgaggcgttcttggtatcgatggtggtggactagatcttaatcatgtggtcagcttgcacctccttccttcctcacatctgaactaatggccgcctgggaggttctcgttttattgatgcagcgccatgtcggttcttggtggatgccgaatccttcaagatactccttccccgttccatgttcaccgaggacaaggtcaccttgctcaaaccctttttcctcattttgataacgcttgttggtgctgtgttgttgcttgtgtgcaggttctagacaaacaacaccatgagcgattccattcgcccggcatcacctccagcgtcgatatgttctgctccctttctcctgttcttctttcttttctacacttctttcacgcccatggttttcgcagtgatcaaaaccatggttgcatgatcaggt

SEQ ID NO: 52149 - DNA, 1501 bp, Oryza sativa
aagacgtgggtctatcccccgggcggcagtagaggcggatggggatgccgacgtctggtggagcttgatgaagacagcggtcgaggcggaaggacctgacaacgacggttgtgaaatcattgtcatgattaatatttatgatgaacaattggttttgtaaatgatttaatcaatgaattggttttaaaagatttgtggatgttggtgggagtgcgtgtgactaatgtgggtcaggttgtgatatttgtgctcaggaacagttgttttatctgattgtgtacaggtaacttgaggtcaaccttggtcaatggtgaggaccaggactatactcagggtggagcagaggtctagtacggtcgggataccatgtgagaaggcgactagagtcaggattcttggaggtcaacttcggtcaacggtggggatcgggactagactcagggaggagttgaggtccagacggttaaggataccgggtgatgaagttggatacgagatggcacacagtggatggacaccgtgtgggagtgatcttcgcaacgggcttcacaaggtgtacgtgcaagcgtcggtgttcacggaggagattggttgagaaattggagcataagtatatagttctacagtactctaggtactgtagcggtgttactgtattgtgcatgtatgcgaaaacgctttgtatcgagcgtccgatacaagacaaactccggacagtcgacgggacccacctttccccaatcttatcctcattccttctcatccccaacctctcgttcaacttcttctcctcggcgtctccaactctccatgctgcacacgcggccgcggcgtcatcagggggcgcaggcgccgctgccgccgccgacggcggggcttcctgtgcgggtggccagattatggcgccaccagtgatgttcgtcagcggcatcgtgtggcaggcacggtggctgtgttccgggtggcgtcgatggcgacgacagatggaagagagggaggaagcgtggggtggtgctcgtcgccggcgaggactaccatgcgcttgagcggcggccggtgcagcagttccagcggtagggtgcggtgagcaccggcaaccacgttggcggcaacggggcagcacgacggaaaagcttgagacgccatcacctgagagggttctgagctcggcgatgaaggtgaggaggcttgtggcaacgtctaactagttagcgaggattgttgcacactacatgtttattttgttgcatatagtgtgtttgtgatgttgcaatctgttttttctctggatgtttcttaaatcggtaatggatgttgtatttggtttcttcggatgttgcatatattggttttttttgttgcagacaacattatcgagtgttgcattcgattgaaacatcttcgataatgcggtgaaacattttttttcgagcgatgaaacatcaacaaacaattcctgttgaaacattttttttccgagtggtgaaacattgcaacattt

SEQ ID NO: 52150 - DNA, 1501 bp, Oryza sativa
gtttaaagaaaaagtttggaactaaactcggcctgacttgtgatgagctgctgacttcctgttcctaaagagatgaggatcagctggcagcaaaggcatgtagcggcggtggccgcagctcaacggatgcagcaggtggtggcgcgacgggtgctgcaccgtagcaccagtggcgctcgtagtctcggcgtcattgcttagtgggattagtgaacactgaacagtaattagtatttttggttgttgggttgttaggcatggtttcctggttgatggtggtcattgtactagtggaccttttggccactagtgctttattgggctaggcatgttatctgggtattatccggatatataaccgggtaatacccgtatttttaccagataatccgtatccgtcggataccgtcctcccgaatcccatctcatatccgatagaaaatacccgtattcgaacccgctatccgtagaaacttccgggtacccaaattttttacccaaaattgtcccgaaataatacggccgggcgggcgggtaatacccgccccgttttcacccctacctcccgtgcacctacgcttaacggagtaaggctgtgttcgtttggacgttttcccagcgcgctacagtaacacggaaaacggaacggttcattaacacgtgattaattaagtattagctaatttttttttcaaaaatagattaatttgatttttttaagcaacttttgtatagaaactttttgcaaaaaaagtacaccgtgtagtagtttaaaaagcgtgcgcgggggcaaaacactgtagcgcgcgctgggaaaacgtccaaacgaacccagcctaaattttttcctatcaactctatctgctaactatatttactccctccctctccctcgtagaaaccgttcacccactttcccctccatctccactttttatggatcggcagcgacgattacggcctgcgggtgcggcaggcggtcgccggcttgggcctcctcggtgtgctgggcggcaggcggcggggtccctccagcttcctccggcggcgggcgacggcgacggcctgcgccagcagcgagcgacgacgatggcctgcgccaacggtgggcgacgggctcggcggggctgtccctcgcccggatccggcgacggcggtcgtcctccgcctggatccagcggcgggggtttgaggtagagctggcttcgacgccgccgagatgaccctccccgtccacatcggtgcctcccttggtgccgccacctcccccgtccataaagcgccgccaccatcgccttctactcctgtcgctgtccaccccttttttttaggatcggcgaacggcgggcgagatccgggctggttgtcggcgttggaggtgtggaggcgcgtcgtccagttgtgagttggcaacaggacggtggacgccatccaaccatcaggcgccacccttgcccccttcctgttgcatcatcctccgctcctcgtcgccggatgtgac

SEQ ID NO: 52151 - DNA, 354 bp, Oryza sativa
atcactgttttatctagccatgcttatgtacttttgttatgaccttattattgttattgttattatggccttgttcaccttagaataaacaaaaccccaactagtggacactctactcatggtaccactagtatgattttaggtagatgcttcgctggttaattaggcaacattaggtggttttataactctagactttgggaatattttcatcacctggacactatagaatggttggattattgtggaattggattcacacctccccctctattcaaaacccttaaaatggttttaggctgggctcggggtgcatggttttgatagtagcacctcggccatataaggaccggt

SEQ ID NO: 52152 - DNA, 1501 bp, Oryza sativa; identical to SEQ ID NO: 32740

SEQ ID NO: 52153 - DNA, 1501 bp, Oryza sativa
atgaatcagtcattgattatgttaagagatttagcgatgttagaaaccgatgttatagcttgaatataactgatagagatttggctgatcttgcttttaatggtttaattgctcctattaaagaaagattagattgccaacaatttttttatgttagtcaactcatgcaaaaggctctggctcaggaaagccgggttaaggatagcaaaaaatttgttagagcctaatgttaatttgattgattatcctgaagctagtgatagtgatgatgagggtgatcatgatatgtatgttgcggagtgatcatgaactaacaaaaataagccttttgtttgctctaatttaatgccgactcctcgtaaagatcggcaaagtaaggttaagtatagttttgacgtggccaaatgtgatatgatttttttttatcttttgcaagaaaaacaaattagattacctaaaggccatgtcataccctctcaagtagaattgaagcgtcaagcttattgtaaatggcatgattctcactctcattctactaatgattgcaatgtgtttcgacgacaggtttaatcggccatagatgaagggcgattgaaatttaccgatggttccaagatgaagcttgatcatgatcctttcccggtgaatacaattaatttcaacaataagaaggtgttgattggtcaaggagtggtcattggagagcctaggccaaagatgatggtgccaaagaatccggaggttggtgtttggaaggagaataggagcgaagtttcaagttctaaagctcctaagaggactaaggtgaccttcgatatgcttttgaataagtatgagaagcaaggtggtgagaaagctcgcaacaaaaggaaaagaccaagatcacctcctagggagcgatttggtcattcaccaagacagtcggaatcacctacatatcatcgttctcaaaacatgtcatgggggccttatccaatgctgccgtcgggttatccttttccttactacatgccatggggggcaacaccatcaatgttcaatcatatgcctccaatgcaatacaaccggggccagctcgttagcgtttatctttaccaaacaatggccagttttatgctaagaaccgggccaatgaggagaaaagggaaggaaagcgtgtcaaagtggagattaggacttcggaggtgattactatcaaagtggggtctcatgatgagccaataccttctggagatgaagttggagagtcttcaagcaataaatccaacgccgggaccagctcatcgcaggcggccggtctgactaggccctctggccggtctgaccgcagccctaaggctggtctgaccgggccatcaggccggtttgaccgtcagcccaatgtcggtatgaccggcgcttctggctggtctgactaatggtctacgtccggtctaaccgggctccagcgccggttcgacaggagatttgcaaagggtagttcaggggcttcatcgtcttc

SEQ ID NO: 52154 - DNA, 259 bp, Oryza sativa
atatacatataaattggatttagccgatgacaacaaaggtttcactgtttaatctaatcttgtggatttcatgacatcggacctccagccgatgtgtgttttaaccttcggatcggtgattattatatcttgtttctagccgattggtttctactcggttatattgtttttttattacatcatcaacagcagattgcctttatatcattatctacattgcacatatagccgattgcttaatccctatcgctatcggctg

SEQ ID NO: 52155 - DNA, 526 bp, Oryza sativa
tgtgtataggggacgggagaggatggggtggcggcgttagcggtctggggagtgggggggagtggggcctgggagtgggagggtaagagtccaagagatgagcactttaattagtgggctgatgactgatgagattatcctacttgagcagagcccgccaataccaatttcaccagttccaaaatttctctcaccccgccctgtctccaaaatttcgagcttagttgtagatagatttttacaactaaaattctgtttttggaattcctaatttgattttaaggtgaaaatatatttttatttccaatatatatcttaaatggcattgttgcaaatagtagtcactgaagggagtacaagggagaaaaacgagtggcttatcgccttctcggcatggctagggcagctccaccgccgccgacgcgggcttcctccgaccgcattcgcttgcctctttccctttcacttgcaaggccgcattcgcttgctgttttcccgttcacctacaaggtcgcctcagcataga

SEQ ID NO: 52156 - DNA, 1501 bp, Oryza sativa
actgttcttctctctttctcttttaattaaaccaagctaatggcacatgcagattatagtctctttaattgttctcattaaaaatttacttattattcctgtgttgttagtactgtacatctattactgtactaatgactcatttaccagcaaaggttttacaacattatttttatttaatcatgttgcaatataataaacttagcatgttgattttataactctcttttattttagcttttttttaaacctgttattcaaaagtgcaaaaatttgtgatcctgttttcaactgttccaacttatcttagtttactttatttacctttcacttcgattttctaactttattcaatttaatccaaaaccttgtgctattaattggataaatgtcttaactccctcctttcacttgtctttagatgccacgcttcaagcctgagcacttgttcggtattgagggatttgtccaggagctgcgtatgatgtcctttaccataggattcgagactgcccctttgtatgcccagattcctcatgatcgtgatgaagagaagtgccgtgtcatggtcaccttgaacagtgatcgtgaagacatcccatcgatgatgttcgaggctggagggggaagctatcctcaagcttgtcaggaggcggcaaggatcgccataggagagctccgtgaccgttacaatgatctgttggccgacactgagtatcgttgccatcctcgtcagccccagggaagtgaccgtgccagctatgttgatcctgaaggaattgagaatgatgctaccataagacatttggtcgagatgctgtgggccatggatgagtcccgcgctgaagttgtgtcagctgctcaagcttgtgaagatcggaaccgtggtaagatctgcaagctagaggacaaggttgatcgtctggagaaggaactagccgaattgaagggagaagcgccaccacagaaggccagggttcatcttactgcaaggaagagagctctttttgttccctgctaccagttggtgcccaaggttcgtgtggtggcaagagaagctgtcccagtcccagtggatcctccggtcgttaatttaagtgatgaggaggaagaagattcaaagcgcacccattcaaaggttgagtggggtgctactcaagatgatgagaacgagccgaacgagccttcaatcaactccgatgccaggaagatctagatgtcttgttaagtcgttgccttagttcgttgtgttagtttgcttgtttaagtttggctatgtgtgggtcttgcatgtggtttacatcattggtgggatgtaaatgcatgcgtttgtttggtttcgagtgttaggaagtttgagttaagtggtgtgagagtcttcagttttatgtaataatgaaactcagttaagatcaataaaagtcaagttagtagaaattaattccctgtcctaagtagctttctcccttgtttctcttcttgtgctcttgcctatgccaga

SEQ ID NO: 52157 - DNA, 1501 bp, Oryza sativa
ggttgtgaaacattaaccgtgccaaccacaagccagcgtgggcaacggctttaacttttgtatagtgtggttcattgtggggaaccagactgagaagtggcggagataagcccacgggggtcgctggggagtccatgccttgttttataagggggtgattatgatccaagaaaggtgcactgctttgaattgtgttttgcggaggttattgtcacaatctctattcgggttcttgttaagtatcgcgacgcatggttgacatgatgttgaggttgtgtcttgtgggtacagtggtacacctctggccagaataaaactattcgaatagccgtgcccgcggttatgggcgggtctaacaatgtcttttgtgattagtctcacacctttcaccataataaatgatgctgtaattggtaataacttgtttagctcctggtttagaatggtatattcctggtttggagatagaactgtgcagccaggaatggttgttcagaatggttgggcctatgcaacgggtatgttgtatagcgttggattaatattgtttaattaaatgctttactgtttttctaaattctgaagtatttattgattgccatttatgcaaatgagactatattatgccatcctttgttatcccctgcacttgaatatttgctgcgtggcttgttgagtgtgtcatatactcaccttgcaaccattcatcagaggagttctacagtgaggctgaaggtgtggaggattaggcgtagccctggtcaagctgcttgtgggatggagtcgcctacgctctttattttattttccgctgcttagatctttattgtttaagaggaactatctatctctataatgaatttatatccgtctattaattagagtaataattgcactctattatcaatttgttattgtatgcctcgactgattcctggacgagggtttacacacatgtaagtgtttggagttttggatagaaattctgggcgtgacaagttggtatcagagcctccttgaccctaggttatgccaaatggttacctatagaagccctctaaaaatattaaaaaagtagaactgttcttctctctttctcttttaattaaaccaagctaatggcacatgcagattatagtctctttaattgttctcattaaaaatttacttattattcctgtgttgttagtactgtacatctattactgtactaatgactcatttaccagcaaaggttttacaacattatttttatttaatcatgttgcaatataataaacttagcatgttgattttataactctcttttattttagcttttttttaaacctgttattcaaaagtgcaaaaatttgtgatcctgttttcaactgttccaacttatcttagtttactttatttacctttcacttcgattttctaactttattcaatttaatccaaaaccttgtgctattaattggataaatgtcttaactccctcctttcacttgtctttaga

SEQ ID NO: 52158 - DNA, 1501 bp, Oryza sativa
tcaccctttgagcattcgctcaggggttatttctatctaatattcttttctgagtattgatttcaggaaaattctattcttttctgagtattgttgaggaatacggaatgaagagatggtgtacccgccgagataaaatttcttgacttcaatccaaattctcgattacagcaagacgggagacttagtcgtacgctctgtactttctcggtcgacatcagagattgacttagacaaaccctttcggtgcccgcacgaggctgatagaggaagtctaacgttatctctaaactcaccgagaacggtcacatgagctcgataacagttcctccaaagtctgcggttgagaatatgaactcgttcatttgcatcgaagtcgggggctactgtcagggttatggataccacatacctaatagtagttgactaaatctcggcaggacccactatataccatatcctatacggaagcaccttcggatataggaggagttccggataaggaatgacaaccagagttctacatgaaaacgacaaggactactcggattgtatctatattggtttcactagttctacttggacaaggggatacctgtgggtataaatacaagcccccaaggagaagaggggagaggagacgatcaacacgatcggcacccaccatggaggatcaacactcaacataatcgagatagaagccacaacatggaagcctacatacgccaagacacgccgccggatatcgacttcagggataagcacggctagtaccctacggtgtctccggatactgtcaggagagacgaaagcgctatctctgatcttaccgggcacggattcgaggagaaaggctaccctgttgtcgactacgagtcagaccgccatgtcgacaacagttagataggctaccccaaatattatactggtgtgattatcatgaataagagcaataccggcttcggccaacaggatgtagggttattacctgacaatacaggatgtagggttattacctcagtctcgcatatatcctagcaccgacgatccccatactatgcaaataccagaattgcgacatcaaacgtcgacaaattggattagcaagaacattatatggttttagctaaagtaattaggatgcttagccatggttagagacactagctcatatgaatgggataactaatgattcactattacttaatgatcgattaatggtagctcatgatggtcaatcgtgataggatggtttattaagatgccaactaaaacatggtaatggtgggttgtgagcacatggttttgatggtcgtactcatgacaattaaggaccggttcacgatttttggttgtgaaacattaaccgtgccaaccacaagccagcgtgggcaacggctttaacttttgtatagtgtggttcattgtggggaaccagactgagaagtggcggagataagcccacgggggtcgctggggagtccatgccttgttttataag

SEQ ID NO: 52159 - DNA, 1501 bp, Oryza sativa
ctcggtgagttcgccgcttcgccctctacccgtaggtgcagttcgtttgcgccgccgcgccgtcgttcgccggcgagcaagtggtgccgagccgccgtcggcaatgacatcatcgtcgacgtcagcgccacgtcagccgtagacccgtggtaggtcggttagatctcggccgttcgttttgtttagattagatctcagccgttcgttccgtagaccgcttctgttcactcggtccaccatgaacccgagccccgctgacgcaataaatcctttttccgtttcaaaaataattctttattgcatcataatccaattaaaatctatataaatgatttaatccggtttaatctttaaaaattcataactaattcatcttagctcggatttagttggttcaagtctctaaattgttctaaaattgagatctacatgttaaaaatatccacatgtgctgtttatgattgtttgtgtactgttttggtgattttactcttttatgcttagattccgacgttcttggagagtccgattttgcaggagaagactttgaagaattccaaggctagcaaggcaagtcacacagatcccaaacaacccttggagcatgttaatcctgtttaaagctattgtttctattcaactattgcatttatttttgaatacatcgggtggaaatgacctatttcctttgttatagccattttgttattgattacctatactttgtcacctggttaataattgtgtcagggttatggttaccacatacctaatagtagttgactaaatctcagcaggacccactaataccatatcctatacggaagcaaccttcggatatatacaaccagagttccacatggaaacgacaaggactactcggattgtatccatatttgtttccctagttctacttggacaaggggacgccaatgggtataaatacaagcccccttaggaggagaggggagaggagacgatcaacacgatcggcacccaccatggaggatcaacactcaacacaatcgacatagaagccacaacatggaagcctacatacgccaagacacgccgccggatatcgacttcagggataagcacgacttccgaatactgtcaggagagacgaaagtgctatctctgatcttgccaggcacggatgcgaggagaaaggctaccctgttgtcgactacgagtcagactgccatgtcgataacagttagataggctaccctaaatattgtactggtgtgattatcatgaataagagcaataccggcttcggccaacaggatgtagggttattacctgacaattcaggggcccgaacctgtataaaaatccctgtctccatctcttttacctcagtctcgcatatatcctagcaccgacgatccccatactatgcaaataccagaattgcgacatcaaacgtcgacagtggcgtgctaggtagggggattttggtgcttcaggatttcgacgagatgggttcaaaaga

SEQ ID NO: 52160 - DNA, 1501 bp, Oryza sativa
acatcaactcagacgatgaatcaatcggacgatgttgagaaccatacttatgtatgaatgggcgaagaacgcagacttgacacgatgaatcaggccaaaattcactagtctacgaagtaaagcagtagaggaggccgccagccgaaattgggctgggttgggccagccccaggttttggctggacggtggagatgaagccccaatgacggttggagggtattaccgaccattccaactgtcacaactgtcatagttcagctataaaaggatttcaccttctcactgcactcacacacctcaagcaagaggtctctcattcctctcaagtttagtttagtattatctagctggtggaatagaattagaataggaatcaggagtccggaagccttcggaagagttcgggtatggctctagtagctttcctttcctcttttgtaagctttgtacttttatccgaatactcttctaaatatatttctggtattgaaatactttctgagtatatgagtaccaactttacattatgttcatgttatactgaatatacggctagctaatctgggagatgctttggtgcgggtatagtgtttgcttatgcaattactctatgtcatgacgatgatattagagtagtatctggtagtttaggcgtggtgtctagattacgggatatcattatttggggttacatattgcggataagaggtgagccgctgatggtgatagctcactacgagtattcctccgcgcctatatataatcctaagttaatttcctggggagggtattcctccgtatttagccccggttggatggtcatgacgggctgtcgtaaggaactcggcagtcaggggtggcttctcgaagtactaggagggcatcggatagagggtattagctagtatatcagttaactagaatgtatgtatactatgtatattagaagtatgggaatagattctctttctcttttctttccacctagcttagatgtcacatcctaaaaatcccaaatttataaattgttgtttaaatggaattattagaaatgattttaaaagcctagaagaaaagatctaattttaagtaataaattcaaatataaaagtgggctagataaaattttatcaaatacttcacttgattagttcctagatttttctcggatttatttgagccaagaaagtaattataataaatggaattgcatttcatgaataatttaaaaggaaaaaggtttaaaaatccttcttttggttttgggccaaaagtcagcccaagtctctctctctctctccggcttgctcgcgctcggcccaagtcggcccatcaagccaatccgccctctctccctcttctctcccgctggcgggtggggcccacctgtcggggtcgtcttccatctcccaccgccagccgcgccctagccgcgcacaagccgccgccggacgccatgggcctagctgccgccccctagcccctataaaaggatcctca

SEQ ID NO: 52161 - DNA, 1501 bp, Oryza sativa
attcaggaccttggtgcaggttgattggtataactctgtgatcatgggaagatctcatccagtagtagacatgaagtggctagactggcagtacatgtcctgaaaaaacaacatagtcttcaatgaggtacgcaaggtgtgtgagcgcaagcacgtggcagatttgttggccttgcagtattcctggaatgaggaagtgattggacagttctactccactactttctttggcaccaccaagaaggggattgattttgtgaagtggaccattcaggggcagcagtatagggtttctatggcacagtttgctgcagctttggggttagatgatgatgacctgagtcgtccacatatctttgtagaggatgctctgtcaccgaccagcactacctttatgtatgagaaggatgctcccaaggattgtttggggactactcgagggttgcgtccatattatagagtgttgtactctatcttcaggtggtctttactccccaaagtaggagatgctacagctcttccaggtaggcatgcgctcctcctcagtcgcatgtgctacaacaagccagatttcagcatcatgaagcttatttggagtgagatctatgagatataacttgttatcgactggttcttattgctagaaaacaatcgatagggttatgttctgttattaatctagattgtatcgtgtatctaccatctcttagagtttttcatcatcttgcctagatcttatatttgtctttatgcttaatgctgcatcggttgagatcgatctattaagtaatatctgtaattatgatatctagcatgttttatgattatcaagagagatagtatcggggtttcagccgatcttacctgatttagctactttatacgttatgtgcttgattgatatgctaagtctgccctttatattaagatcctattgcaataaagtatattaagctacttgtttgatatattctacttgttctaatatcttaatatagagtggtatcggagtactagccgatacatgctagatctatctgattggctatgctataagcatttataatctttgtgttaatgtatacttcgatctaagtgatttatactgtctcagcatggcgaccgatctatcccaatcacttggtttaaatatacatcaacagaaggattacatagcgttaatatctacagccgatcgagtagatttagtcttactttgcttacttataattgccgatcgattcacatatgacatcggcttcaaaatacatgatatgtcatcggcgactggccgatcggctatcgtttatggatttaaccgcggtttttcttgtctttctttcttgttgattgcaggatcaaatcaactggcacgctcacgaaactaaaagcaagattttggatctgcactgaagttaagcagatcttccaggccagtgtgcgtttttcgcatcaacacgcttttggcatgcctggtgggaccgacaagtaataacaatgt

SEQ ID NO: 52162 - DNA, 1501 bp, Oryza sativa
aataatgttgtaaaacctttgctggtaaatgagtcattagtacagtaatagatgtacagtactaacaacacaggaataataagtaaatttttaatgagaacaattaaagagactataatctgcatgtgccattagcttggtttaattaaaagagaaagagagaagaacagttctacttttttaatatttttagagggcttctataggtaaccatttggcataacctagggtcaaggaggctctgataccaacttgtcacgcccagaatttctatccaaaactccaaacacttacatgtgtgtaaaccctcgtccaggaatcagtcgaggcatacaataacaaattgataatagagtgcaattattactctaattaatagacggatataaattcattatagagatagatagttcctcttaaacaataaagatctaagcagcggaaaataaaataaagagcgtaggcgactccatcccacaagcagcttgaccagggctacgcctaatcctccacaccttcagcctcactgtagaactcctctgatgaatggttgcaaggtgagtatatgacacactcaacaagccacgcagcaaatattcaagtgcaggggataacaaaggatggcataatatagtctcatttgcataaatggcaatcaataaatacttcagaatttagaaaaacagtaaagcatttaattaaacaatattaatccaacgctatacaacatacccgttgcataggcccaaccattctgaacaaccattcctggctgcacagttctatctccaaaccaggaatataccattctaaaccaggagctaaacaagttattaccaattacagcatcatttattatggtgaaaggtgtgagactaatcacaaaagacattgttagacccgcccataaccgcgggcacggctattcgaatagttttattctggccagaggtgtaccactgtacccacaagacacaacctcaacatcatgtcaaccatgcgtcgcgatacttaacaagaacccgaatagagattgtgacaataacctccgcaaaacacaattcaaagcagtgcacctttcttggatcataatcacccccttataaaacaaggcatggactccccagcgacccccgtgggcttatctccgccacttctcagtctggttccccacaatgaaccacactatacaaaagttaaagccgttgcccacgctggcttgtggttggcacggttaatgtttcacaaccaaaaatcgtgaaccggtccttaattgtcatgagtacgaccatcaaaaccatgtgctcacaacccaccattaccatgttttagttggcatcttaataaaccatcctatcacgattgaccatcatgagctaccattaatcgatcattaagtaatagtgaatcattagttatcccattcatatgagctagtgtctctaaccatggctaagcatcctaattactttagctaaaaccatataatgttcttgctaat

SEQ ID NO: 52163 - DNA, 1501 bp, Oryza sativa
atatataagtcatcaagaatgcatcctattgcacgagagcaactgagcaagcaagcaaacaacggcaagcacagacgtaagtgcctggtttcttccccaattgcctcccgcagccgtgggtcgtctggcagagaagagctgctccggctcgtcggcgtctcctcgtcatcgtcggcgggatccatggcggagtggatctgtggatggatgggtggaggcgaagccgcaggccgcagctagagctaggtaggaggaggaaggagcgagccctagctaggtgaagtaggtcccttttcgttcgaggaagacgaaggggaagggaaggcacattgcgaaatttgatattttaccatcgttaggcagctggattcgccgaaaatatcattatcaattgagaggcttcactcatatgccattttcttctaattctctctttcgtcttattattattgactaaaatactcctagttgaatcaatttaagtatatcaaaaaatacgtagattataaagtaaatataccaaaatagttttacatgttattttttttctctacaccatattacatagtatgcggcgtattatctccacaacataaaaaaaaacactctcaactgaaactctcataaaaaatacgtaattattttttatttatgctgtgaagatagtgtcttatactctgtaatttggtgtaaagaaaaaaaaacatatatattgcatgtcaatatatttgtgcgatatgtactctgtaatctacatatttgctttacttgaattaattcaactaggggtattttggtcagcaaatataagagaaaaaagagaattggaagaaaatggtgtttcggcaaaacccctcaattgagaatggtatttcggcgaatcccaactataagtggtatttgggtgaaaccctattttaacgatggtattatgccaattttctcctagctatgtagtgttatcatggcgcatgggcctttgggattcggcccagtttccactgttttgggccaataagttcatctgaggtccttaagttgtcagcgaatctgattttcgtcctttatctagaaaacgatacaacgggttcctcaactgttaaaaccgatgcaatataggtctcatggcggtttgaacggcgattttagctaacgtggcattgacgtgacaatttaatttggaaaatattaaaaactgtgaccccacatattagttacaccaaaataatgaattaaaaaatggtgggctcatgtggaccccataggttctcaaccccccccctctctctctcttcctcccggttttgctactgggaaagagtagcatgtaggggttgggtgggggggtgatcgcccgagcggtcacccacccattagcaccccctcttcctcctccctctcggcctctccacattaatgccacatgtaaactcataattacaaaagccacaatagatcgacaaattttctaatggagcaagcatgcatacacacggctagg

SEQ ID NO: 52164 - DNA, 498 bp, Oryza sativa
cgggggaggggggtggcgccgtggcggcggcgtgatctggagatgagattggagcccgaggcgcggtgttcggagacgacctgcctgccatgacgaccaacaccaagcgcgcctacaagctccgtatcctcgcgaattcgtttccagtatttttgactagtattttttgtattttttttcgaggtacattgtgtctgtttgaccgatccatcgccactgtcgcattcattctgctagctgggcgatttagttcttcaaatttaacccatcattttattatgcttttatctcgcttgcccctcgttaagataatgggggatttagtgtttgctcgattttatcacttaagctgttgctgatcactagttagtagtgaccgtggttatgtctgattgtcggacaagtgggattactgctgctttgtgcttatgaactgcctgaagattgcaacatgatttatttgggggtgattttgtgggtgaacttgcgacattggaa

SEQ ID NO: 52165 - DNA, 1501 bp, Oryza sativa
gcaatatagttaaaaaaaccaaatgaaaagaaccaacaccgccagcatgctcaatcgttacaaagttacaattatgtgatttaccaaatccaaaattaagacatgtactatggtaatccaacagttttagataagaatctcacttacaatattaagttacccacaaatcaaactatgtggaattttggatgatcaagtacattctggcttgagcatattaagactgaaaccagtgaaccacaatctaactttttttttttaaaagaaccacaatctaacatgactattcaccattctagagttatcaaattcagatgactacaaaaagggtatacggatgtgttgagtgggttgcagcttgatggatgctgcaatcgcctaacaaatgataaatcatattgacagagatgttcctgcattttgaaaatatgacataatctctaacctttgttgatataaaatatcctttgtcgacacattaaaaaaactgtaaatcaactacagtaaaaatgcagcatcagattatttgaaatgagtgaggggttttgcagctgagccaaagtggcggattcgcacttgatcagtatcatatcatcaagaacaaaattgttttacaaaattcaagaactggaatgcccagatctaacatgcagcgatccagcggaaagcgaccagacggcggcggcccgaggtcggtgctggttgaggaaggcggcgtcgactcgacgcagcggaaaggcgcgcgggaatggaagacctggtcgcgctaggcgggatggccggaggagatcgggctagggtttagggtagaggagcacacgcatacctggcgagttctcaccacggcgatctccaggggaatctcgaacgccgttgatggcgcggtggtcgccggctgctcgctggcttgtggtttgcgtcgccgtcccctcgtcgcgcttggcctgagagagagagagagagagagagaagagatcgggaggaggagttgggccgatgggagaagctttcttgatgtcgtgggccgcggcccgttgggagcggaaaaaacaataaaaacggatggaaatgaccgttcggtttgcaatcgcgtctctcacgaagccaatgggatcgtggtaatgctaataaccaaattggggttttacgattggtttcacacgaatgattaaatcatagaagctttgattacaagggtgattactgattaggaggaattaaattaggatggtaacggtaacacctcccaaaccaggaagtgacggatggaaatgactcggaatgtaacgtaaaacgttgctattttccaggatttgctgcctctttttttctgctatagttggcacgctcttaaaaagcagaaacttgtcagacaaaaaaaaatgtataagagcgaaactgacgacataatacgttattacgtcacgtacgaccaccatgattattagtgtgacgcaaataaccagtgcaacaaaaatggagttagagcagcacggcaagg

SEQ ID NO: 52166 - DNA, 1501 bp, Oryza sativa
tggcataatataggggtcatttgcaaaagcagcatttagcaaacatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaagagctaaacaaattattaccagttatagcatcttttattatggtgagaagtgtgaaactaatcacgaaagacattgttagacccgcccataaccgcgggcacggctattcgaatagttttactctagccagaggtgtaccactgtacccacaagacacagccccacaacatgtcaccatgtgcctcaataccaccacggtacctcggaaaggagctgtgacagtacccctcgcacaacacaatccaccacagcgcacctttcctagatcataatcacccccttataaacaaggcatggactccccagcgacccccgtaggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccattgttaaataatagtgagtcataagtcaacccaatagtgtgctaatgtttctaagcatggctaagcaatcatatctaatatctagctgaaccaatatatatagcccaactagtcaagttataataacccaaggtatcaaggaataaagtaatcaagaacaaaagggctataacaaacaataggtcaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacaaactctccggaaacgtcgggatctaaacagaaaagagcaaaaacaccaaaaaagtacataaacaagcatgaacagtaatgtggatatttttaacatgtagatctctattttagaaaaaattagagacttgaaccaactaaatccgagctaagatgaattagttatgaattttcaaagattaaatcggattaaatcatttatttagattttaattgaattatgacgcaataatgaattatttttgaaaaggaaaagggaattattgcgtcagcggctagggttcgcggtgaatcgggtgcacggcggcagctcacggaaacgaacggccgagatcgatcctatccacaacggacggccaagatccatcggtccacgaccgggccacggggaacgacgacga

SEQ ID NO: 52167 - DNA, 1501 bp, Oryza sativa
tgatgtaaatcacatgcgagacacacacaaccaaacttaaacaaacaaactaacacaacaatctaagacaacggcttgacaaggcactctaggtcttccgggcatcggagttgattgaaggctcgttcggctcgtctccatcatcttgagtagctccccactcgacctttgaatgggtgcgcttcaatttttctccttcatcatcacttacattgacgaccggaggatccgctagggctggggtaacttctttctccaccacacggacctttggcgccaattggtagcgagggacaaatagagctctcttccttgcggtaagacgaatcctggccttctgcggtggtgcttctcccttcaacgcggctagttccttttccaaacgatccaccttgtcctctagcctgcaaatcttaccacgattccggtcttcacgatcttgagctgctagcacaacctccgcgcgggtttcatccatagcccacagcatctcaaccaaatgccttgtggtagcatcattctcaatctcctcagtctcaaggtagccgccacggtcacttccctggggttggcgaggatggtagcgatactcagtgtcggccaactgatcactgtagcgatcgcggagctctcctatggcgatccttgccacctcctgacatgcatggatgtagtttcctcctccagcttcgaacatcactgatgggatatcttcactattactgttcaaggtgactttgactcggcacttctcttcgtgacgatcatgaggaatctgggcatacaaaggggcagtcccaaatcctatggcaaaggacatcgtacgcaactcctggacaaatccctcaacaccaaacaagtactcaggcttgtagcgcggcatctaaagacaagtgaaaggagggagttaagatatttatccaattaatagcacaagtttttggattaatttgaataaagttataaaatcaaagtaaaaggtaagtaaataaagtaaaccaagcttgcaagataagttgaaacagttggaaacaaggtcacaaattttgtacttttgaacaacaggttccaaaagaaataaaagaaagttataaaatcaacatgctaaatttatttcattgcagcaagattaaataaaacaatgttgtaaaacatttgctggtaaatgagccattagtacagtaatagatgtacagtactaataacactggaataaattttgaatgagaaccactaaaagagattatgaagtgcatgtgccattagtttggtttaattaaaagagaaagggaggagaacagttctacttttccaatatttttagagggcttctatgggtaaccatttggcataacctagggtcaaggggctctgatactaacttgtcacgcccggaatttctatccaaaattccaaacgcttacatgtgtgtgaaccctcgtccaggaatcagccgaggcacacaataataaattgataatagagtacaattattactcta

SEQ ID NO: 52168 - DNA, 1501 bp, Oryza sativa
cggttgtgaaacattaaccgtgccaaccacaagccagcgtgggcaacggctttaccttttgtatagcatggttcattgcggagcaccagactgagaagtggcggagataagcctacgggggtcgctggggagtccatgccttgtttataagggggtgattatgatctaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggctagagtaaaactattcgaatagccgtgcccgcggttatgggcgggtctaacaatgtctttcgtgattagtttcacacttctcaccataataaaagatgctataactggtaataatttgtttagctcttggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgacccctatattatgccattctttggtatccttgtgcacttgcatatttgctgcgtggcttgctgagtatgtcatatactcaccttgcaatcattcatcagagaaagagttctacagcgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttattattgtgtgcctcggctgattcctggacgagggttcacacacatgtaagcgtttggaattttggatagaaattccgggcgtgacaagttagtatcagagccccttgaccctaggttatgccaaatggttacccatagaagccctctaaaaatattggaaaagtagaactgttctcctccctttctcttttaattaaaccaaactaatggcacatgcacttcataatctcttttagtggttctcattcaaaatttattccagtgttattagtactgtacatctattactgtactaatggctcatttaccagcaaatgttttacaacattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttataactttattcaaattaatccaaaaacttgtgctattaattggataaatatcttaactccctcctttcacttgtctttaga

SEQ ID NO: 52169 - DNA, 1501 bp, Oryza sativa
ctgctgtgtcggaatgggatatctgttgtacggaggattagtgtaaacgcagttcacatcctaacaataaccttcctaaaattatgaagagcaaaagcaaaagcagcatgtatgatccgtggtggaacactggcatctcggtaaaacgtatctctttgagtattttccaccgctttttaatgatgctgaaagttctctccacaatacctcgcaaagaggagtgacaatggttgaagtgctcttctcatccttcgagtggcgccgctcctcttcgtcccagtcgatccctgtgttaccgtacatgtggtacggtgcaagaaatcccatcctgctaggaaaaccaaagtccacaaatagataccttcctgttgaacatattagggaaaattaattaaatcgcactgcaaggttttaaaatgtagaggagtgtgcatcccgaagtttgtaagtgaacaagttaagtgaactaaccatacggaatctgtgggaaatcatggggatagtgctgcacagcctcattcagaatcctttgatcgtaaactgatcctagccatccgaaatcacagaaaataattctaccatcatgatcacagatgacgagaacatttttcgtcgtgacgtggtgtctgtttatgtgttgcatcgtcgtggccgcagaagtcacaacagatacgtgggttccgtcaactgcacccacagactggtaaaatggtttgtaccattcctccgtttcaaacattcattgaaatgtactgaagttgggatctattgatttcaaaatattccctgccaggttgttcaaagcttccaatacttcagcgaaggaaatagacacgattgagttcgaccggacccaacgattgttagcgtctcttgttggacggccgccagccataatgaacaagaaaatcctcagtttttctagtgaacaattcccgcctatatcgacaagtccataagaagttaccaggaggctgtgcaactgtgtatctcgtcagcggtcagccggaacattgcccgaacatttcccaaatattgtccagcatccaactaataccagtctgaattggaatttggttaggtgctctcgcatttctctctaactcactgtccaacaggccgatgatggcatcgtcctcctcgctgctgctatggtctgcaggctgcagcccagccatagggaccggcaccgctactcatcgccgcaatcctttaaagaatatagcacccgaaaatggataaacgtagattggtcatgtaagtatgaaatagagtaatagatgtgaacatgatggaatataatgcgccaggaccatataaaaccaagtcgcaccaatttattttaagcagaaaataaagcataacacatgtatttaaccaaatgaatgttcacgccgaaagtgatgcatacactctaggggtgaaatcgggtcgggttaggtcagatctcatccgctggtggagaagttctttttagtcccggttcgtaaccctttgtagt

SEQ ID NO: 52170 - DNA, 1345 bp, Oryza sativa
gccaccgcgccacgccgatgccgcgcgcgctgccatgccgccgccatgccgccgccgcgccgccccgccgctgctctgctaccgccacaccgccgctccgctgccgccacgtgatcgaacgaattaacgtgaatgtgaatgtgaacgtgaacgagcgaacgaacgtgaacgagaatgtgaacgagcgaacgaacgtgaacgagaattgaacgttaaagaacgaacgaacgtgaacgaacgagcgtgaacgaacattaacgaacgtgaacatgaacgaacgtgaatgtgaaatgtaatatatgcaggtgaatgaacgtgaacgaacgaacgtaggtgaatgaaacgtgaccttaacgagaacgcgaacgtgaacgatcgtgaatgaaacgtgaacgtcaaatgtaatatatgttacttcgcgtttatcctaatacatatttttgtatgttgcagaaaagacgttgttgtcgtcgtccctcaagccgaagtggtagctagccctcgaaggaattcgcgcaggcaagtgacgtaattatatatatgattattatatttgtaatgcaattaagactattagatttaatatacgacacttagacttggttttaatataagattattatagttttaatataagattattagatttgtaactaggcttagcatataagattgtgtagggttctaatatacgacagttagactacgcatatatgactatttgagttttagtataagattatttgagttttaatataagattattagatttgtaattagacttagtatataattattgactagctagggtcctataatatacgtcacctagacttagcatatatcactatttgagttttagtataagattattagatttgtaattagacttagcatataattaagattgtgtagggttctaatatacgacagttacacatagcatatatgactatttgagttttagtataagattatttgagttttaatataagattattatatttgtaattagacttagtatataattattgactagctagggtcctataatatacgtcacctagactaagcatatatcactatttgagttttagtataagattatttaagttttcgtataagattattattgttttaatatacgattattagatttgtaattagacttagcatatacgacagttagacttagcatatacgacagttagactaagcatatatgacttcgcatatacgacagttagacgtagtatatatgacttagcatatatgattgttagtatataagattgttaaaacataaatgtctcatgacttagcagctgtttcctgtatgaacaga

SEQ ID NO: 52171 - DNA, 1501 bp, Oryza sativa
aatatgattgaattatgccaatatgcttatgaatgaatgtctgcttccagaaatcatcatatgaaaatgcagtactaaaatttgaaatcactctaatatgatcgttccttatatatacttgcattcagtaagttaaataatactagagtcaataacacactatcatgatcaggtccttatgaagcttcactttaacactatatttatttatatggatgaaaacttatataaccatgtcaattctagattatcgattactgaactttatcaagaaacaaacatatggtgattgatttctctgaatggtctaatgactgctttactctaaactgctctgtttttttaagatgatatgctatagagacctactagttctgctcatagatctgcattaaacgcaagatgtatcaatacactcactattcatattaatcgtataaatactacatactgctagcatcacactatatgagaatattaatctttgatattgttacagacttgcacctatattactcacgagatgcaattaacgattggataaactttatattactcatgacctgtacaaactagtatttgtcgtgctatgctctgaacaagttcgttccttacatgctctaccgttaagatatacattccaattatctttaggtgctcagcataatttcctacagagtgtttctgctgaatgtccctctatggtcacttgattaaatataaactactactgtcaccatataccaatttatttattcataatcaatctaataggttctttactaatcttatctccactaaccaaatacatgtatagtattcaactcatatgcatttatttatatgatttttctgaccaatttaaaatgtgtcttgatgttaactaaatgattgataatctacctgcatactctgttcactgtatgaaaaagtgaaatctttgcattgtagcaacagcagactcaacatgatcctcctatgcaaaatcaacctcgacatgttgttcataaggttgttcatcttccacaggcaatgctgaggcgtttaaatccattgagaaggtcattcaacattcactacttcatatatcctcaataaagttttctgatttgcacctaagaacaagtatatacttagatgatcgtgcatatacaaacaaatattatcaatactaagaagaggggaatttttcccgttattccctgtgattcgaaaaagaaaaacgtttctatctttgaaactctaagatggagtttgacgagacaacttggatttcactaaccatatagtctagcaattagcgcaagggcgcaacactgacagaacaatctagagcaactatctgacgaaattctcaaccatccagatctaactgaaaaagtcatcaacaacaaagttgtataatacatctaaatctacaatttttattttggtcatttgttcatccgataaagtgattgtaacattgttcacaagttttacatatctcccacatggtttc

SEQ ID NO: 52172 - DNA, 1501 bp, Oryza sativa
acggatggacggatgagatgagatgtgatgattttacctgtagaattgttaggggtgaactcctttttatactagatatagataattatataatgtgatactccatagactgtctcgctagctatataataacatgacgtctagctcttgctgcagtccaatcctggctaaggagccctcagccaaataactactccctccgttctaaaaaaaaagtcaaaccctaggtttccgtgtctaactttaactgtccgtcttatatgaaatttttttataattcgtattttcattattgttagatgataaaacatgattaatattttatgcgtgacttgtctttttattttttttcataattttttcaaataagatggatgatcaaacattggacacgaaaactagggtttgtcttttttaggacggagggagcagtggatttgtggtgtgaagtgtcgaattagccaaatgggagtgtccatcccaatcatgatccccaagcgctgaatgtgcatatcttcctcaattcccaacgctggtctcttctccaatgcatgcccatcttagatttttttttcagattttctttttttaaaaatcagagggtaggctagggcccaatgaagcctacccccttgcacgagcagctagcatccatcatccgtcctatcactggtggagaaaccatcttttgtcggtcggccgaattccacaatagtcccggatgcaataaaaaccggggctaaagatgatctttagtcccggttaaaaagggtaacgggcatatttgatctttagtcccggttcaaatgctgtcagggcctgtcaggcaaagttaactttagtcccggttggtgttaccagccgggactaaagatcccggggatctttagccccggttggtgttaccaactaggactaaagtctcacccctatatatatatgtcttcttcctcccctagctggccaagcaagcttcaaaatttcttcaaaaaagagaggggaggtcatgccaaaatttctagtgaatttattttggtgattacttacaaatcagaggtgcctaaaaggtttgcaacttcatcctccaaagtttttttttgtcatattacatttggagctatgttttgcatacttttttgtctccaaaatttagttgtaagttgatgagagagaaaatttgtgtggggaagaaagaatatatagaaatttagttgatttgctaaagaaggttttataaaatagttgagaaggaaaatatagtgaaagttaatcttaaataatagaaaacaaagtaaaattaaaattaaaagaagtaaaacacattaatagaaatagtaaataagaattatttggtgtaatattttatgatttttgtatgaataaagatatgtcattattgtatgactgttgaaagagtttgtaattatcttataattattgtatgactgtcattattgtaagaataattatttgtgtacgattttttttcatgtcatgtaga

SEQ ID NO: 52173 - DNA, 250 bp, Oryza sativa
atataggatacaatcattcggacatgcgtgaatcttctaaacttccagtcctagagggtagactatcttcttagcctcgtacgttgtctcaggcaatttgtttccctccggaagaatgttcttgacgagtttcaataaatcgccaaatgccttgtcactaaccccattttttgccttccattgcaagaactccagagtggtatccaactttttgtgcccctgctcgcaacctgggtacaacgacgttcta

SEQ ID NO: 52174 - DNA, 1501 bp, Oryza sativa
agaactgttctcctccctttctcttttaattaaaccaaactaatggcacatgcacttcataatctcttttagtggttctcattcaaaatttattccagtgttattagtactgtacatctattactgtactaatggctcatttaccagcaaatgttttacaacattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttataactttattcaaattaatccaaaaacttgtgctattaattggataaatatcttaactccctcctttcacttgtctttagatgccgcgctacaagcctgagtacttgtttggtgttgagggatttgtccaggagttgcgtacgatgtcctttgccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggccgacactgagtatcgctaccatcctcgccaaccccagggaagtgaccgtggcggctaccttgagactgaggagattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttggaaaaggaactagccgcgttgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaatgtaagtgatgatgaaggagaaaaattgaagcgcacccattcaaaggtcgagtggggagctactcaagatgatggagacgagccgaacgagccttcaatcaactccgatgcccggaagacctagagtgccttgtcaagccgttgtcttagattgttgtgttagtttgtttgtttaagtttggttgtgtgtgtctcgcatgtgatttacatcagtggtgggatgtaagtgcatgcgtttgtttgcttttgagtgttaggaagttggtgagtttggtggtgtgagagtctttagttttgtagtaatgaaactcagttaagatcaataaaagttaagttagtagaaaaattaattctctgtcctaagtagttttccccggtttctcttcttgtgatcctacccatgccaga

SEQ ID NO: 52175 - DNA, 1501 bp, Oryza sativa
tccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccattacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccat

SEQ ID NO: 52176 - DNA, 1501 bp, Oryza sativa; identical to SEQ ID NO: 21679

SEQ ID NO: 52177 - DNA, 1501 bp, Oryza sativa
atgtacgacaactcactcgaaagctctcagaagcaaccaaagatcattttttgatgagataattaagaaaatcgacaggagctgcaacttcaaggaggcattgatgtgcattgggctcgcagtgagagagaaaaacgatgagcccttccaatggatgtgttggctccggcatctgccgcaacacggaggcacaaatgaccaagtcgatttctgcaacattttgggagcccttgaagagcttcttgaggcagtcagctgcaaccttgagcaatccttaactgaatttacagacttcaagttgaaattttgtaggtgcgtagcgtacgaagacgcgtgtgagagctttgaaatgttgcttcagatgtatagaacgactaggaatcagtacacgaggggaatgctagcattgcacaggaagcatgaaatttaacttctggagtttggagaattccctcctgacagataaagttcagtgatcagctaggtgtatcatttctccctgactagaaaatctgtctggaaacatttgccccacctcaatcatccacaattctgattagattttaactcaactatcatggtcttttgtcttgtggtcttacagttctgattagttacaacttgagttcactattgtcatgatatgactaatgataaaaaatgaatcacttgctcatgctgcaaagctccacagaatctctctgctcaagtctcacactctcacatgaccacctgatctactgctacaaaactgcaagttgataagcaaacaaacacaatttgttgccaccgaccagatggaatccaatctatgacctctggaccccaaatcaacccgttggcgctgcacctgcaaagagatgacgtttctaaaccgctaatctcctcccccaattattgcaccatctgagggtcagtcataacctcagtgacagtcttgtattttctgaatttctggctgcatcccccccccccccccccaagattataaataacaaacaaatactaaatgtacaatttgcaggtcaatgaacgctgcacataaacaacaataaatgggtcgctgctgcgatcggaggtagacgtgacaaggagagccgcatcttccatatccaggagaagagaaaagatttgataaatcgaagaagaaaaaattttggggaaaattttatcctggggacgcttggattgtgtgctggttgcctccgatggtcgcaagggccagaaatctcgtccacccaaaccgcggggagccctatcccctcagcaaaagccaagatgctgctgttcccgcccgccactaaaaatatttatgcacctcctcgcattaaaaattccatcgacgtcgcctcctctcctcctcctcctcgtcgctgcattccggtgagtccgtgcaatgcctgcattttgtgttttggtgggtttgtttgtttttgtgatgacaatgttgtttgtttgatgcaggttgagtgagttggtgattatctgtagggggtgaaaa

SEQ ID NO: 52178 - DNA, 1501 bp, Oryza sativa; identical to SEQ ID NO: 21676

SEQ ID NO: 52179 - DNA, 1501 bp, Oryza sativa
aaagaattgccacacaagtttctcttgcatgctttgtcacttcatagagcatgacgaagaaaagaaagtaacggcagaatattgttggactccttaccaatttggatcagctttaggctctgtttttttctagatggaatattgtttgaaaccggcaaagttgtaatgagaggactcagcagctaactaattgacacgtcaacagtaacaagcctatcgtatccataatctagtcaaaaaaattgtcatttctccaggacaagttgaacatgaggccaacgagatagctccagataggaatcagaaatggcaccaacgcaactcgtggtcgatcaatcctcctaaactatgatcaaaagaaatgataggtcgtgatcagtatcctctttttcatgtcatgagaagcacattggtgacataggataatctatagttctaccacgcacatttttgtagtattaccgatgcaaacggtactggactacaggttcaattttaatttaacctggaattcagcttttgctgccgtccattgaaggaaaaaaaagtaactatcttgtatccactgtaatctggaaataatcgagaggaaaaaaatcaaatagataacatccaggatgctatgcgtgcatgacgacgggaaaaaaaaaagaaacaagaatcaagcaataccagaaagcgcatcaaaggcataatgcatgacagaatagtcacaggttggctaggactaggagtattcgattccaggagagctccagcatagcacggttgcataaaggcgattcaatggtggtgtttgcatcctatgaagataaaaattaagtgtttcacgtaaaacgagatagtaatagcatgtgattaattgagttttagttattacaaacttgaaaaatagattaatatgatattttagaacaactttcatatagaaaattttctcacgaaacgcatcgtttaacatcgtttaacagtttgaaaagcatgccatgagtatccaaaatttaatccactccttacataagaaaggaacaggaccattaatgttaactcataaaatggagtcctattgaaaaaaaaagagagagaggaggcattcgcaatcacatatttatcctgttgagaacacccccacagaattagttgaaatcatatccagtttaaagcctcaaaggatttgattagcatttgccaacatcctggtaagtcagtttcaggctttcagccatggctaatccggctacttggcctaaagcatgcattgcactgttaatactacctacatccctcgatgtttgaaagttcgttagtgaaaaaataaagaatggagggagtagcactttgttaagtaaaaaaacaatcaacaaatatggcatgcaaaccatttacagctaggatatactgtggttcagatttcttaagagttacctatatcaaatcaactgaataggattacacatgaattacaagttagcatattgccaattctgaacggtggaattat

SEQ ID NO: 52180 - DNA, 159 bp, Oryza sativa
gccaccgcccccgtgggaccaaaccaccctcctctctcccgccgccgccgcctccccggagatgcggcgagaggagggcaggtggagcaaatgcggtggcgatttggggtttggtgcgcgcgggcgaggtggtggtggaggcggaggcggaggggggaa

SEQ ID NO: 52181 - DNA, 1501 bp, Oryza sativa; identical to SEQ ID NO: 21678

SEQ ID NO: 52182 - DNA, 154 bp, Oryza sativa
tcctgcagccctaatgtgcagcctctagacatattgcaaggaatttggcatcaatgtttttctgttactgtattttctatgtatctgtcaatgcttgactgaatattttattgccatttaaccacccatgatgtgttaatgccacaagcagcta

SEQ ID NO: 52183 - DNA, 1415 bp, Oryza sativa
gatatttaatctgagcacaaccttgaagtaacagaaagccagaaaatcctcagagaatgtgtaagaaatgtggcaaaactatataaaatttcagaaaagaatactattatgccgagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaaattttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggccccttatgccacctataagacagcaatactgaacagctgttcaaaagtcaaaaaaattccaacgatttccaccaaagttttctacattattatttttttacttctgcgctgattaattcatgatatcactttgcatatgtttcaaaatttctttaatacttgaagattgataattgtattcctgttaattccattctaaacaaatagctgttgaattcttgtcatttgtattgtgccttcacacatttactataaactgttcaagatgtccacatatgatcgattaataactcgatctttatcatgatgaattctagagggatgaagaaattagtatggcaccagaggaaccagtactggtagacaacaacaaccaagaggaaaacagtttgcaacaattgaatctactggctgatacatcagagtggttcaagaacatgg

SEQ ID NO: 52184 - DNA, 707 bp, Oryza sativa
atttaggaaattttatttcccacatttaacttcacttgtaaattaaagaacatttaatataaattctattaataatttattaaataatttataaatcctaaaacaaaaatcaggatgtgacaaatctaccccccttacaaagaatctcgtcccgagattcggaacggctagaaagaaaagggaataggtaaactgcagtctatcttattccataactccgataattattctaaggctttaaagaaaactactgccgctttgaaactggtggctgagttgtaacacttgaagacacaactggcaccgcattggctcctgtgacgacaatgttgtagacctgaccttgcggctgctgatgcttcggcttcggacactctcttgcaaagtggcctgccttgtaacaattgaaacatacctgctgctcccttccactactgttattctcctgagactggtcctgctgaactggcaccggctgattagcttgctcgatgttaacttcattgctttcattagtctctgatttgatctcaccaccgatgttcaactgttgcgactgtccttgaccagcggaaaaaggttcactaatttggagtggcttgatacgctgtctctggctactaccttgtgcctcctagaatacagtcattttccttttacggttatccatcctgttcttcttgtcttcaagtcgaattactttgtca

SEQ ID NO: 52185 - DNA, 1501 bp, Oryza sativa; identical to SEQ ID NO: 19213

SEQ ID NO: 52186 - DNA, 1501 bp, Oryza sativa
atctaactccaaaccaggagctaagcaaattattaccaggtataacatccataattattgtgagaggtgtgagactaatcacgaaaaacattgctcaacccgcccataactgcgggcacggctattcgaatagttttactctggccagaggtgtaccactgtacccacaagacacagcctcaacatcatgtctaccatgcgtcgcgatactggaaggtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctagcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatcattaaataatagtgagtcataagttatcccaatagtgtgctaatgtttctaagcatggctaagcaatcataactaatatctagctgaaccaatatatataaagcccaactagtcaagttataataacccaaggtatcaaggaataaagtagtcaatgcaaacaggccataacaaaggaatagattcacaccacccagtgacattcgaaaataaatgcatagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaacgaagaaaaagactaataaaaactaaataaacaatacataaaaagtaaacaaacatgtagatcataattttagatgaattatgagacttgaagggcctcattctgacttcaaatgaatttattatgaattttactagattaaatataattaaagcccatttaaaaagaattaaataaatttaattcaatttatggataattttaatatgtagatctttattttacacaacttttgcaacttgaaccacattaaactgagttacaatgaattagttatgaatttttaaagattaaatcgggttaaaacacttatatggattttaattgaattatgacgcaatattgaattatttttgaaaaggaaaagggaattattgcgtcagcggctagggtttgcggtggaccgggtgcacggcaacggttcacgggaacagacggccgaggtcgatcctatccaaaacggacggccgagatcaaacggtccacgaccgagccacggggaacggcgacgatgacgtcagcga

SEQ ID NO: 52187 - DNA, 1501 bp, Oryza sativa
cgtttggaactatatattacttgtcgttttgtgtaccctaactggtcctagatagggatttaatacacaaaatagtttgaaaatttgggttaaatttctgggcgtgacatttgttgacgactattaaataccaaatttacgtcgtcaatacctgcataaatatgaaaatatagaacatccaacatagtggtagggtttatttctaacaaattccacgagtgttggtatatatttggatgcatgtgataaattacaaaagttgagatgaaatgtacataaaggagggaaagaattacattcgtatcgaagcccatagactcttgggcccataaacccaacgaaatacctgcaactaggccaaactaccatgccaatgaaataaggacccacatgccatggcctaagaggaaggagtgggccagggggagccagccaggggtcagtcgaccacgcgccgatctccaatggccgcgtgccgtgcggctccgaaacagccacgcagctgctcgtaagtcgtagccatccctcctttgttttccctcctcgtccagtccttatctccttcaaagtgattgagccgaagttcgctattcctctgtagacatcaagagctaatctcgttttcatcccaaaacttctcctgccagatccaagtccggctgtgcagccgtttcgccggcgtcaatcttctgccactgcaccacggcaccgcaggaacacctctcatcggtgagaacatccccaacctttctccccttctttccttgcttgggtcgagctcccatcgtgctcctgtccaccaccatggctaccaccgtggtcagtttttccggcgcctcatctatatcaactaaccacaaaaatggaaccttctcatcccggaacgcattttgacacgctcactcgccccgttcgccaccggagctgccacttccatgcccggtgtggcggtgtcaccatagctccagatctggaactcgcgttccggctagcttcgttgtcttccagcccagcgtccacgtcctgtgggggtgtcagcctgtggaacacgtcatgctatcgtatccgtcgccgttccctcactggagctctagagcttttctctcacctctgttactcacgtgaaaagccaccggaagaagatgaatggcagcactgtttcctattggtaccatcaaaaccacctaaatagtgcctaaccacagtaaaaccagtccaaacaattctattatgatgtttttctcatgttcgagctctaaaacaccaaatcaatttcagttttcacccttgtcatctatagcattaattgcaaattgcaatcgctactacatataccatgaatcataaccctagaataaatcttttgtcatccaaatcaagttaactcttgatttatcattttcttttgttcgggctccgattcacaatatttattttatcgtttatttataatatttttattataggcttatttggtcgtttcttcgtgtgcgcatgttag

SEQ ID NO: 52188 - DNA, 1501 bp, Oryza sativa; identical to SEQ ID NO: 21668

SEQ ID NO: 52189 - DNA, 1501 bp, Oryza sativa
gagctcgagcacagggaagagcacggcagccgcctccgctcgccacggccgccggcctccgcgcgacgctcgccgcctccgctcgccgcggccgccggcccccgcgcgactgctcgccgcatccgctcgtcgcggtcgtcggcccgccgcctccggtcgccgtggccgcgggccctcgcgcggcgcggcccgccgcctccgctcgccacggccgccggcctccgcgcgacgctcgccgcctccgctcgccgcggccgccggcccccgcgcgactgctcgccgcatccactcgtcgcggtcgccggcccgccgcctccgctcgccgcggccgccggcccccgcgcggcgcggcccgccgcctcccctcgccgcagccgtcggcccccaccgcgcccaccaccgctgtcccctcgccgcttcgccgccgccgcctgtatcctgccaacgtgagaaaagaggaagaggggaaggaaggggagaaagaagggagaggctgacatatgggtcccggtgtcatagagtcaaagtagagaggatagatggagagattgttgaagtgaatagctagtttgactagccagccaaattagatggagagttggctatatgggtatttagagagttctatttgtagaggttgttggagatgatctaatgtagcccttgtctggactctggagataaaaaaaaaaaagtggatgaataattaattagatgcatcgtgatgtgaaccaagatgtcactatgtcaggaccaagttacctcgttgagatatgaactgcaccttttgagtgcagaagagcccacttcctgcagtgacaaggagactgatctcctggtgtcatctcgacttaaagcatgcattgagctgcatatgtctttgtacttactactaaaaaactacgctgtctacccacaaacagatcagtttgctctggactgtggatcagtattagccaacattagtgtagtcacagcggattttgactctaacttcagttttgcaggcctcattctgattccatcagacagacggttttgtctactttcagttttgcaagcctcattctgactccatcagacagatggtcttgttttgaggactgatcaccacccgaagcaaaacctccattcgcctctgcaccagcaaatcgggatgccatcagcgagttgtgaatttggatacaattctgatcgacatatcgtgagagtaaaacaattctgatatcacgtgacagcgtgagagcaaaacagcaatacagtactgcgtaacatgcgtgagcaactgcataggcccttcgtaggcttcaatttaggtgaccagacataaaaaaaaaggaaaaataaaaataagtttaatttcattttgataattgttggggttctccttatatagaaaatcccctcaaaaaattagagtatgctgctatttgcagcgagcacacggtattctttagtaaaaggcgaaagaatagttcgctctgtgcccactgcgcagctg

SEQ ID NO: 52190 - DNA, 329 bp, Oryza sativa
gtacgcaagaccacagttaaacgagacattggaccgggatgatacaataaatcaagtttagagacctcaatgtgcactttgtaaatttgtggacttaagtgaaacctcatgacaaattagtaccgctggtcaattttactctattaaaaaacagaatactatacaaatcgacattgttattttatttagagtattaaccttgatgctaacctaacaagggtgggcgaactagcataacaaccgtatcatgtgctttaatccgcatcaaatcatcctcgagctagagagattagccaagaagataaaacccgtctaaaaaccccccgaat

SEQ ID NO: 52191 - DNA, 1501 bp, Oryza sativa
tgtcgtcgctagcttgctagctaggccggctattagaccgtgaatcaaggtttaatatgatctattcattatgaaaatttgttattatagtcgtatcaaagattaatttaattacactcttttgacgagcacaacttatatgtgattagaagctacattttcttttctcccatgtgcaaaagattatcagacttctacaggaaattagggttgggatgggatgaaaccatccttgattttagggttgggatgattccactcgtgtgtttggtttgtagaatagtacgatcccagtttttttcttatttggttgaagggacgagagagggatgggatggacaccgtttgtaaccaccgatgacggccggccgggcgaaggagcgcgactatagcctggcaacaagaaggcggaggagaggcgtgagcaggcaaagcaaccatggccgccgtcgccgcctctgccctgacctccctctccaccaccgcagccgccgccagtggcaagcgcctcctcctctcctcccttggctccctctccctctccttcgcctcctgtggccgcgtcgccgttaggccccgtaggcgggcgtaggagcgcgacgacggacgggcgggcggatccgctgccaccgagtcccccgcctccagatctgccgccgcacccgtccccatcgccgaatccgccgccgccatccccaccacgggatccaccatcgccgaggcccccgctgccaccattgccgagcccgccgccatcgcccgagccgtttgcttcgctcgagcccgccgtctcctaagggcgagtcacgccgttcgctcatcccaggtgggacgagttcatccgccacatttggctggatcggttggtcccggatctgagagaaatattcttctccaggggactaacccatcccactcacctctaaactaaacacctctaaaagtgggttcgttccaacccatcccacccttgcaaccaaacactaaggagctaagcatgcatcatgcatcaatgagacaaacagtatagcttagccacctaacaaaatcagtatctcctgccttttcactggacaaaatgacaatcggccgttacttttggggtcacatggactctgattaataattaatcgaaaattgtgcaagggcataaagtaatgcgtgttagtcacttgtcgcattcgaatatcgttaaaaggtcgcattactgatagcaccatttttatatgcaatatgcttatcatcatcccatacttgatcagactaagcaaactaactgttaaacttcctgtataaatatgcatggagaccaccatgcttcacactccactccacactggcacactgcccatatccatctattctgaatagagcctctgcattgagttaagaactaatccgtttgactaattctgtttttgcacacaagtcgccataatcaccatgacaatggccatggcgtcaatgaagggagagaacgtcactgtatctgcagcagcag

SEQ ID NO: 52192 - DNA, 1501 bp, Oryza sativa
gttgttgttgatgacgtcggcggggaaggcgatgatcgggttgcagctgggcttctcccactcgcggaggagcgggtcgagcgggttcttggcgaaggacacgttctgcacctgcacgccgccggcgtccctgccggtgtagaggaaggcggggcggccgccgaggaggacggtggcggagcccgaccagcatccgttgacatcgaacgggtcggtggggtcgatcgccgtgccgaggaaggcccagttcacgaggtcgccggagacggagtggccccaggagagcttgccggtgtcccagagcgggccgtgcgggttgtactggtagaagaaatggtacaaaccgttgtggtacagaggccctgccatttcaatggaaaattactgccattactgggcaattatgctgatcatgaccaagacaacctgatgattggcaatgatcatccaaactttattgtgtatggtaaaatatgcttaattatgtggactaatacctttcgattacaggtttttaagctcacaagagtgaagagttcgtgcatggactcattctgaatgactgaatataatggaagaaaagaaaatgatggaggaggaagaaggggcatcgtaccatttggatctgttcagtttcgccagcggcagtgtccatccaaattcagagatccaaacacgatttgacaaacaagttatgaacttcgccatgattcaagcagacaatgatagaacaataagggcaaggtgtacattaccattctgccagaacttggcaggctggaagtggtaggcagttctgccatcgtgcagctgcagctttccgttcacagggcacattggagaagatgaacaggacgagactttgaagtttgaattgctatggacgaatgacgtttatatataggaaccaaaagttgcataaaacaatttttttattgaccaagttgcacgagactgcaaaattattgccgtccaggtcagtttaatacttttgtagaagactttgctttgtcaatatgatagcactccgtcttttctatttcgtgcttacaccttatcgattagatggcagctaatcagatgatattctgagcaactcgggagtagtttgcttcggaggaactcaacatctcgtatacttcgacgaaatttcaactgcagtaatcaacaaagaaatagttatctatgacgcagtgactcagctcttgtacacagtctaatggcctctatctgtaggcacaagatgtctattggaagtgtatacactatacagtcattgatttttttcttcttttgttctgaaaactgcgtatgcctaaatttgatcgtgtactacatttttgcatgatatttagctcattgtacaaggttttgttctgaagctaaatatcatgccaaccaaccatgatatcatgccaagaattgtttaactttggccgattccactcttccaaatgacttctttaggactttaggagtaacaaatgaacccaagttttcc

SEQ ID NO: 52193 - DNA, 1501 bp, Oryza sativa
gaactaccttttctgtttcaaattactcatcgttctaagtttgtcttgagtcaaatattttaatctttgaccatccaaggcagtatagatggtagttttgtccccaaagcagtatagttggtagttttgtttgacgtgacagtttgacacagatcaacagtgttgagttagtgtgggtcccacatatcaaggcctcgtcacctatctcccttcctcccccttgttcccatctcaacggccaccacagtcccgttgttggaggagccggaggaggctgactgcggcgccaatggtggttgggacatctggcggtggggggttcatgataggcggaggtgatcatatcgtggttggagcatgaaagagatagcatctgtgaagtattcttgttggatcttcttggcttccttctcagtctagtccatcagtgagatttcgcactcggccttggagagcctctccagcaaccagctctccatatgagaatgcttcttcggcatgggagctcgacgaggctggttagtgtagagctcgagaaggtgctcgccacgccatccctaagccaccgccgttacttcgatggggaagatgcagaaaagggggagagtggttgtcacgcccagaaatttaacccaaatttccagactattttgcgtattaaatccctgtccaggaccagccagggtacacaaaatgacaagtaatatacagttccaaacgtaaataaagcgtaaaatacttacagaacaggcacttagtcctcacaccgaaacagaacgacagcagcggaaaaaggcgatcctagtgaggcttcagctccactccacaggcaaaactcaactggggtctgagccttggtcctctaactccatcttcagctcagaagcactacacttttgaaaagggggaataatagcaagactgagtacaaccaccgtactcagcaagccacaccaacaatgcagatgtgcaaggggatacaaggatggtttgtggctatttgcataaaggcagttgtaaaacattttattgagcaaaacagtaaaactgttgagtaattaaagtaacattaaatctccacttatcaacgctacaccacgttgaacaggtccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacatccccacgacacgtttccgtgcgccgacatgccaccacgacataccggaaagaggccgtgacaggacccttcgcataaccccctctagccaagcacaccacaccttaggttacacccccgtccccagcgggcaacgggcagtcccctctcgtgcctaggtgaatccggaagcgacagaggccgtcgcagggcccgccccgctccatcacgcccacccttgcctggatgcattgactaga

SEQ ID NO: 52194 - DNA, 1501 bp, Oryza sativa
cgaggatgataaggtttggtttttcaaaatcttaagacatcgaaataactatttaataaattttaagtaaaatcatattaaaaatatataattttatatgggtgctagccgtgcaattgcgcgggccacccagctagttattattaataaggtttctaaactcttaaaaaacatttttaaatccccaaacttgttatagtgtcattcccgtccaaaattgtcatgacacctttaggattctacgtatcactgacgtagcatgtcacaccattgaaagtcgataagatttgtatatcaatgattgtataagagttgtatatcaatccagttaaccattgaaagcgtagccccatgcgaaactacacataaaaatccactagttatattattattgagagatgtcctcatcttcactcttgtgcggactaaaaaccaccacattaatttaagatacataaaagaaaattgcaccattagatcgtagtgggtccaaactatatcagtacttccggaatcaatcatatgcaatataaaactgtatctgtaaaaacaaaagctagaagttcttatcaaatctacttggagacgtagcgaaaattcactattagcacaataatttagacatttactgtctcatatgctcgcccatgcttagaccggccggtcaattttccacgtctcgcttagctgtctttgttaaaggcctatggataatgatatttgaaagtttacttcaaattcgccgtcactgttttaaaatcaccacctattccatggagactatatatggcccttctgaagaaacttaagatcatgagaaatatttggctgttagtcagcttctgagaatctggtgaatctgaatttttagtttattttatagattctctaactataacttcttataatctaaataaaaaaaactacactatttgagggagtttttgattctaagatatgatggagttgtcagaagctccctcaaataggctcttagcaattgtataactagtggatttttcatatctaattaggactgtatctaattttgaacactataatcttttagatacagagtgagtacaactagatttatgaaaattagaagctaacagttgtatatcatatctaattttaccttttagctctgtgattttgcacggaaaaatgctaattccaataacttcactaatattttgttgtatatataagtagtgtagtgacccatgcagattacacgactaacgtcattacacaattttctcatatgcataatagaaaatatacttccacaatttattgtcaaaaaaacaatattgaaagtataatcttgagctctggctcaacttggtcaaaagtatacgcatgatattccgactaacatcttactccctttgtcccaaaatataaaagattttaaagggatgtgatattttctaatactatgaaatgtcacatttctccaaaatcccttatattagggacggattgaataactttt

SEQ ID NO: 52195 - DNA, 1501 bp, Oryza sativa
gccacgtcccgccccggcgctaatatagtaggggaggcgcgtcgcctgctcgaagccagcacatgcgacatgctcgccgagatcaaacgaactgagaaaatcgtttcgtcctcggatgggagtgttgcacagctggagaacatgcccacggaggctcaggaggacttgtagaaattcaaggacctcgttgccagccacgtggggcagcgccaggggatggagaagctgatgatggagatgcagggccacctggattcgattagccatggctcgacgtggtggcacgcaacctgagaatccaataagcgggccccacgttccccgatgagaccaccgtggagtccttgcttggctttttaatcgggaaactcgaaggagttcccgccaagctcgccgagcgagttgccgatgaaacatgctctggtgttcggaccggtgcatgtcacgttctcatgtgcctaaaactcacacaccccgagatgaacctcaaggaggtgctggacaggggtggagacgacccgacgccagaggacatgtctggggatacccgggttgagtatgcactggtcgagaaaccatctttcgtcggtcggccgaatttcacaatagtcccggatgcaataaaaactagggctaaagatgatctttagtcccggttaaaaagggtaacgggtatatttgatctttagtcccggttcgtaacaccaaccgggactaaagatcatctttagtcccggttcaaatgctgccagggcctatcaggcccccccgggatctttagtcccggttggtaacaccaaccgggattaaagatcataactttagtcccggttggtaataccaaccgggactaaagatctcgaggatctttagcaccggttggtaacaccaaccgggactaaaatcccacccctatatataggtcttcttcctcctccagctgcccgagcaagcttctaaatttcttcaaaaaagaggggaggtcatgccaaaatttctagtaaatttattttggggattacatacaaatcggaggtgcctaaaaggtttccaacttcatcctccaatgttttttttgtcatattacatttgcagctatgttttgcacacttttttgtctccaaaatttatttgtaagttgatgagagagaaaatttgtgtgagaaagaaagaatatatagaaatttagttgatttgctaaagtacgtttcataaaatagttgagaaggaaaatatagtgaaagttaatcttaaataatagaaaacatactaaaatgaaaattaaaagaagtaaaacacgttaaaattagtttaaaactttagaaatagtaaataagaattatttggtgtaatattttatgatttttgtatgaataaagatatgtcattattgtatgactgttgaaagagtttgtaattatgttataattattgtatgactgtcattattgtaagaataattatttgtgtacgattttttttcgactcatgtagatggatc

SEQ ID NO: 52196 - DNA, 1501 bp, Oryza sativa
aacatctgaccaagatcatccgcaacgtcgttaccatcagcatccctttcctcctcgcctgtttgatttccttcaaatccaatgtactgagcaaagtccagaatattgtcgtcttccacttcatcttcttccatttcaacaccttgctctccgtgggatgtccaacaattatagcttggcatgaactccgactcaaacaagtggaaatgaatagtcctggatgcagaatactccttctaattcttacacttattgcatcgacaacaaataaaacccctttgcctgttagcttcggccactctcaaaaaatagtgcacgccgtcagtaaactctttggaccgccggtcagcgtacatccattgccgatccatctacatgagtcgaaaaaaaatcgtacacaaataattattcttacaataatgacagtcatacaataattataacataattacaaactctttcaacagtcatacaataatgacatatctttattcatacaaaaatcataaaatattacaccaaataattcttatttactatttctaaagttttaaactaattttaacgtgttttacttcttttaattttcattttagtatgttttctattatttaagattaactttcactatattttccttctcaactattttatgaaacgtactttagcaaatcaactaaatttctatatattctttctttctcacacaaattttctctctcatcaacttacaaataaattttggagacaaaaaagtgtgcaaaacatagctgcaaatgtaatatgacaaaaaaaacattggaggatgaagttggaaaccttttaggcacctccgatttgtatgtaatccccaaaataaatttactagaaattttggcatgacctcccctcttttttgaagaaatttagaagcttgctcgggcagctggaggaggaagaagacctatatataggggtgggattttagtcccggttggtgttaccaaccggtgctaaagatcctcgagatctttagtcccggttggtattaccaaccgggactaaagttatgatctttaatcccggttggtgttaccaaccgggactaaagatcccgggggggcctgataggccctggcagcatttgaaccgggactaaagatgatctttagtcccggttggtgttacgaaccgggactaaagatcaaatatacccgttaccctttttaaccgggactaaagatcatctttagccctagtttttattgcatccgggactattgtgaaattcggccgaccgacgaaagatggtttctcgaccagtgcatactcaacccgggtatccccagacatgtcctctggcgtcgggtcgtctccacccctgtccagcacctccttgaggttcatctcggggtgtgtgagttttaggcacatgagaacgtgacatgcaccggtccgaacaccagagcatgtttcatcggcaactcgctcggcgagcttggcgggaactccttcgagtttc

SEQ ID NO: 52197 - DNA, 1501 bp, Oryza sativa
caagcactccagattggttgatcaaggcacgttgtacggcataatcaacttggtcttggaaatttgtgcacctaggaggttcctcccgcacttcagtaccatcttcaccaagatcttcaaccacaccatcttgaagcccatcacctttatcgcctgagccatctgcagtacctttaccaccttgggatgaacttgttccaacttcatcggcagcaaccaccttcaccttgtacttttggataacttttccttgtcgggttgctgcaaacgatttcatgaactgctcctgagcgctcttcatcatcagttcatactccttcttttgttctggtgataacttgtctacagtgactgggacgatgtttgtctcattgaccttggactcaaccccaattgaaggtagattagtccctggaggtttcggcagcttggtttgaggaggcactggcggcttgcctgttaatggcggtgattgcttttctgctgacattgttattacttgtcggtcccaccaggcatgccaaaagcgtgttgatgcgaaaaacgcacactgcctggaagatctgcttaacttcagtgcagatccaaaatcttgcttttaggttcgtgagcgtgccagttgatttgatcctgcaatcaacaagaaagaaaaacaagaaaaaccgcggttaaatccataaacgatagccgatcgaccagtcgccgatgacatatcatgtattttcaagccgatgtcatatgtgaatcgatcggcaattataagtacgcaaagtaagactaaatctactcgatcggctgtagatattaacgttatgtaatccttctgttgatgtatatttaaaccaagtgattgggatagatcggtcgccatactgagacagtataaatcacttagatcgaagtatacattaacacaaagattataaacgcttatagcatagccgatcagatagatctagcatgtatcggctagtactccgataccactctatattaagatattagaacaagtagaatatatcaaacaagtagcttaatatactttattgcaataggatcttaatataaagggcagacttagcatatcaatcaagcacaatcaggtaagatcagctaaaaccccgatactatctctcttgataatcataaaacatgccagatatcataattacagatattacttaatagatcgatctcaaccgatgcagcattaagcataaagacaagtataagatctaggcaagatgatgaaaaactctaagagatggtagatacacgatacaatctagattaataacagaacataaccctatcgattgttttctagcaataagaaccagtcgataacaagttatataatgcgactaacaaagattgcgacgtgtatatgataactcgacgaattacataaacaggattagagtgtcataaatatggaagcactaatcccgataacgcaagccgccatgacaagtttacctctagttgaagatcaaatcga

SEQ ID NO: 52198 - DNA, 1501 bp, Oryza sativa
gaagaacagagtttgcatcggctgtgaaggcatcggctggagtctgcatcggctgagatggatcggatagaggacagccgatacagccgatagaggtgatgcagccgattccgatgacgatggtttcaaggatgtttctagaatcgatcaaattgcttcacgaggattgccacgatggagataaagttctcggataggcaaatgtatctattaattaggatatttcatgtaattttcttagagatatgtttgggcaaaagtctgccgtaaaggcttatggtatcttagagtttattagagataagtgtcgtgtccggcaaggacatattttgtaatctcgggtataaatataacccgaacccatgtaatcaatcatcacacgatcaatacactttcggcgcatcgccaccctttttactttcgttctatttcggcgagttcttgctttcgggttgagctgcatcgatttgatcttcaactagaggtaaacttgtcatggcggcttgcgttatcgggattagtgcttccatatttatgacactctaatcctgtttatgtaattcgtcgagttatcatatacacgtcgcaatctttgttagtcgcattatataacttgttatcgactggttcttattgctagaaaacaatcgatagggttatgttctgttattaatctagattgtatcgtgtatctaccatctcttagagtttttcatcatcttgcctagatcttatacttgtctttatgcttaatgctgcatcggttgagatcgatctattaagtaatatctgtaattatgatatctggcatgttttatgattatcaagagagatagtatcggggttttagctgatcttacctgattgtgcttgattgatatgctaagtctgccctttatattaagatcctattgcaataaagtatattaagctacttgtttgatatattctacttgttctaatatcttaatatagagtggtatcggagtactagccgatacatgctagatctatctgatcggctatgctataagcgtttataatctttgtgttaatgtatacttcgatctaagtgatttatactgtctcagtatggcgaccgatctatcccaatcacttggtttaaatatacatcaacagaaggattacataacgttaatatctacagccgatcgagtagatttagtcttactttgcgtacttataattgccgatcgattcacatatgacatcggcttgaaaatacatgatatgtcatcggcgactggtcgatcggctatcgtttatggatttaaccgcggtttttcttgtttttctttcttgttgattgcaggatcaaatcaactggcacgctcacgaacctaaaagcaagattttggatctgcactgaagttaagcagatcttccaggcagtgtgcgtttttcgcatcaacacgcttttggcatgcctggtgggaccgacaagtaataacaatgtcagcagaaaagcaatcaccgccat

SEQ ID NO: 52199 - DNA, 171 bp, Oryza sativa
aagaattatttttgaaacggaaaaaggatttattgcgtcagcggggctcgggttcatggtggaccgagtggacagaagcggtctacggaacgaacggctgagatctaatctaaacaaaacgaacggccgagatctaaccgacctaccatgggtctacggctgacgtggcgc

SEQ ID NO: 52200 - DNA, 752 bp, Oryza sativa
ggcacccttatcctgagtggtttgagagagttccactgccgaaccgatacaaagtgctagatttttcaaagttctcagggcaaaacaacatttcgacgtacgagcatgtcagccgattcttggctcaatgtggagaagcatcggctgtcgatgctttaagagttcggttgtttcctttgtctttgtccagatcagcattcacatggttttcttcattgccctgcaattctgttcaaggttgggtcgacttggagaaacaattccatagttacttctacagcgggacccatcagatgaagctctctaatttcacggcggttaggcagaggcatgatgaaactatgcaagattacatacagaggttcagagatatgaggaacaagtgttacagcttgtctttgacagattcccagttaaccgatctcgcattccagggtttgatagctccgatcaaggagaaattttcatcgcaggagtttgaaagtttgaccatgcatgagcaaaggtttgtggaggctaagaaaagtttcaagaagatcaatcacgtgtatccttatatgtgtgattttattttgtttgagattctgtaatgttttttcttttgtttgatctgtaaatcaaaaagaaactattgaactagaatgcaaaaatattctcaagaagaagccaaaagaaagagaggtgaaacagagtagagagaatcgggtgcttccagtgattagttgtcagaaagcattgttttccatatcaga

SEQ ID NO: 52201 - DNA, 1501 bp, Oryza sativa
ccaaatggttacctatagaagccctctaaaaatattaaaaaagtagaactgttcttctctctttctcttttaattaaaccaagctaatggcacatgcagattatagtctctttaattgttctcattaaaaatttacttattattcctgtgttgttagtactgtacatctattactgtactaatgacccatttaccagcaaaggttttacaacattatttttatttaatcatgttgcaatataataaacttagcatgttgattttataactctcttttattttagctttttttaaacctgttattcaaaagtgcaaaaatttgtgatcctgttttcaacagttccaacttatcttagtttactttatttacctttcacttcgattttctaactttattcaatttaatccaaaaccttgtgctattaattggagaaatgtcttaactccctcctttcacttgtctttagatgccacgcttcaagcctgagtacttgttcggtattgagggatttgtccaggagctgcgtacgatgtcctttaccataggattcgagactgcccctttgtatgcccagattcctcatgatcgtgatgaagagaagtgccgtgtcatggtcaccttgaacagtgatcgtgaagacatcccatcgatgatgttcgaggctagagggggaagctatccttatgcttgtcaggaggcggcaaggatcgccataggagagctccgcgaccgttacaatgatctgttggccgacactgagtatcgttgccatcctcgtcagccccagggaagtgaccgtgccagctatgttgatcctgaaggaattgagaatgatgctaccataagacatttggtcgagatgctgtgggccatggatgagtcccgcgctgaagttgtgtcagctgctcaagctcgtgaagattggaaccgtggtaagatttgcaagctagaggacaaggttgatcgtctagagaaggaactggccgaattgaagggagaagcgccaccacagaaggccagggttcatcttactgcaaggaagagagctctttttgttccctgctaccagttggtgcccaaggttcgtgtggtggcaagagaagctgtcctagtcccagtggatcctccggtcgttaatttaagtgatgaggaggaagaagattcaaagcgcacccattcaaaggttgagtggggtgctactcaagatgatgagaacgagccgaacgagccttcaatcaactccgatgccaggaagaactacatgtcttgttaagtcgttgacttagttcgttgtgttagtttgcttgtttaagtttggctatgtgtgggtcttgcatgaggtttacatcattggtgggatgtaaatgcatgcgtttgtttggtttcgagtgttaggaagtttgagttaagtggtgtgagagtcttcagttttatgtaataatgaaactcagttaagatcaataaaagtcaagttagtagaaattaattctctgtcctaag

SEQ ID NO: 52202 - DNA, 1501 bp, Oryza sativa
ccactgatcatgtaggaacatgaagagcatatatagtcactaatattagcaccacatgacatgatgacagtagaggggaattatcatacacgaacaggacaatatggtgaatatgccaatgccactggtaaggtaatcagggtcatctttggccaaactgtgccaaaagttataatttaggatccaccaaaagtgcttaaggcatgtggccagacaaaaaaccgtcaacaagaacagaaaacaaaacatattgtcttgcacgatcgattggggtcgtaaatcatacagtaccatcactatttactttagacagattaggggaaaataggataatagcaatacctctctctttttgcactccttatagtcgtcgaactgctgctggcacttgctcttgtcttggttggcctccaaacctgaagaaccaacacgaacagaatcagagatcaaccacacacgcgtgaaaatccgagctctccacatagtatgatgactgcgaagggggtcaaggaggcggcgaggagatgggggtagttagatcaagattaggacggatgcatcatacacttgagggaggcggtgtactgggggaagcagtcggagtcggcgatcctggcggcgctggggtacggcggggacgccgccgccggcgacgacgcgcggtgggtggggggcgccgtggctgccttcgccgtcgccatgatgccttcttcctcttcctcttcctctctctgctcagcgttgcggggctttggatttttttttcttttttctttggcctgaatagagtccacatcggcagtaatgggcagaaatatctatagacgttgggccgtgcagcaactcgttttgggccggaatccagcccaacacttgcaagatgattttttatttcagggagttgctaaccgtatatatggggaaaacttgggttcatttgttactcctaaagtcctaaagaagtcatttggaagagtggaatcggccaaagttaaacaattcttggcatgatatcatggttggttggcatgatatttagcttcagaacaaaaccttgtacaatgagctaaatatcatgcaaaaatgtagtacacgatcaaatttaggcatacgcagttttcagaacaaaagaagaaaaaaatcaatgactgtatagtgtatacacttccaatagacatcttgtgcctacagatagaggccattagactgtgtacaagagctgagtcactgcgtcatagataactatttctttgttgattactgcagttgaaatttcgtcgaagtatacgagatgttgagttcctccgaagcaaactactcccgagttgctcagaatatcatctgattagctgccatctaatcgataaggtgtaagcacgaaatagaaaagacggagtgctatcatattgacaaagcaaagtcttctacaaaagtattaaactgacctggacggcaataattttgcagtctcgtgcaacttggtcaataaaaaaattgtttt

SEQ ID NO: 52203 - DNA, 1501 bp, Oryza sativa
caccgattccaccgtgaacccgagctccaccgccactttgccgactccggcagcgcgccaccgccgccctagccaccaccaagccacgccactgccaccgtcggcttcgccgcatcacgtagcaccccggcctctgcttcgttttcccgttccaccgcagcaacaccatctccaccgcgaagccgaggacgtcgccgcgtttgccgtcttcggccgcctcttaccgctgttccttgccacctcgcgccacaccaccgcctctactgcgttcgccgcgctcccccgtaccccggccgctccttcaccttcgttggagaccgccgaatcgccgccgtcgtcttcgccccgtggagcgccgccgcctccctccgcggccgctccctccgtcgccgcgcctctcggtgagccgcctccctcctccttttcctcttcgccggccgcctcccgtgccagcgccgcgttgcgccaccgccgccgccggttgtctggccgtctgcgcgccgcccggccatccccagccgtccgatctgccttggccgatctgggccgtccaacccgtggaccggcggtggaccgtccttgtggtcccggtccacggtggaccgccacctcgtctcgctgacatgtgggccccgcctgtcggcgccggccccctctcttgctgacgttagcggcagtccttttcctttgtgaaaatatttaataattgcgcaataaatcattaataattatagaaattcatttagtggctcaaaacttctaaaattcatatctaattcattcgaactccaaattgggccatttaaattgcaaaattcatctaaaattgagttctacatgtttgtttactttttaggtactgtgtccttcgtttttattaggtttttcctcgttttgcgtgctagcgtgtagaatccgtcgttttggaagatcgcggtcgcgaggaaaagagttcagaaaatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctggtcgcacccatggcagttaaggactggttcgcgggatgccctggaagaacttatcgtacttaccacaagccagcgtgggcaacggctgggcttgtagtgtagctttcctctagtcaatgcatccaggcaagggtgggcgtga

SEQ ID NO: 52204 - DNA, 1501 bp, Oryza sativa
tcaaaaaaaatctaaaattaagatttaaaatttaaatttcagttacgactaacaaagctaaaaagcaaatgatgtagcttagctagggtttaaagtttatccataaattgatctctcctacaatttcttcgatctatccaacaccgctatatttattactcactgtggtaatattatatgctcctagaggcattggaatattttttttttctttttacctcaattttaaagcttgccaattaacctaaaatctcttaaaatttgaacggatcaggtagctacagaattagccactgccttgtttatctctctaggggattagctagctaggggcctgtactgtatctatctcaaaacgccctaacgggaacggaacgaatcggcatggaggcgcatgttacctttctgcaaagcgtgtggcatgtgttgcccaagattacgatcaattggtcgatatttgatcgagatcaagttgttgcctggctccagcaacatctttataatctctctgctggattaattattttaatttttctccagctgtgcaatatacacacacatttgcgcgtaatatgtgcttttgcacgccgattaggcgattgctactatagaaacttaattaacattgcatggcgatggtttgacgaacgtgtcaaaccccaaatcccaggccggtttactcgttttacgttgcttccacgcagacgaacaatttaacaacaaatcgagttaatgtttcagacgcggacggcaacgtgatgctgatgctgatttgcatgaaaaaaaaaagcattgccttaatttttcctcttttttttcatccaattgtaactaccactaccaccgtactcatatatctatccagcacatgcatggatatgcatggttaatagtagtttagcatgtgttgtttcctcatgttcgtcaatgcaatcaggttaattaaccaaatcagcagattgcgtaggagtagatgtatgtgaccgatcgagtaactgaatcaatatatcgatccgaccaaagtccgaccagattgcttttatatccattagcccacatgcaagcaagagctaaccaaagatgagtctcatgttcatcttggccaacaatttcttactttctttctctacagtactagcagactaatttttttaataaaaaagaataatttggattgtttttgtctctcgttgtcaactaggtattataagacaccggatcttgctcaggacatttgtgtcagagccgtgttcctcgctctcttccctttcctttttttctctctctaaaatcgcaacccacaaatccttctgatccgtttgtgtcagagccaaatcttcttcttcttctccatctctctcctctcctcttctcttctctcgttggaaggtgaggaggtgaggtgaggttgggggcgccgtttgatggacgcgaagaggacgccgccgccgccgacgccgccgaaccctaaccctagcgtaattggcagcggcgccgccgc

SEQ ID NO: 52205 - DNA, 1501 bp, Oryza sativa
gtttgtcttcatctgattccgtatgaaaaagttatgtatatatacgtgttttttatataatttgcttaatgtctgcggatatctgaaaaaaattctggatagtttccgaccgttttctgattccgacggatattacccttactgtattcgttttcgtttccaagaaaaaatatccgaattcgtttccgaatccgagaatttccggataattccgactgaaactatcctaatccgaaaaatggtccggacggacgaaaactatccgaaccagtttcatccctacttaaaagcttacagggtggtgctaatatagctaaacaaataatagggtgatgggatgatccttctaggtaactaaccatgttataattctagctcatgaattactcacttcatcccataatataaagaattttgaagggatgtgacacttcttaggactacgaatctggataaagagcctgtcaagattcgtagtcctagaaagtgtcactcccctctaaaattctttgtattatgagacggaaggagtatttgtttttgtaatatttaaatccatgatgtagagtattatggtcaaaaatagcctttttagataactaatatactggtagacatagatttacctccattttactgcatgaattccattttttatacatataagataactagataagtcccatatatccatgaactgagaacatttatttacgccaaacattatatgtctatattggtaaaacaattaaatatatctgttctttataaaccgctatcacgcttgaaacacgacaaaacttgttgaatataaataattgaaaagatgcaaatcatgctctcgctatcaccggtaatcaggagcatatggacagcgacaggaagagataaacacgaactcatgattaatactgcctagacgctgttgattttttatctaacgtttgatcattcgtcttattcaaaaaatgtatataattattattcattttagtgtgacttaattcatcatcaaatattctttaagcatgatataaatattttcattttacacaaaaataaaacgaatagtcaaacattggttaaaaagtcaacgacgttatacattgaaatacggagagagtagtaaccagctagtacatctataacacccaaaaagaaaagtccctccccacaaaatcacagaaagagaacaaaatgaaaaaggaaaaaaaaagaaaaaaaaaagagacggagaaataatacggccggcgtcgcgccagccagcggccatgtccgcgtctgcatccgctgtctgtctccttcctccccgaggaggaagcctggcccgacccgacaccgcactccccccagccagccagccagccactgtcgcggtgaaccaaaatatcccccgcctcgcctcgcctcgcctcgcggtaacatccatcacactcctcccccgccgcggccgccgctgcgcggtagatctcctcctcgtccacctccaccgtctcctgct

SEQ ID NO: 52206 - DNA, 1501 bp, Oryza sativa
tatatatttacagctgacttatagcctgctattgttctcgctcttagcgcaccgcagtcaagcggtcaaagtatggccatgtctatagcaattaatgcaagccggtgcatatgcataggaaacccaagtagtacatggcaggattgagcaatgagcagagttggggagaagaaagggagtagcagggagtggagaagaaatagccaaagccccaaaatccacgaatcagtgaaatgcaagaatctgccccatccactgcaagaaccaaccttcattaccaatcaggccaaatactcatacagccggtttgggtgtttggcggtgtgatcttgttgatggaaaacatcaatatgtgttttgggtggttatgttgcccctgtgtgtttctcttcccttgtatttccccatgtattcactctgttatcctccagggcgcctgcacttgcgcggtcattgctttgcccgtcattgctttgccatgtgtaagtctgtttggcgtaatatattcaggtgggcacttcgcccccgttgacattttcaaaaaaaaaaaaaacgggtaggcagggaggtgatttaccgaggaggaggggaggtgaacagatcggcgaggacgcacaagggtgcatgactgtgaacgaattcgtcacctacacaaaggtgaacccctcatttcttaccatcattcatttagcacatagagcagtcatggcatgagcatcgattttctctgcacttgtatccacagcgcacaaatgctagagccagagagggaaggaaagagggagagaaagagcacccacagcacagccgcagctgcagcagcctccgtcaccatagccacagccgcagtcgtagctgcagcagccaccgccacagccgcagtcaaagcagagctgatccacacctagcagcggcaaatcggtagccatggtttggaccgtgatttgggaaggaggaagagccttagcagcagcaggcagcaggaagaaagaggagctaagctagctgcagcagcttgcatgtgcgtgagaaagacataaggagagagaagaggagttgggagttttagggctcacattagtggtctgcacagtggttaatatggaaccacaatccacagctaaataaactcttacttgcttagatatactagctcttaaataaattctagtagtacatggttcacagattaattagaatttctaacaacacctgcactttaccaaataacaaatggttggtaatataaaacattccttagagcagaatttcagtccgactaaaaataaatgtaaatgttgaaattgcagactacatatatggtgaggaatgcactacacagatgaatggagctgatcttagttttgcacactcagtcacgtcgctcttttgatcgtttccggccgatgaagtgcattccaggtgcatatagtaacgaggtggtgtggagagctgttaggctcaacataaactcggagtgtaataaattgaagtaggggaa

SEQ ID NO: 52207 - DNA, 1501 bp, Oryza sativa
caagttttttattatccttaacccggctttcttgagccagagctctatgcataagttgactaacatcaagaaattgttggccatctaatctttctctaagaggagcaattaaaccattaaaagcaagactagccaaatctctatcagttatattcaaggtataacatcggtttctaacatctctaaatctcttaatataatcaatgacagattcattatatttttgcttaaccgatgttaaatcacataacctaagctcagtttctccagtatagaaataatcatgaaatttttcttctagttgagcccaagtatgaatagaatttgccggtaaagaagtaaaccatgtaaaagcattaccggacaaagataaagaaaacaagcgcaatttaaaagtatcactattaacctcaccacattgtgccaaaaattgatctacatgctcccatgtggtcttactatcctcaccactaaacttggtaaattcgggaactctaaaattacggggaaacggcacatcatcataataatcaggatacggctttttgtaaaccctagcacgattcctagtttcaatcccgaatctattcctaataatctcactaattatatcctctatattattaggcccatgttgacttggcggtggattcagtggcctaatagattgtgtttgtggcgcaatatgattatattggccttgtctagtatcggggggataccccctagcaacatcattataagcattaggaacatgtgggggaacctggggactacttgcagcagtagatacaggaggatcaaatgttctaagatgatacaaataaccagcattagtcattggatgtattccttgtatcggaacaattgcaccggtgtgaccggcccaaggcccggtctgaccggcatccagaggcgcggtcggaccggcactggcttgagtgccggtctgaccgaccgtttggccggttggaccgacggctaagtcctggtctgaccggccgtcaggcccggtcagaccggccgcatgcgccgcttcatcggttttactacccgtttgatctataggaggttggttagcagtggtagaggctttattttttgacatgtaattggccataagagggccgaatttaacccttaaaaactcatcaaatttatcctcaaaagttgcatctaacttatctttaaaagcaatcatagatgaatctattgtagatgctacttgttgttggatagattgtgttacctcatcattacttaccaagtcaggagcgagcttaggacgtggcccgggcttgatggtcacaccttgacgagtcctagtgcttgccctcatcaatgcctcccgtgtgagttcgttgatgtactcctccatagctttacggtcttctccttcgaatttatccaaggtgactggcatcatattggatggctccacctccgtcttggatggcggctacgtcatgacgaagtcgaagttgagttgacgatgaacaga

SEQ ID NO: 52208 - DNA, 1501 bp, Oryza sativa
caagaaagttgtaatgaaaattgcctttgtgcaaacagggcccatccatggttgaatctaaagaggctctgtttgcattctctttttttttgtcccactggattgtctatactgtgatggcagtaaatgagtaactccaaaaacttgatagcagcatgatccttcagcagctggatcatttacaaatgtacttggcacctacagttatgaagctaagaaattatgaactattaaaaaccaagaaagaccaagttgacagcatcattctgttctagcaaacaaaattatgtaccaggagcttctaaattacaggagaacactatttgttattacaaggagctagtcagtgatactcaacagtcaattcaagccttcaaaattgagcctaactgcctatgttcatattacacatgaaggtaacaccatggtagcaagatatttggtttgcaaaatgaatttgcggatgagttacataccccattttggctttcccaccagctttcgtcagtgacaatggctgaagtaagggggtcccggccttgtccggttgcctgcgattcaagccacacccacagctggaaccgcttctttgcactgccccagatgtactccaattgcccttttgtcaccttcttcctgcacttggtgaacattttcttcgccaagttctcccatgccttgggtttgggggagttcgaggtgttgttgtatgccgccatctcctccaagcaacactcaagaaacacacgcagctcgaaatcggtccagcgaccacgcggttcggacatctactgaaatgctagtcaacaaaaaatgaaagagagaaaagaactacacaagtcaattgaacggctgacggtggcaaggctcattcgacgcacgaactcgataacggctttgggggacttggcacacaccgtacagagggcattggcgatgtgcacgacgtcgtcggctagagccttggcggtgcccgtgtccgaggcgaccgactcggaggagccctcgccggactccagagtggatcggcggatagcgattggtagaggtgacgtggttggaacaatctccctttccaaggcagggtgtgacagctcaacctctcctttccgcttcttccccctcgcctccattcccctacttcaatttattacactccgagtttatgttgagcctaacagctctccacaccacctcgttactatatgcacctggaatgcacttcatcggccggaaacgatcaaaagagcgacgtgactgagtgtgcaaaactaagatcagctccattcatctgtgtagtgcattcctcaccatatatgtagtctgcaatttcaacatttacatttatttttagtcggactgaaattctgctctaaggaatgttttatattaccaaccatttgttatttggtaaagtgcaggtgttgttagaaattctaattaatctgtgaaccatgtactactagaatttatttaagagctagtatatctaagcaagtaa

SEQ ID NO: 52209 - DNA, 235 bp, Oryza sativa
aatcctaggtggatgcctaaggatttgacgtctgctcaaaagagaaggttgcaatgtcttcgggctcaagagataagagagaaaaaagccgaagaacaaagagataaaaggtttaatgagttgcgaccaccaccggtatggaggcgtaaatccatagagaacgaaaagtcggttgttgtagaggagaaggaggaacaatcggttgataagggtgaatcatctccaaaagaagaca

SEQ ID NO: 52210 - DNA, 191 bp, Oryza sativa
  unsure (1)..(191): unsure at all n locations
gagcacccgagtaagttgtggtcgagtacaccacattatcgagaacgatctcgacaaatgcagagtcgtcgcgcccaacctaccaacgaagaccgacnnnnnnnnnnnnnnnnnnnnnnnnnnctggactactcgagaaaaggttgttaacggataattcctcgcgaacgtcgtcggcttgatcacctgac

SEQ ID NO: 52211 - DNA, 299 bp, Oryza sativa
ttcctgcagccccagaatgtctagatagttgtacaagtgcgcctttatgtcttgagtatggggcgatttcagaaccagcagctccaactgttggtggggtgatttcagaactagcagctccaactgttggtgtagaacaaccaccaattcattatgttgattgggatagcttggagatagatggaacattagatgatgagggaaggattcacgtcatgaatgatgaccaattgtttgcactcctaggcttgagggataagggcaaaaaaatcagtgcatgctgttggttcaagtagtaa

SEQ ID NO: 52212 - DNA, 1501 bp, Oryza sativa
tatagcgaaagattattatattattatataatgtatgaagtagtatgtatatacaacagcaagttgaatttggcgtaaacaggaccatatgtacgactccaagcacgaggagggctcattccatatatatcaacaaattagtgtcatactgtcatggatctagctaggtaaacatcgtcctatctgggagaaatatgatatccatgcatcgccaattcgccataggattaggaatcgatctcgatgatcagtctccgataggccggcctgccggccccggggtagctactatacgtaccggctatagctgcggtgctatccatggatggagcagcacacacgcgcgtcagtgaatcccgggaaaccctcccggccacaagttctccggtaggcgcgcgcggggcccggccggagtttggtcgcgcgcgttcgtctctcgtcgcgtcgtcgtcgcgcgcgcccgtgaacctgctggcgtgtgtgtttgttggccgggaccgggatgatcgatcgagcgatctaccgcgcgcgccgcgctgacatgtacgcagcgacgacgatatgatcgcgcgctgctgtatgcgtgcctgctgctagcgctacccaacaagggatcttcacgggctgcccaaccttgcctcccctatatacttctctgcatctattccagctaattaaactgcagatcaattggacggatatatagagctagcgcatttcagcgcatgagttctcctgatattgcatgttgctcacggtccagattggtagtatttagttgtgtataatgtattattaggttgctgtttttttttaaacggagagagtagttatttaactaaccatgcgtacatgctggcatcaaattaattgaggttttttttttaaaaaaattatctggtcatagatattcaatgttcagcttaagatgatccatcacaattttcaattgtaatgaatataactaagtgttgtaaacgttgctacgttcttcttaactactaggtctgaattaaagaaacttgaacttgataaaatatagtacaaaacaatttataatatagaaattaatactactataagactttctagcattgcccatattcatatagatgttaatgaatctaggcacacatatatgtccagattcattaacatatatatgaatgtagataatgttagaaaatcttataatatgaaatggaggtagttaatatggaacagagggactactgcatcagaaaaaaaaaaaaaccctgcccaaatatgaacgagtgctgattgctatatttgtcctcgccaaggctggcgacaaaactgtttagcatgccaaatataatccatcaccttgttgacttctcccaagaaccaataatttgcaaactgtagggcacagttcgatcccgtaataagatagttgcaactgaaacccaaccgaaggacccattgtgaaaaaccacagactttccaggtttcaacccaaaatctcccatccgaacac

SEQ ID NO: 52213 - DNA, 1501 bp, Oryza sativa
agtgcttgttgcattgatcgcatgcctaatatacttggggtttttctataatccaacgcgcgcggcatcgttgcgcgagctccctcactgtgttttcgttttcctttctttgaggcctgcttgtttttgagcttgttggatatcagcttactattcgatcggtttgcatgggattcatattttgatttgcaaattatgtatcgtcggttttcatggattttagtaattaaagggtctcgcattatgaatctctaacggattaatttgtaccctgctccgttactcgtctggtgcataatcctaatctttgggctccttttgattgaaggattttcataggaattttgaaggaatcaaatccttaggaattttttctaatttgcatgtctggaacatagtcttggaggtgagcaaattcctttgaattaattgcaatcctatatagctctaatttgcatgtctggaacatagtcttggaggtgagcaaattcctttgaattaattgcaatcctatatagctcaacacattcaaatttttgtgtattaaattcttaaaagttttaacacatggcattccaatcatgcatttttcggcctattcctatgtttttgaaatccagcattccaaaggaactactaataataataatggcgcagttaaaactataagcaaatggtaggctatatttggagaacaatcttatctattatatactaaaagtccattaaaatttctcaaaacgcttttaagtcgccatgtgacaatctagtaattagagaaaatagtagaaaatcagagaaaaaaacaaaacatctatccctaaattttcatttaaatcggtgggtccaatatataaaccgttggatatattttttttagaaaattatgagcagttatgagtctgatcgtctcaagttagcatgcgagtttttttaaaagaatttcttatacgactcttactgtattttcaaaaacgaatgaacttaaaaaccgactcaaatacggatatggattttcaaaagcgaacgaacttaaaaactgactcgtacacggatgacgtaccaaagtaccggtaaaaacatctttaatttttatttttccatgtatatagttgagacgacaattatcattacttttagtgataataatttttaaataatagttactttgcaaatattgaattatcaacatataactctttaaaaatagaaatagaagtaaataaattagtttctaatatataaaatatagtttacatcattatcttatactatataatgtacccattattttagatttttatgtaaaaatatttgtacacatattttcactaaaataggtggacctattatttagaccatcaaatctatcttttgttaaaaaaaacgaagactcggaagatgtttctccgcccctctacacaacgcacatgtgcgaaaatccacacgcgtgacaaagagtgtcgtacctaaggtacctaaaatgatcatgagttcatga

SEQ ID NO: 52214 - DNA, 1501 bp, Oryza sativa
gcgggatgggccaaacaattttgcaaaaccatacgggatggcccgcccgcaaatttacgggcttttttgtggggcgggactacgggccataaaaaaagccagccccacttgcacccctaattttaactccctcccatatactccttccatcccaaaatatttgacaccgttgacttttttaatcatgtttgaccgttcgtcttattcaaaaaaatttaagtattttttaattatttttctatcatttgattcattgttaaatatatttttatgtatacatatagttttatatatttcataaaattttttgaataagacaaacggtcaaaaatgtttaaaaaagtcaacggcatcaaacatttagggatggagggagtaacttcaatctaattcacatccctgaatcacaataccacatatctttacactcaactattagaactggtttaatttaactctatcagtggttttgaagggaggtttcgctgatgtgacgctttgacttggtctaagctgccgagtcatcttgtggagcccacctgtcaatgactatatctcttctcttcccttcctttccgcttcatcagatcggtgctacctcatcttttgccttccgctccacgtcgggccaccgttggggagaagcgcgaacgtcagggggagtggcgacgagccggcccatggcaacgagctcgccaggtcagcaacgggcaagacgacataccgaagacggttcagcttcgtcctcctcgacatctccatgccctagcttgcgcctgctgcatgtgcttgagtagcgggtatagcggtagggcaccgcgatctcctggctgccgacggcggccgggtcgttcccctcgacgacgacgacgcacacacatgaagccagcgatgcacccggcggtggagaactgcaccgggccgaggaacttcccttcaggcaccaaatggcgtagggacgacgacaacgagatgacagctttctcttttctcttttattttttatatgtctttatctcaagatctgagctaatcaagttgtattttttttccatttaatttttaagtatttatcttagaatttgagctaatcaagttatttgagttagcttgattattttgcttcatggcttttttctgattgtgtgccattctatacgaaacaaattatgccgaacatcctactttcaatggaagtgttatactccctccgtttcataatgtaagtcattctatcattttccatattcatattgatgctaataaatctagacatatatgtttatctagattcattaacatcactatgaatgtgggaaatactaaaatgacttacattataaaacagaggaagtagtaattttatttccttgctttttacttatctgtcatagaaggtagatccgtcatatacgtttggattgatttatttgttagggatgagttgtaactgtgtaatttctctagcaatatcattcttttaaagtgctccaatcttaaa

SEQ ID NO: 52215 - DNA, 236 bp, Oryza sativa
acgccgcgctcgcccgtcgccgctccgcccgccgtcgcgccgcccgtcgtcgctccgcacgccgccgcgctcgcccgtcgccgcttcgcccgccatcgcaccacccgggctcatgagtgtgcgtcgtcgcctcgtcgggtgcagcagagctcggccctcttcctcctctcccgccgtgcggccaccccctatcccgcaggcgcgggcagtcccgactcggcgcggatggtgacaga

SEQ ID NO: 52216 - DNA, 1501 bp, Oryza sativa
aactttctaactcatcccactcactggcacatcataattagttggaaaaagacaacaatgatagtaactttcttcttgtaatcaagttttgattatcaattgcatgcatgcaaacgttttgtttctagatgcagcatggcatatatactagactctgtttatacttttcatgtttgattgtatagtagactctgttgtatttttatgctgaattttgtatctgtacatgattccctgccttggtgagcatgtgcagaagtatctcagtacctgctaatttgaatatcagctagcagaattttttttgttgttttcagaaccaatcttaaaggctaatccagcatgcaaactggagcttaattttgtgcggtcccttcatgcttttgatcgatacaggctagagggacatctgaaagcaccttctcatcaaaacacaatcagttagtcctcgtcagtcgtcaccatgctgcaatctccaataggcatgattaataaagattattcctttctaccttggcgagtaggttcagttcatgacacttgtgctagtacttgagttccatggctgcatgcctccagaaatctgtcacaattacagcgaaaaatgtggtatcaaagggttaacttgccacattttttcatgaacttgttctgtcagagctggaattagcaagtatatacataccaatattcgtttatgtgctgcatctgccggcgaagaagaaaaagaagcatcaagaaaggcaaaggacgatatcgaatctaaatgcgaaaggcctttttgttcgtgcaaactattaaaggcatcaccttaaaagattcaaaaacccaaaaacggacaaaactgaatcatgttgcctcgctgtcaaactgactgtaatccaactccactaatgctgcacgcacgcacgagttaggctgatgaatgcttttgtcttcaagttttttccattgtgtcaggatgtgatcaccgataaggaaaagtttactaacgtgacaagttaattcctgaagaaatttctgaatgaacccagagaagttgtccaggttctaaacttcaaaccatcggtagcaaaaagtcggtcacttttctgcattttgcaagcaaaaactacatttgcttgagtcttgggctctggactctggttgatcaactccctaactttttttttctcccttaaaacagtggttgatatcatgcatgaagaaatagtttcactcttccaacaaaagaatttcactcatggaagaattgatagcgtcaaagatccgaaaggtgaagacacatctactcccaacaactataccactacatctgtacaagtacatagcactagttgcagaccttgacactttgagacttgcactagtgccacggccaggctcccaggcacagagagataaattcaccagcctcgcccgcgcctcctcacacacttgcaaagcatttcaactacaccaagagggaaaaaacgtgccaagaaaaccatggagttcgtcg

SEQ ID NO: 52217 - DNA, 1501 bp, Oryza sativa
gcgccgcggcgcatgcaaccagcacaacaagataagcgtaggcggcggcggcggcggcgagaagcgtaggcggcggcggaggaggaggcggaaggcgataacgcggcgagatgggaggatgcggggagcgggcggccaataggcgaggcgagacgaggcgaggagatgaaacgcggaggcgaaaggggacggttggggtagcgaggccttgccttataggagtactacgagttggccgcaggccgcagctgcaggagaggcatgtggcgatggggatggatagataggctaggcagcagtgcagtgcagtacaggctctctctgtccctatctctatcttcttcttctctctccctggctgcttgccatgtgttgcagtacaagtttagtactgctactgctgatgctgctactccagtttccggatttgcgatttttgctcttcttcctcctcctggccacacgagatacgcgtgcctgattaagaacggctactaatcatcaagttgtgtgttagtagtttgttagtttattactactactactaattaactccctgtgtgttcattgattagtagtgattataacaaggtaggacgactagttgggtgtatgtgaaaccgagagccgttttcgacgagattgcaaaagggatctcgagttcgagatcgcgtactaaaaagcagcggtcggtggcagaaagtccaaaccaaacccccgccttttctccatcctcgtttatcgatagccaccaccgccgtgggcatattcccgggccttttcgggttggctgccgcgctcccgcgtgatctgctcgcgggcgacagaggggaaaacggcatatccgggcggtgccgcggccgtgcgcgcggcatatccgcccaccgtggccgtggcgtgcggggccaggtcaggtcaggtcacggcgcgtgatctgggcccgggccccgcggatgggggaactgatccggtggtggcgcccccgcgcgcggctggtgctaattccggggggcgcgtcacgacacggcgccgcgtcagcgtgcgggcgcgcgtgcatggcttgcttggttggttgttcggtttcgcttgctcacgttttcctccttgcgcttttcggattgtgacgggcgacttccccggaccggccgtccggccccatcatccttcttctcgggcctgttgtttaatggacagacgatttgcgtcctactgtacaatcccgtttactaatatataaaaagtgctccatttcaactagtatggtggtgtttgaatcttacgaagataaagacgaagataaaaattaagtgtttcacgtaaaacgaggtggtaataacatataattaattgagttttaattattataaacttgaaaaatggattaatctgatattatagaacaactttcatatagaaaattttcgcacgaaacacactgtttatcagtttgaaaagcgtaccacgaaaatccaaaactttatccactgcttgtagtggaaac

SEQ ID NO: 52218 - DNA, 1501 bp, Oryza sativa; identical to SEQ ID NO: 26432

SEQ ID NO: 52219 - DNA, 1501 bp, Oryza sativa
ggcaagatttttttttaagcaccttggtcccacatggcattgttcaccatattgtggtgccaaatttgttcgtctaaccttagacaagcttggcaagaaaactatggcaaccctaggcaatgttataatacaaaccaaacaacgaatgtcaggctatcatgattctgtggtatgtatttttgtaatctttacatgttttcccttgtttttttcaacagaagaaaaggggcagtcgcaaacacggcacaggagctcagtcttgtcttccaggaagttatgtagttgactgaccacacactgtcatacatacacaactgaatgggaaatgcattcccgctgatggcaccaatgttgggcatcagttgccatggagagctgttcgttcgtgcccagtcaccgagctccaaggcacagcagcagtggataacattttgttgccactgtttgttcctcttgtacacacactaaccaacagtgctcgagatccttgtctgttgtcacttttgaagggaagctgccatgagcggtgacatctgccggcagcgttcttcgcgtttgtctcattggtttctgaagataccagtttgcccttgatagatgtggatgaccgtgagatggagcgaatgtcagcgattgtaatgccttgctggctgtagcctcttctctcgtgtcttgtgttagcgggttgcatttgatagtttattgtttggttgtgatgtctggtcgattcaatgacaagattgatgaagagtgattgagctccttgtacacctgtacatcagttttcttttgaatagtatttgagatctatactcttgatcgacacctttgttactcgttggcttgtcacgtccctacaacagctaatgtctgagttttgatgaaacatttctttgcttgtaagtgagatatgccctttggagtattatctggagggtcatgaacatttcattgttaagcttcatcttctgggtaaaaacacaactgtaccttcaattttttttcagggtacagaacagtaaactcctgaataattctgctcacattcacaaaatcaaacaaaccaacatacaatctcattaaactcgtaaccacatttcacacgacaaaggacctaccatgcaacatcaaaaacaccatataattaagaagactagaacaacaacaaacattgggcctaaacaaattaattcgacgacatatatgagatgagaggcactcatgcaagtgcagcatgcccctgcttattcccttctttaccaagcaggcaaaacaagctaattaccatgatcaaggctactacgaaaccgaaggattcgatggatgaatcgaatcgcggcaagaacgagctagccgcaggtggggatgcaggacttggagcacttggcggagcacttggtgtgcgccgacatggtgcaggtcttgccgcacatgagcctcttcttgtggcactcctccttggtcacgcagctcttcgacttctccgcctccttgccgccgc

SEQ ID NO: 52220 - DNA, 1501 bp, Oryza sativa; identical to SEQ ID NO: 26431

SEQ ID NO: 52221 - DNA, 1501 bp, Oryza sativa
ttgagctaggatagcacaaaccttaccatttttttttatttcggcaagcatgtcccaattcaggaaacaaaatctaagacatactcccttgtttcaaagcgattaataatatttcaaagcgacttaattattataatatgaaaggaagacttataatatgatgaacagagacaaagtaagatagaaaaagtgaaaccaaaaccatgaaggaaaaagtgtaaccaacacaatgaagaatgtgagccggtaaattagtaatccgttatttctatagtgacgttcttttctcttgaagatgaagttttatacgcaaaacgagatgatattaatatatgattaattgggttttaattattacaaactagaaaatagattaatatgacattttaaagtaactttcatatagaaagttttcgcacgaaacgcatcgtttagtaatttgaaaagcgtgccacgagtatccaaaattttatcaaattttgttgaagaaaagaacagggtcacagtgataccaattaattacagttataattatgatcctagagctcaacactcggcaagccaagtcgtcactcatataaggagataacacaaattaagagtgccattaaatggtagcatgacttcattacaaaccactgcagaggtgactatcaaaatacatcgaagtatgaaatggacagcacaggagaatgtccgaacttgttcacaacactgcccagatggtatcgctgccagcatacaatctcgatttatgagggatcatttggagttcccctttcctactgttgtcgttgccattggcatgataaacactcggcaccacctccacaccggtcaagacagtaatgttcttcccaattaattcatcggagtccccttggggagtcttattgtgaaagaaccttgcaatgcagaacttgcccgagccaaggttgacaagttgagaatccttgcatcgcttccattcctctggctggtcaaactccttacaagtagctagtagctgtggctgggaattcatcgatgagagatcagcagcagccaagtcttgggtgtcggcagaaatgccaacccagagcttgagctcaggtacatactcaaccttgccggtgaagggtagcatccatttgccgaggtggctccatgtgaagctccgcatgtccatacaataggtgccgacaccttttacagagatgcagatgttcgagccgtcaccaagcaaagcataggaactgatctccaggtacctgcccaagtatgctctgtcatagatacatggcggtggcaggaggatctggcgggtccaggacttcaaggtgctgcttccacgatagtggcagtagatgaaggcctcgaattgattgtttcctaactttcctgttttactcctcttatccattatgtaaaggttgccaccgtcgaagtcaccggcttcctccaggcaggggacgaagatggagatgggtatctccttgggctggtgaagacagggcagcat

SEQ ID NO: 52222 - DNA, 1501 bp, Oryza sativa
tagaagttggacttgtatgtttgtggtgatatattacatgtaacacatcttcttaaattttttttcataactatttaaatgacatgcagagagatattccctcgagagtttagaatccattcccttatttttgtatgcttcccgaatcttttacaatttggtcctttttaaaaacttatttcacaaataggcctctggaaaaacttatcccagaaatggtcatttttagggtgccaaagtcagtgacatcatggtccaatgggactaggatggggctagcatatctggcgccgtctccctgccactgtggcggaccagcgctggcgtggaagggggagcgtgccaatgatgctaccccccacccacaatgctatcttttttttccttggtgcgctccccccgagggtcacacccatcccccgcgccctccctacgcgagcccgagcgccgctgctcttgctctctctctctccctcttctcaaatccacgcaagatttatcggtaagagactttctgttttcagtgtttttatttttcctatagtcagaaagttaccaaaacaatattagattacatttccttaatcctataaaccctttagcatttttttactagcattgctttgttagtgtttgttgagtttttttgttacattcgagtgacctttcttaaaacaaatacagaaaaaggcaaattatatatttacaaatatctacataaaaagttacatctgattctcccccatttcgcccgggtttggtgaaattagaatctcgaaattctgcttgcaagattgtgttttcaaggcgagaagttttttgatagagctttgaaaaattctacaggtcacatttcattcgtttgagtttaatttttctatgtttggttcttgtgtgctcctaaatgtgaaaaagtataaaataaaataaaagaaaattatcattggcgcgcttcccctgccacgtcagcgccggccagccacgatggcagggggacggtgcaagagatgatgtcaccgtcctattggaccacggcgccaatgactatgacgtccaaaaagaaccatttctagtacggtgtaagtttttttaggggtttatttgttaaacaagtttttgaaaaggacgaaagtgtaaaacatccaggacggctaccgcctccgtactgttcgtcgccgcagacaatactctgacacgccggcaggcggcggcagacagcttgtactagggtgcacagtgaacaggggcccatcgatcgatcgattaatcaatcgagagctagctacgctagggagaaggcatgcagcaacattgattaatcacaggtgattattacccgggctagctggtaggctggctgggctgagacgctgagatgagacgagatgagaggtgaggtgtggtgctgagctgagcactttgatggcaatcacaggcggcaatccgagacgtcgcttttttacctcccattaatcccatgcatgcagccgatccgagcccc

SEQ ID NO: 52223 - DNA, 1501 bp, Oryza sativa
gttacaactcatccctaacaaataaatcaatccaaacgtatatgacggatctaccttctatgacagataagtaaaaagcaaggaaataaaattactacttcctctgttttataatgtaagtcattttagtatttcccacattcatagtgatgttaatgaatctagataaacatatatgtctagatttattagcatcaatatgaatatggaaaatgatagaatgacttacattatgaaacggagggagtataacacttccattgaaagtaggatgttcggcataatttgtttcgtatagaatggcacacaatcagaaaaaagccatgaagcaaaataatcaagctaactcaaataacttgattagctcaaattctaagataaatacttaaaaattaaatggaaaaaaaatacaacttgattagctcagatcttgagataaagacatataaaaaataaaagagaaaagagaaagctgtcatctcgttgtcgtcgtccctacgccatttggtgcctgaagggaagttcctcggcccggtgcagttctccaccgccgggtgcatcgctggcttcatgtgtgtgcgtcgtcgtcgtcgaggggaacgacccggccgccgtcggcagccaggagatcgcggtgccctaccgctatacccgctactcaagcacatgcagcaggcgcaagctagggcatggagatgtcgaggaggacgaagctgaaccgtcttcggtatgtcgtcttgcccgttgctgacctggcgagctcgttgccatgggccggctcgtcgccactccccctgacgttcgcgcttctccccaacggtggcccgacgtggagcggaaggcaaaagatgaggtagcaccgatctgatgaagcggaaaggaagggaagagaagagatatagtcattgacaggtgggctccacaagatgactcggcagcttagaccaagtcaaagcgtcacatcagcgaaacctcccttcaaaaccactgatagagttaaattaaaccagttctaatagttgagtgtaaagatatgtggtattgtgattcagggatgtgaattagattgaagttactccctccatccctaaatgtttgatgccgttgacttttttaaacatttttgaccgtttgtcttattcaaaaaattttatgaaatatataaaactatatgtatacataaaaatatatttaacaatgaatcaaatgatagaaaaataattaaaaaatacttaaatttttttgaataagacgaacggtcaaacatgattaaaaaagtcaacggtgtcaaatattttgggatggaaggagtatatgggagggagttaaaattaggggtgcaagtggggctggctttttttatggcccgtagtcccgccccacaaaaaagcccgtaaatttgcgggcgggccatcccgtatggttttgcaaaattgtttggcccatcccgcatagcccgttgggcgccaccacattagggcacgagactgggtctctggga

SEQ ID NO: 52224 - DNA, 1501 bp, Oryza sativa
atgatcttgtggctataagatctggcggcggtgagctcgggggcgcctgatccagcaacccgcccgctgtagtcgttgaagaagagggtgaaaaccctcaagcggctagaggtagaccaaatattagtttttttaattggtatttttatttgttttttaagcttttgttcttgttcttggctttgtggtggtagtattaaagctatgaaactttgggacaattattccaactttgggaggattttgttaatacaacttggttttcctttctttgattctgaggatgcaaacaacgatcggggttcaggacgatgggcgcgatgggatttgttcttgactgttttatttatttcggattcttttcgatccgagtaatcgggtatgatgcgcaggggtggaggggatcgtgagcaatgcggacaattagcgcttacacggacgaaaaacaagtgacgaaaggaaaaatacgaatcttttaattaggttattagttaatataagatataaaaatacgaatcttttaattaggttacccaagtcgggtagacctatccctagcagatctccctactcccatccccgccggctgccgccattctgttgggggtgctgggtgctcctccttcccttctccggcttggcgaggtatgccctttccccgagatctacatccactctctttccttgttctctctgatgattatataaggctgctcacttgatgccttcttgccaaccctgcaactatacgctctcctccttgctggaatcactcattccctcacaatagcagctgtacctggacctaaggtaggcctgttttttccccttcccttggtaaacaaatctttcctgtttattttgattttgattttgatgatttcatccttacttcttggtaacaaatgcttttcgtgttgtttattttgattttgaagttcactccgataatggccctctcccggaggtttctgaatctaatcgtggacaacggcttccctggatccaaatcgctgcgctgcatcgacctcacgctctagaatttcttcaacgctactccaccgaatcggaacggatcagagtccaaagttatcgcggctgatgcctgcatccagaagcagaagaataataataaggaggaggaggaggccggcgcaagcagcatggatagtattcaacttccaagacccatcttcaacttccaagcttcaagtgtggcccatcactgggagattggatgcttcccgcttagaggtcgcgaggtgctctgcatcgaccagaatgggtgttgttttctcttcgacggagacacacgcaacgctgttaccatgcccggcctctgtcagcccaagcgattcccactctccttgtttgtccccagcaccggagttgataatgacagcggcagcctcttcatcatggagtctgttgttaaaccgaagtcgacaagcagtgggccgcgcagcgatcagtttgaggcctttgtctaccgcacgccctc

SEQ ID NO: 52225 - DNA, 1501 bp, Oryza sativa
cttaggttgctatattcttggatggagggagtatatccaccatcgatgctgcttcagtctctctctgggccagctctgtttgttctcgcaaagctacacacaccacagcacagccttgtacagtgatactaacctcttcctctgtcacattcatttcagagtttcagataaagcgattctcctcccagctttgattaatcattttctaactcaaagagaacctccgttagtcaagccacgacggaaatatataatttacagaaaaaaggttttattccgaatgcagcataagtgagtttcaaggcaatgcttgagtacttgttcagagttcagatgtgaggctaagaatcttgttcgatgtacaatggtagatgcagaaattacgtatccaatactagtacttaccgacacaaactgtacgcttagctaatctgtaacgaaacgtgacagaaaaaactgaagacacgattcatacatgggaaacgaaatgagtactaaattttttgaggaaatttcacaaaactacaggtattttgcacaatttatcataaattaaaagtttgtttcacaaaattacagatttagtatttccgtttatcacaaaactacaagtactttgtacaatctatcacaaaactacagatttaagaacttgttgacaaaactatagatttagtgtattcgtttatcaaagaactacacatttagtgttttcatttatcacaaaactacaaatttagtgtctccattatcataaaactacaaatttaacaatgctaaaacatatagttttgtgataatgaagacactaaacctgtagttttgtgataaatgaagatattaaatatgtagttttgtgaaataaattcttaaatatgtagttttatgatatatattgtgcaaagtacctgtagttttgtgataaacgaagacattgaatctgtagttttgtgaaataagttcttaaatatgtagttttatgatagattgtgtaaagtatatgtagttttatgaaatttactcaaattacttttacaaactttctataaacactgatgtgtgttgaatctttcagttgattcaatcaaacggttgaaatttttgtttgcaagaaactagctgggtggcccacgcaattgcgcggctagcacttaaataaaatcatatattttttatatgattttacttaaattttattaaatagctatctcattgtcttaagagtttgaaataccaaaccttatcatctacgtgtttctaattatatagttttttaaaagtcacaccagttgctacccctatgtcatctccttctttatttgcttgctcgatttatcactatttctattcattctcattggaacctttagaaattggatcttgtagtttttagagtttattatcacgttgggttcatttttataatttctagacgtcccgtcaaacgttgctattatacttctctatggcccgtccactgtctcttctctttattgtcatt

SEQ ID NO: 52226 - DNA, 1501 bp, Oryza sativa
atacttgtctaaacatttgaggtacttatggtagatgagaaaatgcaggcggcctcccgtagagtttgtgagcgcatcaaataagttgcgaacagtgatcgcgtgtgccattgcaggacacgcaggaataatcttggcaaatgcttcaggactgaccgttctcctcccatcaacctaaatatttcatcaaatgtttggattgatacttgagaaaccacaaaatatgtcaaattgacagagatatatatataacctgaatggccatttgtgtggggctcaaacagaacatggacccacaatcgtcgtcatccttgccgtcaacgaagctaaatgacattttctgttatagcgtatcggtttctgatcagagttgcgtatgaacaacaaacaagatggtgatgttgaattgggggtgaaaaaaaaaaagaaaaccggggtgtcatcacctgcaacgcggcgtccgtctcgtcgtcgggggcttcccaggcgatcatcatgtcgtaggtgagcgagtggaactcgctgtcgctgaggtagtcatggcgcttggtctcgacgcgcagggcaatgtaggagcagtactccacgacgctcctggcgtacgccagcggctggtcccccttctccggctcgaaccgccgcagcagctgctccacctccacgccggcgatcctgcagccacgatcgataaaaaaatacacgaatattaagaaataacgacctaatatcaaataatcagaagaggtgaggtttcgaacccaggttgacgtttctcgccgcgatcgatcaggaatcgatcaattaaatcaaattggacattaatccatacgacgaggaggagatgagggagatcataccgggcgcatcggtggacgacggaggcggcggttggggagaggggagggatggcgtagtcgggcgccgccatggcctcgccgtcgccgccgccaccgccgtcgacgcgcggggcgaggaggaggtcctcaaggagacccatctggggtggcgacgacggagcaccaggagggacgcatcgttcgttcgttcgttcgatcgtcggcagtgtgtccccgtcacgccgcccgtttaaggcaagcgagatttgttggagacgtgccgtgcttttgacggatgctctgcgacgcaatgcgatgcatgcgttccgccttgcccttttcgcggacagttaggcgcgcgcgggtttttttttccttctttccttcgtctccgacggactcggccgtccacccagccactcctccctgtgctgtttgccctctcgaattatcggattgtaaacgttattattagtttgaattaaaaaactagttgtatatggtacttaaaagtaaattcgagcttttggttgttctgatcaaccattgttttatagatacagcaaatggaacataataatgtattaccacaaataacgttgcagaatacatagttcatgcaattagtataccgttaaacggctcaggccgccgattaccaacca

SEQ ID NO: 52227 - DNA, 728 bp, Oryza sativa
tttgctcaatattgatattgaaggatttagtctaaaaaaattaaaatgtccagtgaagaaagagcatgatttatgatttacttacagattgcaatcctatccaatcttctgcacatgttatgcttgtcgacacaccgtatggcgaggtcctcgactttgttggagaggatgagagagcacaggtactcaacacgctcgcgcatgacgtggatgatggcgaggagctcgagacgcctgagctgacgaacgccgtcagcatctccagccctagatagggagctgctgtggagagcttcaacaagctacgccgtggaggaagaggaaggcggaggagctcgaggaaggaggagggaaggtcggcgatgaagaagatggtttttttcctcttctgccagccaccggttgcatcaagggagagagaggagaagggaaggaggccggcaaccacccctctccgccggcggccatttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttataaccttgccccccaacctatataaggagggcagggagcccctctaggggca

SEQ ID NO: 52228 - DNA, 1501 bp, Oryza sativa; identical to SEQ ID NO: 41378

SEQ ID NO: 52229 - DNA, 1501 bp, Oryza sativa
tcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcgacggcgacggaggcaggccggcggtgaagtcgtagacgcccaacagcggcggcataataggccagccgtgtaggcggaaacaccagtcggcggcgacggaggcaggccggcggtgaagtcgtagacgcccaacggcggcggcatataggccagccgtgcaggcggaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgcttgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggat

SEQ ID NO: 52230 - DNA, 753 bp, Oryza sativa
cccacaaaacatcagtcccaaaaggaaagaaaaaagacccgacaccctgaaccgaactaaaagctgaaaattaaaatccgaccacgtgcagtgcgaccaatcgcttaataaatagtacctctctccctctaatataagggatattcattattttcttataatgtttgactacttatcttatccagaaaatttgtgcaaatataaaaacgaaaaattgtgcttaaagtactttagataataaagcaagttacaaataaaataaataataattctaaattgtttttaataagaccaatggtcaaacggtataagtaaaatgtcaaaattccttatattaagagaaacagagggagtactgtttcgaagctctccgcgctcccaaattcggtgcatacgcaggataaatcgttcatcctcggaacgtgcagcgcgccgacgccgtctcggccttcatccgttcatcgtcccctctcctcactcccgttagcgccgccgtcttcttcaggagcaagcgagatagaaaggtagagaaagagagctcagaggtgctcctcgctagcgactcccctcacctttcgactccaggtgacgtcgccgccttgggttcgcgtccaacgccagcctggctccctctgccgtccatctccagtatcctgtttttccatggaaaccctagaaaatctatttcctccgtttcataatgtaagtcattctagaattttccacattcacattaatgttaatgaatctaga

SEQ ID NO: 52231 - DNA, 1501 bp, Oryza sativa
tgcttaaagtactttagataataaagcaagttacaaataaaataaataataattctaaattgtttttaataagaccaatggtcaaacggtataagtaaaatgtcaaaattccttatattaagagaaacagagggagtactgtttcgaagctctccgcgctcccaaattcggtgcatacgcaggataaatcgttcatcctcggaacgtgcagcgcgccgacgccgtctcggccttcatccgttcatcgtcccctctcctcactcccgttagcgccgccgtcttcttcaggagcaagcgagatagaaaggtagagaaagagagctcagaggtgctcctcgctagcgactcccctcacctttcgactccaggtgacgtcgccgccttgggttcgcgtccaacgccagcctggctccctctgccgtccatctccagtatcctgtttttccatggaaaccctagaaaatctatttcctccgtttcataatgtaagtcattctagaattttccacattcacattaatgttaatgaatctagatatatatatatatatatatatatatatatatatatatatatatatatatgtctagattcattaacatcgatataaatgtggaaaatgctagaatgacttacattgtggaatgaaaggagtatgttcgatatgtattctgaatgcagagaaatattgttttgttcatgatttgtactgtgaagtataaaatggtatgaattatctgtaaacccttacataatacactactgtcaagatgttgtattttttttttctaaatcttccaggttatcaagcactactgcatcgtagcagcgccataggtaggaggtcgtatggctggggatcgtctcgaccttccgtttctccacatgtgcaacaagacgtcgatgaactatagcggcaaaaaagaaaatcagaggcagcagcgatcggcgaggcgtcgaggtactgtagcggcaacgtatccacggcaagaaaaaaagatcgatcaactgaactaggcccacatgcctacgtggccaacaatcatataatattaggatttttattttttatatatcactgaaattatatatcactgaaaatcggtctgttatcttatatgccacttaaaattggctcttcctctatatgcgattggcttaaatttgtgcaccctctcactctcgactgttgactgcgtgttgactgactagggtcaagtcacatgtctttttttttcttgcataaatgaccaaaataacctttggttcaaaatcatgtgactgcaaacattcatatattcaatagtatgataaatagtgaagatctagtggcataaagggaagagccaattttgagtggcatacaagggaaccaactaattttcagtggtatataagaaattctcaactttttattagcataataatttttgggacggttttagtccaagatttttgggaactaatttttaatcttctcttggagatgctggcactatg

SEQ ID NO: 52232 - DNA, 893 bp, Oryza sativa
cagtttcaccttcagaccggccaggcctcctcccctccttgatgctcctcccttctcttggtcgcctgctcccagaccggccgtggagtcttttggtggttgagtttttttcgtccgtgttggtggtctagtctgttggtagtaagggcgcttgggcctcgccgatgcttcacgtgccctgtggctatgtaaacctgtagttgtgccgagtgtggagcgatgtgcttaccccctacggtgttagagtttttgtgttaaagtggagttggagctgtcatcgggttcagccgatgagctaggcaacgataacactcaacactcttgctctagcttcttagaggtcctgtacttcttgagggagtcttgggcgacagccctgcctggtcttctaggatcggtgacatcgatgcctatgggtgtcgtttcctcattggaggtgttgccttgtggactctctccacttcgggtgaaaacccagtccagttttgggcgggcgttggcagcggcttctgtcattgttcacctccttggaggctacgccttgaaggccttgctcttctctggatcacttctgtgggtctagtcgttttgtcacaggttttttgtgtcttttgtgtaaggttttgccagtttccctttagcaaactgtgcagctgtacggttttcgggccctattttccttataaacagggtcaattctcttctaatatatccggtagatctcctaccgtcttatgtttcaaaaaaaatatatatgcaaatgcatatgtatatgtacaaaatacacatatatgtattagacacgtataatttaaagcacttaacattttatgtgtgtcagggttacggataaggtataccctctatccttggatatacgtcatgtactggta

SEQ ID NO: 52233 - DNA, 1223 bp, Oryza sativa
gtgcaccttgttggtatcgctgattttgagcgccactcatacctgtcattgcaaacacaaaaacaacagcaaacaataaaggttatccctaataatctgctacgcggtgtagtggtgcccctcaacaacttagccaaatggagcaccttaccaagctcttacaagtatcttaccagcaatgctaaggacggtacaatcggtggttggttcgtgacaccatgaaggacatgatgtggcgattgcaaggatcaaagcggtgctgaccagaagtatatatgtgtagcttggaaggcacaatatatagtagcaaaggaacgcaaatgtgctaatcagaaaatgcaaagttgaataatagttcaaagtactagtcaatgtgttggcctagtctagactcaactcttgctcaagcaagcacccgacaacactaaggactagatatgaatcaatgcacaactctgcactctgaaaacatactcaaaggatgaatggttttttttctttcttggtgcggcttttctttaagcacgtttctgcaattttttttcttttctttttaggtgcggctttttttttctttctttttctttgcacctttctgccttttctttcttttttatttttttactttttttttcaacaagaactgaaccactaacctcgaacaaggactcaaatgtaaatatgaatattacagggactcaaatgcaaagaacaaaactaatattggatcacctcaaaaaaggattgctcatatcatgtaggttcagtttttataaaaacatctcaaatccgatacaacaaatatatgatatagggaaaacactcgatactcggtccggaggtggagagatcggtacggaggagggggaggtggagagatcggtacggtggagggtgggaacggcctcggtcaagtggaagagagaggtggactgtgtagtggctggtcaaggtggagatggactcttctatgggccttgatgtgaaacgtacggtggcccaagaaaaaaaacaaaccgttcttttcttatgcaaacatatatatatgcataaccggccgggataattcagaattaatagaatttcttttcaaaaagaaaaggatcaaacgggtttaatataaagacctggtaggagggtgggatggaatgatcggtgcttacctttgatggacggtggattagagcgggagtacaaacacctgggtgtacagattcattttc

SEQ ID NO: 52234 - DNA, 164 bp, Oryza sativa
ctgcttgtgccgagacggtagaaagaggaagaaagagtagggaaggaaggagataacatggtggctgccagcgactggagcggtcggagtcgccgacgcgaccccccggcaggacccaatcccaccgactgacggagacagccggcgcagctgtaggcaggcca

SEQ ID NO: 52235 - DNA, 1501 bp, Oryza sativa
tgataaacagtgtgtttcgtgcgaaaattttctatatgaaagttgttctataatatcagattaatccatttttcaagtttataataattaaaactcaattaattatatgttattaccacctcgttttacgtgaaacacttaatttttatcttcgtctttatcttcgtaagattcaaacaccaccatactagttgaaatggagcactttttatatattagtaaacgggattgtacagtaggacgcaaatcgtctgtccattaaacaacaggcccgagaagaaggatgatggggccggacggccggtccggggaagtcgcccgtcacaatccgaaaagcgcaaggaggaaaacgtgagcaagcgaaaccgaacaaccaaccaagcaagccatgcacgcgcgcccgcacgctgacgcggcgccgtgtcgtgacgcgccccccggaattagcaccagccgcgcgcgggggcgccaccaccggatcagttcccccatccgcggggcccgggcccagatcacgcgccgtgacctgacctgacctggccccgcacgccacggccacggtgggcggatatgccgcgcgcacggccgcggcaccgcccggatatgccgttttcccctctgtcgcccgcgagcagatcacgcgggagcgcggcagccaacccgaaaaggcccgggaatatgcccacggcggtggtggctatcgataaacgaggatggagaaaaggcgggggtttggtttggactttctgccaccgaccgctgctttttagtacgcgatctcgaactcgagatcccttttgcaatctcgtcgaaaacggctctcggtttcacatacacccaactagtcgtcctaccttgttataatcactactaatcaatgaacacacagggagttaattagtagtagtagtaataaactaacaaactactaacacacaacttgatgattagtagccgttcttaatcaggcacgcgtatctcgtgtggccaggaggaggaagaagagcaaaaatcgcaaatccggaaactggagtagcagcatcagcagtagcagtactaaacttgtactgcaacacatggcaagcagccagggagagagaagaagaagatagagatagggacagagagagcctgtactgcactgcactgctgcctagcctatctatccatccccatcgccacatgcctctcctgcagctgcggcctgcggccaactcgtagtactcctataaggcaaggcctcgctaccccaaccgtcccctttcgcctccgcgtttcatctcctcgcctcgtctcgcctcgcctattggccgcccgctccccgcatcctcccatctcgccgcgttatcgccttccgcctcctcctccgccgccgcctacgcttctcgccgccgccgccgccgcctacgcttatcttgttgtgctggttgcatgcgccgcggcgcaggggctgacggagaggggtgcgcgtggaattgagaggagtggcggatggaggcgg

SEQ ID NO: 52236 - DNA, 1501 bp, Oryza sativa; identical to SEQ ID NO: 26422

SEQ ID NO: 52237 - DNA, 1501 bp, Oryza sativa
tttgagcctaattacgccatgatttgataatgtgatgttacagtaaacattttttaataacagattaattagacttaataaattcgtctcgcgatttactgacggattctgtaattagttttgttattagtctacgtttaatacttcaaatgtgtgtatgtatatgataattttttttccaaaacaactaaacacggccaaaacattaatttgttttgttttgccaaaaaaaatttagaaagaatctgcagttcgaattctcttgtgacgattgaccaacagtgtacgtacacgcgatgggcagacgtggttgcgtccattgatcatcctgcaccgaagtcaacttatcagaaacctctttaataaaaaagaaaaaatatgtaaattttgtataacaaatggtttcttccgcgagacagttcacaattggcttgcttaattgatgagaaaataagcgcatgaaagaatcaagaatggaactttcttttgtcctcttttcttcttctttagtcttttattaccagagaagaaacttctttagtcctttgttacaagaggagaaggttctgttgagtttggaatttctcaatccgtttgacgatcatttttgtttcgtaggcatggttctagaattggaacagtcaccgtcgaccttgacaacaacatcgaagaaaataaaataattttacagcaaaacagaagcaggtagtacatactccctccgtccaaaaaaaaaaagacaaactctggtttccgtgcccaacgtttgaccgtctgttttatttaaaaaaattataaaaaaaattaaaaagacaagtcacgtataaaatattaattatattttatcatctaacaataataaaaatacgaattataaaaaaaaattatataagacggacagtcaaaattggacacggaaacttagggtttgacttttttttgggacggagggagttctttacatggtaggttaggccaggtcaatacccgtggcatgtttattgaagccaaaactaaaggagtatttgattttctcgttgtgatagtggatttaatctaaactagcaaatcgcatgcatagcttatactacaacattaaagcaagctaagctgggtgaattcctaaagctaaagaaaaagccaaaggtgccttggacagtttgaccacggtcagttgcggctccctccatccgccatcagccgcgcaaagtagtaatgggctatacttttcccctcttaagtggatgggctttttagagaggaataagctcattttagatcccttaatttatcgtcaagtctaaaatttacccctaaccgcaatatcagacatgatgtgtcccttaagaaaaaaaaacattcaacattaccctcgcaataccgactaaattaagctagctcacaataaaaaaaaatccaaccagatctgcaagctaattggagtagccaagaaaatataacccccgccaaggactcgagtactgttgcatcgacattaagg

SEQ ID NO: 52238 - DNA, 1501 bp, Oryza sativa
gctgcgccggtggcggcggcggcggcgtcgtcgtccccccacctccagctccctttcgcggcaccaccgcgtcgtccccggccgccggcgccatggcacaccgtacaacaacaacaactgtagctagctagctagctggctagctgcagggggtctaagctggctagctccgtgatggcgcgctagctctaggttggtctgggtgtgattaggtggacagggaggggtggccgtgacgccgcgtgcatataagaagaagaggagggagatcgatggtggaggagggtttcgtgcgggggagggaagaggaattgaatggcgtctcatgtgtgtgtgagggagaggaggaggatcatgcgctggggctcggatcggctgcatgcatgggattaatgggaggtaaaaaagcgacgtctcggattgccgcctgtgattgccatcaaagtgctcagctcagcaccacacctcacctctcatctcgtctcatctcagcgtctcagcccagccagcctaccagctagcccgggtaataatcacctgtgattaatcaatgttgctgcatgccttctccctagcgtagctagctctcgattgattaatcgatcgatcgatgggcccctgttcactgtgcaccctagtacaagctgtctgccgccgcctgccggcgtgtcagagtattgtctgcggcgacgaacagtacggaggcggtagccgtcctggatgttttacactttcgtccttttcaaaaacttgtttaacaaataaacccctaaaaaaacttacaccgtactagaaatggttctttttggacgtcatagtcattggcgccgtggtccaataggacggtgacatcatctcttgcaccgtccccctgccatcgtggctggccggcgctgacgtggcaggggaagcgcgccaatgataattttcttttattttattttatactttttcacatttaggagcacacaagaaccaaacatagaaaaattaaactcaaacgaatgaaatgtgacctgtagaatttttcaaagctctatcaaaaaacttctcgccttgaaaacacaatcttgcaagcagaatttcgagattctaatttcaccaaacccgggcgaaatgggggagaatcagatgtaactttttatgtagatatttgtaaatatataatttgcctttttctgtatttgttttaagaaaggtcactcgaatgtaacaaaaaaactcaacaaacactaacaaagcaatgctagtaaaaaaatgctaaagggtttataggattaaggaaatgtaatctaatattgttttggtaactttctgactataggaaaaataaaaacactgaaaacagaaagtctcttaccgataaatcttgcgtggatttgagaagagggagagagagagagcaagagcagcggcgctcgggctcgcgtagggagggcgcgggggatgggtgtgaccctcggggggagcgcaccaaggaaaaaaaagatagcattgtggg

SEQ ID NO: 52239 - DNA, 1501 bp, Oryza sativa
gtaaaacgacgtcttggctgggatgggttttgcagtaaaattaaataggggattagtatttacaacaaaatgacctatgaggtataataccaaatttcaagtgatttatggggtggtttttaaaatttcccttagaaaaatgaactggccttttgaaatcgagaggaaaaaaaaaggcttgaactaacgtttggtcgcgggtaaaggtggcgaacgtcggtccgcgcgtatccctgccattcgcacgccggatttgcccgccgttgcgcgtccctgtcagaaccacgaagcggcccatcctacatcccgcatgcccatcgcttcgaccgctcaaagagccaagaggcaatgctgcagcggcacgctgccagcgcgaacgagcgagctaggaaaagatgctgatcgaaggcttcgaagctactagttcatgtacacggcaatcacaggacacgcatgcccttcttgcaacgcgatagcctctcccaaattctcttcaaaactagtactgtagtatttctcatttcatcgtgttcctaggagtgtctgaatgctcgacctgtcgatatgtcatatagctgccattgccgcctatacttgccagttactccctccgtcccaaaaaaaaaaaaaagacaaatcccgagtttccgtatacaacgtttgaccatacatcttatttgaaaaaaaatattaaaaaaattaaaaagacaagtcacgcataaagtattaatcatgttttatcatctaacaacaataaaaatattagttataaaaaaaattcatataagacagacagtcaaccgttggacacgaaaacccaaggtttgtctttttttttttgaacggaggggtaccactcctaggatattgcaaagaagtactccctccgtcccaaaaaaaacaaatctagtaccggatgtgacatattctagtataatgaatctggatagagatatgtccagattcgtagtcctaggatgtgtcacatccggtacgaggttgattttttatgggacggagggagtaatcgacacagaagcagcagtaggttattttaccagctggatgtttgaggaacactgcatgttctcattgctgcaccctcaggattctcagttatagctatgcctgaagatgttcgatcaccttctttctagccaacagaaaattcactgtatgaagatctaaaaagttctaaatgagatggtagacgacccagtattttgaatcaagtaattccatacttccgctcaagcaagtagctgttttaccagtaaaatccactaagacgaaccagataaacaatacctaactcagcttggcacaacagcggggttcagggaattttgataagtagagacgttctgcaaaataagaagagaaaaaaaaagagtttcagttaagctgctgaagatgcacaaaaatttactgcccatactaatatactattccatccagaaactaacactagatcaatttcttaattttattttttgaactt

SEQ ID NO: 52240 - DNA, 746 bp, Oryza sativa
gatcccggaagaacatgccgacgtcctcactccagctgcttatcttgaacaatatcaattcaaactggagaaggccaagctgagattagccgaacgtcgggagcgcagggatattgaagccacaatccaggccaatcggcaactcgtgcatgaagagaagtccaagcttgatcagctatctgagggcccgatcaagtctaatattgatcagcttgaagctcgtaagattgagctcttggcacaactccaagaatgcaatgctgatatgaccaagtccctaaaagtcatctctggaaccgatgctcaagatacccaagctattgaagaagtagaacacattaggcaaagagctatatcggcgatctagcgctacttgtctcagtgatattctataataggatgtagtaaatttttgtaatcggctaagatactctggcacttgtagttaacttgtcttgatttatgccgattaatataactccatgtttttgctcaagaatttgctcaaaaattttgcaacttttgcatatatatgtgcccccctaattttacaatgtcgaaggcattgatgaaattatatcttgaactaagggcaatataacaatatcggccatttgtacatcggcaaaccacaaccgattacaataggaaaataactaagggcgatataaccatatcggccatcccaaggcaatgcaaacacatcggctattatgtatcagtagtaccagccgatcatgcattaa

SEQ ID NO: 52241 - DNA, 1501 bp, Oryza sativa
gaaggacataaacaagtaaatccactcaaatacatcaacaatttaaactgaattaagatgcaattgacatagcagaagagcagagcatggatagtagcttttttgtttcaatcaaatcgtcgcacaaacgcaagtaggagggaataaagcaagtaaggataagcattaagcaaagcaacgaaacctattagcaataccacattgcgtatatcctgcccctgagttggccgcaccaatatcctaaccctcttcgacccatccggcgcgccggcgagctgctccgtgtcctccacttgcacgacggcgtcagcaccatccggaatcggccctgcccgagaaaccacggtcagtaaccgatcaccgccgcatcatcggaaggaacagagcgagccacctcacctccggtcgtgacatacgccaccgtgccgggggtgacgaccacgccgagggcgtcgtcgccggccctcgactccgtaatcaccgggtactccccgggcccgtcggaggccacgacggcgtacccatcctgcagagggtttcaacccaagcaccctcaggcgcggcggcaaggagggggagcagaagagagggggaggaaggtgttgaccttgatggaggcgcggaagggagggagggggtcgggcgcgcggacgtcctccgcgaggacgagcccgagcgcgtcgtgcagcggcacggcctcggcggcgcgcgccgccgcgctcgccgccgccgcggacagcacggccgccagcgcctcctccacctgcaacattttttttccttttttgctgttcttcttctactcctattttggtcggtttatctcgggcggcggcgtccggcggctgaggctgcccatctccattgacgagagagtatcgactacctactcactttgagcccttgatttaaaacccaacgcacaggatacgtttgggagcatggaagtatgctcctgtaccgtagcactcgatatattcctcctgactccgtcccataaaaaaaaccgtagtactagtgtgtcacctcctatcctatactcgttttttatgtgacatattaagtactacctccatcccaaaatgtttgacgtcgttgacttttttaaaaatatttgatcgttcgtcttatttaaaaaatttaaataattgttaattcttttcctctcatttgatttattgttaaatatacttttatgtatacatatagttttacacattttacaaaagtttttgaataagacgaacggtcaaacatatttaaaaaagtcaacggcgtcaatcatttagggaaggagggagtattactcaacttcacgagttgcgaatcgaatcctatttaaatggcagcctgccacaagtcgtgcgacggatgcttttcggtggatggtggtgccgcaatcaaaataagtcgaaagtccaaatcacgtttcatttagaaaaactgtaaaacctaaccgaaaagttactttgttgcaaatgatcatctcctaactagttta

SEQ ID NO: 52242 - DNA, 1501 bp, Oryza sativa
cgttcgatctcaagtggacggtccagatgaagctcactggatcgagttgggctttttggcccatgaccaccaacccaaccctggttcgccttcggcttcgggtcggttcggtcgctcgtctccgtctccgtctccgccaccgccaccgccgccgccgctcgccggaggctctcgcgcccttcctcgaggttggcatccccatctgtgcttcgtccaaacaactgttcatgtttttcccattccgggtatagattctcacctctaactctggttcattctgcaccctaaatttccccaatttgcatctcgattggttgaatcaatgcccagatctctcgccggtttgttgaaatttagttcgtattattgccgcgatatctttaacacgatagccatctcaatcaggccggtaggcgcttgcttggcggggccagaaatttttctgagcctgggcaagtctaccgatgaacacaacttaacaagtgcttgcaaagaccactcacacaagattcgccatggtccctttcatatcaacttctcagtatgaaatttgagcaaagtgttagcacaggtgaaaaatccagttcagtttgtccaagtattttgctcctgctggtatgcctttgcatctgcctgctaattaagtagccaagcgcccaaataagatagtctaagcatagagtcatgtaccatgtgcctgttgtgtacttgtgttgctgcacgccctgctactctgctagacacctgctgcccgcgccattgcgccaacgtttgctgctcaaccgtcggacgcacgcagagcagtgcaatgcattcactgctgcaagcgaatgagccatttaccctgggcagctgcccagggtggtcgggcgcgaaatccgctccgcttcttccccctgttccactccctctgcttccttcttccttggcatcatctctatggtcctttcatctatgggattgatgtcctgtgggtaggcgtgggggttgtgaagtgtgggtaatggtctcgtgggcgtgttcaacattgaattggtgcgactgtactagtcgacttgtctgggttttatatcgtggtaagtgatcacgtggtaatcagtcaaatcggtgcgagttgtccttgcatttgttttggtttgcaatttgcatctgtaaattggtagtaatgggagtaactgattagttttgctttttgatgattcagtgagtcaaattataatctcttaaatgtaatgtttgtattatgttgcaagaactgcaactgcaatacctacccagaagatttgaccacagattcttaaaacaaagtataaatctgaatgaaaggggactggttttctagcgtgaagatgatttggtttccattttacatgtaaacaatagtttcaaattagattcagtttattgagcttaaggaaacataggccacatcaaaagttgtgattctcagattctgtgatgtgacagcttggaagttgagttggttccgtacctggcatgg

SEQ ID NO: 52243 - DNA, 1501 bp, Oryza sativa
aggtttaattctgaatggaggtggactatctcccactctccttcacggcctaactagggaaccagccgatgcaggcaagaaaaggaaaactagatcatcagccatgagtaacttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacaccatcggcttcacccaagcaaacgcctccaactccttctgcccccgttcattttacatgagtaagtacctctctttgacttcttctgaaattacctccctctttggctaattacccatagactttgtggttgcagaagaagaaaactgctgtgaagaaaaaaccagcagcaacaattgttaaatcggctccaccagtaagatgtccttaattcttttacttaaacaatctcaaccgattctatataacacttgtctatttcgcagcttcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcagctataatttacccagctcttattctttccaaaattgcctctgcaggctctagctgatctcttctcttttgacatcagagattaccttgatgaggcagaagaagacacttcaagcaaagcccaagctcccctatccgatgatgtgagaaaaacacttgaagacatcgctcatcggctagaagcctcttctttagacagtttggtagttgactgtgggtcaattaggacgcggctgcatgaagttcaagctctgattcccgaagatctggctgatgtcctaactccagccgcttatctcgagcaacatcagttcaagctggaaaaagccaagctaagactagccgaacgccgtgagcacaaagagattgaggccacaatccaagctaatcggcagcttgtgcatgaaaaaaaaaccaaacttgattagctatctgaaggtccaatcaaatccaatattgatcggctcgaagctcgcaagattgagctcttggcgcaacttgaagaatgcaatgccgagctagatatggaacacaaaaagctagccgatcttccaaaatcaattgaagaacaaaaagcaaggctcaaatcggctatcaaaaatgttgctgacctaaccaagtccctgaaagtcatctctggaactgatgctcaagatgcccatgctattgtagaagtagaacaaattaggcaaagggctattttggctatcctatgatacttgtctcaataacttttgtgtaataggacttagaaattttttgtaatcagctaagatgctctagtactttactgtcttgacaatcc

SEQ ID NO: 52244 - DNA, 501 bp, Oryza sativa
ccagctcctcctcctcgttcccggccgcggcggcggcggcggcggcggcggaggaagcggaaggtttgctcgggccgcctccgcctccgccgcctcggcggcggaacggccacgagaaagaggagaaggccataggggggacgagctgcgtttgcgcctcgcgatggtgaattcggcgatgggttggagaggatggccgcgaccgcgacgattcgattcgctacggcttacgaattcgccgagtcgtaatcagcagacgcacacaccacgcaaaccgttctggaatctggaggatgatttcgacgaattttgtcttgtgccttgtgccgatggagtttggaacgggtttattattattattattattattattattattattattattattattattattattattattattattattattattattattattattattattattattattattattattattattattattattattattattattattattattattat

SEQ ID NO: 52245 - DNA, 1501 bp, Oryza sativa
caatttgggatcaagccaaaagacactggaaacttgtatcggcatcgatatcctgagtggtttgagagggttccattgcctagccggttcaaggttccggatttttcaaaattctcagggcaagacagtgtctcaacctatgaacatgctagccgattcttagctcagtgtggtaaagcatcgactgtcgacgccttgagggttaggttgtctccctagtctttgtctggatcggcttttacttggttttcttctttgccatatggatcaatcaacagttgaccgatttggagaagaattttcatagctatttttatagtggggttcatgagatgaaattgtctgatttaacagcgattaggcaaaggcatgatgagcctgtgcaagactacattcagaggtttagagagatgaggaataagtgctacaacttaagcttgactgatgttagcagatttggctttttagggtatgatagctccaatcagggagaaattctcatcccaggactttgatagtttgtcacatcttgcacaaaaggttacctacatatatggatctgatgatgatgatgatgattccgaggtagcagcagccaagtgggttaggagcaagaaggttataccatgccaatgggtgaagagttctggaaaagaagagaggtatgactttgacatcaccaaggctgataagatctttgatttgttacttcgggaaaaacatattcaacttcctgctggtcatacaattccatcggctgaggagctaggcaagaggagatattgcaagtggcataattctggatctcattctaccaatgattgtaaagtctttagacagcagatccaggcggctattgagggaggcaaaatcaagtttgatgattccaataagccgatgaaggttgatggcaatccttttcctgtcaatatggtacatacagctggtcgaacagccgatggaggaaaagctcgaggttttcaaatgaactcggctatgattatcaataagtatcagaggaaatatgattagcatcaggaaaagtattatgaggaagatgatagcggtcttgatcctcattggggttgtgagttctttagattctgttggaatgaaggtatgaggctgccatccaatgaggattgtcctaggtacagcaatattgcaggaagttcaagccgatcatataataaaggcaattggctaaggcaagcaagggttcctgttcatcaaaggttgggcccagtaaatcaagatcgtgaccaagaggacaatgaaggtaggaagacttaatggtgtccttctggtatttttacaaagaatcagaagagaagggttcaaaggttgaggaacagggaagaggttgagcaagaaatcaaccatcggctgaagaaaacgaagccgcagcaggagtggcgcgttaagaatcaagttcctacagccgatgaagccacagccgatgaagcaaaaagattggctaaagggaatagtgttgtaactg

SEQ ID NO: 52246 - DNA, 201 bp, Oryza sativa
attgctgcttacgccgagtaacacagcaaactcgagtccaagtgcaggtgcattcatttactcatctaccaaagagaagatcaagcgagaaagaagcaacacttggttcctggtcggtgcggcattccgtcgagcagatagcgagctttagttgcttaccagataacaacagctgctgcggccgtggggatcccctgcagc

SEQ ID NO: 52247 - DNA, 364 bp, Oryza sativa
acatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgagtagccgggcacagcgttggcaagagtataaaggcactgaggaagggatttgtttccttcctttcgccattattccccttgtcttcgccgcttgcgccctaactccttctttcctgtgccctaccttcgccacacgcgctcgctcttaatcttctcttcctccggcgcca

SEQ ID NO: 52248 - DNA, 1501 bp, Oryza sativa
atgaaatgagaaatactacagtactagttttgaagagaatttgggagaggctatcgcgttgcaagaagggcatgcgtgtcctgtgattgccgtgtacatgaactagtagcttcgaagccttcgatcagcatcttttcctagctcgctcgttcgcgctggcagcgtgccgctgcagcattgcctcttggctctttgagcggtcgaagcgatgggcatgcgggatgtaggatgggccgcttcgtggttctgacagggacgcgcaacggcgggcaaatccggcgtgcgaatggcagggatacgcgcggaccgacgttcgccacctttacccgcgaccaaacgttagttcaagcctttttttttcctctcgatttcaaaaggccagttcatttttctaagggaaattttaaaaaccaccccataaatcacttgaaatttggtattatacctcataggtcattttgttgtaaatactaatcccctatttaattttactgcaaaacccatcccagccaagacgtcgttttacggaatcaacatgtttcataaattatgagctattgatgtggtctttaccaaaattaagtatttctagagtatagtctggacacctttttttttttggaaaaatccacggatagaaatggtcgtactgagtttcgctatatccgtaaaaaagagttcaacacaaacactagtttagcatatggtagctctacatcaatgataacagactgatttcgttaagcatgtgtatactgagcttttttacaataaactagttaggagatgatcatttgcaacaaagtaacttttcggttaggttttacagtttttctaaatgaaacgtgatttggactttcgacttattttgattgcggcaccaccatccaccgaaaagcatccgtcgcacgacttgtggcaggctgccatttaaataggattcgattcgcaactcgtgaagttgagtaatactccctccttccctaaatgattgacgccgttgacttttttaaatatgtttgaccgttcgtcttattcaaaaacttttgtaaaatgtgtaaaactatatgtatacataaaagtatatttaacaataaatcaaatgagaggaaaagaattaacaattatttaaattttttaaataagacgaacgatcaaatatttttaaaaaagtcaacgacgtcaaacattttgggatggaggtagtacttaatatgtcacataaaaaacgagtataggataggaggtgacacactagtactacggttttttttatgggacggagtcaggaggaatatatcgagtgctacggtacaggagcatacttccatgctcccaaacgtatcctgtgcgttgggttttaaatcaagggctcaaagtgagtaggtagtcgatactctctcgtcaatggagatgggcagcctcagccgccggacgccgccgcccgagataaaccgaccaaaataggagtagaagaagaacagcaaaaaaggaaaaaaaa

SEQ ID NO: 52249 - DNA, 1501 bp, Oryza sativa
ttcattctttaagttagcaaattgcacaatccttatttttacagtgagatgagcatcaacttactttttataatggatatgcaggtggtactggtttcacacctagagatgtcacaccagaggcaacaaaatctgtcatagagaaagaagcacctggcctcacatatgtcatgcttcaggaaagtttgaaggtgatgactgacatttttctatatccccttgttctttggtttaacatggaaatccattatcatcaactttttctagagataagagataacaactaaccatgcatatgacactagggctaaactttagtggcatttcatttcaatagattttagtaccctaactttcctttaatctgagctattgaacttatctgtggtacaggtgacaccattcgcaatgctatctagagccactgcggggatcagaggatcaacacttgtacacaccatagctcaaacttggcaatttctcacctcactctgaaacgttcacatgtttatcaaacctgttgatatatcttttcagatcatcaacatgcccgggaacccgaacgccgttgcggagtgcatggaggcgcttcttccagcactgaaacacgccctgaagcagataaagggtgataagagggagaagcacccgcgccatgtccctcacgctgaagctgcgcctgtggaccagtgggatcggagtttccgagccgcgtcgtccggcaggggatgctcgtgcgagccatgatcggggccgatgagaatttggtcctcgcgggctatcggcgttcacttcgtcagcttgtcagttccttcgttagcccagccgcgttcagctcggagctaagcagtgacgattttggttctgctcactgttttgttttcacttcacccgaaccttacgaacaccagtgtgacaaataaagtggttacagtatatttgatcttgtaacttcggcccgtttagttaccaaaaactttttgcaaaagcattacattgaatttttgaacacaagcattaaatatagataaaaagaaaaattaattgcagataaaaagaaaaattaattgcacagttagcatataaatcgcgagacgaatcttttgagtctaattagtccatgactagctataagtgctatagtaacccaaatgtgttaatgatagcttaattaggcttaaaagattcgtctcgcggtttcaaggtgagttatgaaattagttttttcattcgtgtctgaaaacctttacgatatcaggtcaaacgtccgatataacatattttcatttcaccaactaaacaggcccttcaaacttttgtatacacggcacctgattttacagcgtcatagggtgggttctattgtggcgagttacttaaatttttttagtacagttcagctgcctaccacgctcgaatcataatgaagaacaacaatggagtagcggtaagcaagatggataggcgagccaaatagaataatacgaacaatctgcgtttc

SEQ ID NO: 52250 - DNA, 244 bp, Oryza sativa
agcatgttctttgttgtttggtaaactatgggtatatgataataatggtttgcataattttgttgctaatacatacacatttagacataatggtcgaaaaatgaaattggaaccataagcttttctgaaattttcaaagatgatcttgaaaggttgaagaatagaatcaatgagactttcagagataccaggaaagatactattgtgatgccttcaactaagtctgagttattacaaaacgaac

SEQ ID NO: 52251 - DNA, 512 bp, Oryza sativa
ttacttctgttttgcttgccgctatggctgaaccagagctgatatgatcatttctagtaaaaaaaaattttcccaggagatcacattgaactggattgcgagaataactgagataaagcaccatttgtttgatatgctcatcattactaatgcattgcaattccttttgtttgatgaactataaaaagatcatggacacacaaaaaaaatcaggatatgataggaattcacgaacctcaggttgaaacctttcacttttctgtctttttttcttctgggctcaacccagaatctacatatgagaaatggcgagaattgcctgcactatttgcgatcttcccaaagccagcacttccagttctctcgctatcggtttctgaatgatctgcttcatggcgattagccttacgagaatccacctcctgatcaccatgaacaggatgcacaaatattccgaaataatcatcggtgacagttctctctctcactgctactcttgcttccatcacagc

SEQ ID NO: 52252 - DNA, 595 bp, Oryza sativa
cagcagacagccattttcccacgtcgcgcctgcctccggcggaagtggaggtaggtatgggccgtcccgtcagaaggtcattcggacgacggcgatgcaaatctccgtccgttaatgaagagaagtcaaattggagggaagagaggatgagtccccaggcaaaagaaagagagggagagatggtgcatgtggtatccccttgagatataaaaggaggaccttgcccacttagagagggggatgaaagagggagaaaaacgatcctagaacgatcgggggctggcattttgtagcttcttcatacactgatccaccaaaaacacaggagtagggtattacgctactcagcggcccgaacctgtatacatcgcccgtgtctcgtgtatttccgctcccgcgaaccttccacactcagacaaggagcttagagtctcacccagggcccccggccgaaccggcaaaggggggcctgcgcggtctcccggtgaggagccccacgctccgtcatctggcgcgccaggtagggggctctgcgagtgatcttctgagctctcgcactctttcgtgtgcgccaagcttttcctgttcagcccaa

SEQ ID NO: 52253 - DNA, 1501 bp, Oryza sativa
aatatttatttatatatatctacatatgtacaatcatgatattttagattatgttcatcttgctagcttgtatatatttttaaaaatttaagcaattttacagtttttgaggagataccatgaggtaccactttttctattgtaaatttagtacctcttagtacttatgtactatgaggtatcaaattttacactaaatttttttttaacatggtacctcctcaaaaaccgtaaaattgctcaaaaaattttgtcactgctaaggagaaacgttgctcacttaatcggactactatgacatgtgaacacaggtcgcggtcgtggcagacctcgtacaacaaggacgatgaccctaaattcaggtaatgtgcttttgataacagaattttgcattgttgttttttcttaaaatatatttactactcattgttagctctggatagtgaatcagaatgatatattttcattttattccatgaaacttgcgtaacataaaatgtggcccaaagtgaaatttcactcttaaacaaaaacaagatgaaacttttttttaaccagctgcaagtggtcgaacgattacgtgggtccgccggcggatctcacatcactaggatggtttgtatttcctgtgttgagcaatgtctaaaatcgtttaagcctgtgtttggtccacctctgagttgttgcactggcaactaattctgaaaagaccagtgttctacctttgtggcatgtgtgcttctttaattattgatgttttgcgataaagaatcttcttttggccagcaacgatttattatatctatatatattgttatataattgattgctgcactgtttcaattcaaaatattgcaggcctatatagtttgtttcagaaaagatttatattcttgttcaccaattaaatatgtctgtttcttttttacacaggttctggtatgtctgcctctggagggaaaggtccagaatcccccttacaacttccgcatagttttgtgtagtcaatgcgtgtggagattgtggatatcccatatctacacggcagttatagtttagttgggtacagggtaccaaatatagatagaatacctttatgaggattcggttagtttctaaactcgtatatcaaggaaatacccaggatcctagtcggttacgattgtattttatctgtaatcacatattccgttagggatatgtgttgtattttgtaatacggactccttcccctatataaggaggggtccgggtccctctagggacacgatttttctcgcagatcatacaatcaataatacactcggcggaatcatcctcggacaggagtagggtattacttcttgaataagaaggcctgaacctgtataaaattccttgtcttcaaacccatccacttttttagcttgatagccacccccttttagtattgccgaaatcttgtttcgacagttggcgcgccaggtaggggtagcgtcaagtttcttgccgatcagtacga

SEQ ID NO: 52254 - DNA, 1501 bp, Oryza sativa
ttccatccatccgagctatctctctctttcttctctctcctccatgaccggccaccaccattgccaccggccgatctcctcttccacagccctacatcccaaaaccttgcgccattagctcggcctcgatgtggtgaatccattttgcccctttcccccttctctccccctttgaatcaagccatcaccaccaccatccatgtcggccggaggtaagcacttgccgccgccgttccggcctcttccctcactccctttgccagccgactgcctccttgggtgagcatcgctcgggaacatgtttccccgccaacgtctccgtcccccgccatctagagcaccggcgcccctcgtctccctctcctctgtgttcggctggaagaagaagcagaaggagagaggatacgggaggaagaagaaggagaaaaagaaaaagaaaagatactgacaggtgggcccctgcacagtactatttcgcattttctttatttaactcaaaacccaaactttagaaacccatatctcctaaaccgtaggtccgattccagtgaaacttggacctaaatttatctaaattcaaaccctaccttttgataccaaatttgctattttaagattttatttgaatttctttaatttattcaaatatcatttgaataaatatttgatttaaacttataattgaaacttatattcacctttcaaatatttacttttattttcaaaataccgtttagccactaaacaaccattggttggaactttacaccttccatggggacgttcgcacggttttctgaccccgacgtcgaaccattggttgtaaagtccgacaaaacccaaacctaaggtcgaagtgttgcttctgacaccttacgcctcaatgcgtataacgagcagagcttcactatttccctcgacctccatagcacgccgcacagttagcttttaagctctgtgtgatcctagccgctccgccgccactcacggttgtccgagtaacacttccaccccgctaaacctacacaaacttcctatccttctagccgttatattgtctgttgacatcggctagacaccaaacctagtcgtcatactacccaattctaatgacgactagcaaacacgcaaatcccagccgatagtcatcctacctcgatattggcttaatcaaatgaaacccaagccagcctgccatccaaactccatatcagccatttaccctccaactacccatagtttaaacatgaaatgcgagccgatatgctatgctatttcagcatcgactcgagaacaactaaaccctagccactattccaccaaagcctaatcttgatcccctctccaacctaatctccaacccattagagcctacgcataaaatactatctcaataacccattaaggagatagttataccccaaacccagcctttctcgcttttcatcgttttcttgctattttatggcttttattgaatttggttcttcctcttcttaaa

SEQ ID NO: 52255 - DNA, 1501 bp, Oryza sativa
agggagcacatcaatatcttttctaaagatgcatcttcgagtagtcgcattgtcgaaataagatttcggcaatactaaaagggggtggctatcaagttagaaaagtggatgggtttgaagacaaggaattttatataggttcaggccttcttattcaagaagtaataccctactcctctccagggatgattccgccgagtgtattattgattgtatgatatgggagaaaaatcgtgtccctagagggacccggaccgcaccttatataggggaaggagtccgtattacaaaatacaacacatatccctaacggaatatgtgattacaaataaaatacaatcgtaaccgactaggatcccgggtatttccttgatatacaagtttagaaactaacccgaatcctcataaaggtattctatctatatttggtaccctgtacccaactaaactatagctgccgtgtagatatgggatatccacaatctccacagtagcccctgagacctttgcagtcgacgaagtagcaataatccgagtgcttcaattcctcctgctctgtcctgccgagcactaaaatcaaagactgtgaagggcgaaaataaaatatggtgcagcgggtagatgcacctaattaggtgtagcccccgactatgtggttagttaaaaaactaaacatgtagtcaagaaccgagtggttttacaaccaaacatcatatagcaaagcacgcatggtatttagtaaaatacccagccgactgctcctcagctttaatatatcaagaataaaaatatgaaaaggcccgagtgataaacactcaaaaggtccacaaaaagacatatttggcaagaatctgagtaagaaactcttaaaatgatccaccaaatatgataaaaatcatggtaattaagaaatttaatagcctaggctacaacccttaccataatcaaaataagcatataacatgctaagagaatgactcttaataaactagtcatctcgaatcaacccaaacagcttttgcaggctaataaagcttacaaaaatagtataacacctttctgtcgggcacctttttatttgcatcgtggtaattccaaagaattatctaactgcgttaaaaaggattttaacagcatcgggtcacatcattgtgagtacaaattgccaaagcaaaaagcgcctaagtccctagggatcacaacgggccacgctgctaataatattgggctgaagtactgtacaggtccaagcccattagcactcccgataccctaacaaaacaccaaagtccaagcaacgctttgtcttcctcgccaaaactctcgccatttccccactccttgctacagtgcaaagccacgccgacgaagctagggttcatcaatccgccccaatccattctcaaaaatccacgaatcttctccacgcgtccaccgcaccgattccccattccccttcagctatttctcagaccgaatcagatcattcgactcgcatcca

SEQ ID NO: 52256 - DNA, 1501 bp, Oryza sativa
ccaaacaaaagcttaatatacttaaatgcaataagatcctgacataaatggcagatttaacatgtcattgaagcatatagattgaatatggttaaatcagataatatcggctgaaactccgatgctaccctaatcggcaaccagaggacaggctagagattgatattctaagcacgacttaatagatcaaactcaactgatgcagcattaagtatgaaaagaagaacaatatctagacaatcaagccgctgggtgtttcataaagtggtagatatcttatataatctaggacaacgtcgctatttaacctaatcggctgccttctattaacagatattagccgattgtaggttagatgacgatattgccaaagattatgtaggatatatgataacttgacgaattatatagacaagattagagtgtcataaagatggaagcactaatctcgagaacgcaagtcgtcataacaagttttacctcttgttgaagatcgaaaccaatgcagctcaacccgaaagcaagaactcgtcgaaacaaaactaaagcaaaaaagtggcgatgcgccgaaattgtattgaacgtgtgtgttaccaattacatagggctcgaggtctatttatacccgagaattacaagatatgtccataccggacacgaccactatctctaacaagctctaagataccataagtctttgcggcagacttttgcccaaacatatctctaagaaagttacataaaacatcgtaattaatagatacaattgccttctcaggactctatcaatgtgcggcaatcatcttgaagcacctcgattcaacccaatgtcatacaccaaattatactatcagaatcggctgaatcggctcacctagtccgactcagacccagccgatcctaatcgtagccgatctggacttcagccgattcttgctctgttctaggatcaatctccgccttcaactccaccttgatctaatctccttttccgatgctgatattaccaaatttggtcgttaacaaatacacaaatgttgcaatgcgatggtacacaaaattgccgcaaataatttcaatatattatatgctattctatatatttactgcaatgatatcaattaaaagtaataaaagcatcataaataatcaataatcatatatgcgataaataaatttcataatcataaacatcagcaataaaagataccttaaatacaaagtcaaggtcgaaatgcaatgtccgatggaccctttttatgcgtgaatatgattttagtgatatttgcaaatttcaaatgcttttcaaacaaatatcccaaatgcagaggttatttgtgtgttttcttaaaacattaggatttaaaaggtaaatttcctttgcagaggaatatgcacttaatttccaaaaaatgcaagggtccatttgcaaaatcacatgagcatcggtcctttccacttctctttccctttcttcttctttccttcttttcctttccac

SEQ ID NO: 52257 - DNA, 1501 bp, Oryza sativa
gactcactgaatcatcaaaaagcaaaactaatcagttactcccattactaccaatttacagatgcaaattgcaaaccaaaacaaatgcaaggacaactcgcaccgatttgactgattaccacgtgatcacttaccacgatataaaacccagacaagtcgactagtacagtcgcaccaattcaatgttgaacacgcccacgagaccattacccacacttcacaacccccacgcctacccacaggacatcaatcccatagatgaaaggaccatagagatgatgccaaggaagaaggaagcagagggagtggaacagggggaagaagcggagcggatttcgcgcccgaccaccctgggcagctgcccagggtaaatggctcattcgcttgcagcagtgaatgcattgcactgctctgcgtgcgtccgacggttgagcagcaaacgttggcgcaatggcgcgggcagcaggtgtctagcagagtagcagggcgtgcagcaacacaagtacacaacaggcacatggtacatgactctatgcttagactatcttatttgggcgcttggctacttaattagcaggcagatgcaaaggcataccagcaggagcaaaatacttggacaaactgaactggatttttcacctgtgctaacactttgctcaaatttcatactgagaagttgatatgaaagggaccatggcgaatcttgtgtgagtggtctttgcaagcacttgttaagttgtgttcatcggtagacttgcccaggctcagaaaaatttctggccccgccaagcaagcgcctaccggcctgattgagatggctatcgtgttaaagatatcgcggcaataatacgaactaaatttcaacaaaccggcgagagatctgggcattgattcaaccaatcgagatgcaaattggggaaatttagggtgcagaatgaaccagagttagaggtgagaatctatacccggaatgggaaaaacatgaacagttgtttggacgaagcacagatggggatgccaacctcgaggaagggcgcgagagcctccggcgagcggcggcggcggtggcggtggcggagacggagacggagacgagcgaccgaaccgacccgaagccgaaggcgaaccagggttgggttggtggtcatgggccaaaaagcccaactcgatccagtgagcttcatctggaccgtccacttgagatcgaacggtttacgaggcttcaatccgagttcttttccgtttccgtccctctattaaatccttttttcgaagaggcgcacccctaccttccgcctccgcaagaaagaaagaaaaagaggggaagcaaagcgcagaggcggccgtcgcagcagcaacacaagtcaggggaggagagagaggccgcgccgccgcagatctgtggccgcgttagggtttcttcgccggaatcgagcgaggaagtaggagggagaggaggaggaggaggagggcgacgagtaggaggcggcggcggcggaga

SEQ ID NO: 52258 - DNA, 310 bp, Oryza sativa
aggagagagagagggggagggagatgggtcgaactcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacagc

SEQ ID NO: 52259 - DNA, 1501 bp, Oryza sativa
actgtatccggcggaggaacgtcgttgccgcccgaatcctttcatctttttcctaaaatgggctggttgaccctatttgtcattgccttttggcccatgaaggtcattttccttttaatatatactacttttctattattgtgtgccgttaaaagaacacacgaaaattcatatttttttaaagcatgccattaatgagttatatgaatatcatagtacttttaggaattttaaaatcgctttcatttttcttcagatcaaatttgaattggaccgaaatgcatcgaattttccaatggaatattctttcgagctaggttcaggatgtctggttttcgtgaaaaccaaccgaattttatctaaaaggtaaaccatgatggaattttcttatcttcgagacatctgttggtaacctactcttagttggtgctttctgccatattactgcagatgacgaaaagtagtggccatatacttcggacatgttaacaaaagagtttttttttttttgtctcttgaaaccgaaggcagacttgctggtattatattaagtaggaaaaggccctgtttagtttcaaagtttttttttctaaacctccaacttttcatcacatcaaacatttcatacacacacaacttttctatcacatcgtaccaatttcaaacaaagtttcaaacttcagtgtgaactaaacacaaccaaagagtatatttatatatttttcccaactgtgaaaagaagaaaggaagaaaaataacaaagatacattcatatcttcacagaggtacgagatagggactaaggcaacattcaacgaaagagttttcattttttacctacaaggtgactaggtgagacttgactctttttgagtcttgagacgactggttgaagaacatcactattttttttcaagatacgaacagggtactgagtttctgataaaacctgacctgtgtggctgtggccggagtagctgtctacccgtgcacattaacaccgatggcacaagccgagcgcgggagcaggggcgatcacccatcgatccttaaccacgatgtgcccctctcatccgttgaccaattctgcgtcacaagcaggatggccaaggatcatgtcaaaccctatcccgaatcattgcgcccaacccaaaggatcgagcagagaattaagcggcgcgcaaatgtgtgatcccggcgagtttgatcggttgaacatgcgagaagttccgggttgctttccccgtttctgtcgtatcaaatcggagaacttttcggaccagctagcttgaccaggtacgtacgcatacccgatcaatgcccgtatctgtatgtattccagacgagcacacacaggaaacggaagaatacggtgtcttaattgctgtgctgtctgacgtatacggcggcagggtaggcgtagtactagtagtaggacctggagcttgaaggagggtcaaagaggaggacaaaatcggagacatggattgggcccgtgtat

SEQ ID NO: 52260 - DNA, 881 bp, Oryza sativa
caacaaatttttggggccatgcatgtatgatgtatggcagcagcaaggcacgtgcatttacccttgatcgctggagtttgttcatagacggtcccacatttgtgcaacaaatcgcatcgggactgtgaaattcaaggcggtacatatactggaaaagatgaacagctacaggagttccatagagaaaataaagtaaaagaactaaaaagacaacacaaaaaggttacttcgtaccactgttatttgacatcgccataacagtgaagcattctctaaatagccaagggcatccacaatataagctactcctaaagtgtcctcactaactaaggacacacgtaggaaaactcaactcgcaatggaggacacccctgaatgggctcctcaaaatcccaacctataaagccacaagtattgttttcctcttctacccctctcttcaaactaaggaatttgaagacatgaagcattcagaatacacgaatatattcaacacagtaattttcaatcaagagtaacctatatattataatctaattaagcaatagaatactagtattttctatcacactctcaagtactacttcaccacatcatctgtactactctatcttatcctcttcgttcatagccattcaccgcatcatctgtactactctatctcatctttttccccaatcttccatcgagagcagcaaaccgatgccaagatcggtggatggcatagcgagctcgcatacgcggccgagctgggtaccgggcggagcaagcaaggcggcagtcggctgacgagctcactcgcgcggccgagctgggtaccgggcgaagcaagcgaggcggagcaatcgaagcggacgcacggcaggagcgagctgccacca

SEQ ID NO: 52261 - DNA, 1501 bp, Oryza sativa
ataatctttggcaatatcgtcatctaacctacaatcggctaatatctgttaatagaaggcagccgattaggttaaatagcgacgttgtcctagattatataagatatctaccactttatgaaacacccagcggcttgattgtctagatattgttcttcttttcatacttaatgctgcatcagttgagtttgatctattaagtcgtgcttagaatatcaatctctagcctgtcctctggttgccgattagggtagcatcggagtttcagccgatattatctgatttaaccatattcaatctatatgcttcaatgacatgttaaatctgccatttatgtcaggatcttattgcatttaagtatattaagcttttgtttggtatattatatttgttttgatatctttatataaagtagtatcggagtattagcggatacatgctagatctatctgattggctatgctataaacatatataatcctgttattaatatatatttcgatcgaagtgatttattctgtctcggcatggtggccgatctaccccaatcacttgatttaagtatatattaatataagaactatatatcgttaatatatacagccgatcgaatagatttagtttcttactatctatttataaccgccgatcgattcacatatgacatcggctcaaagataaatgatgtcatcggcacctagccaatcggctatcatttatagatttaaccacgaattctttgtctctatttcttgttgattacaggatcaaatcaactggcacgctcatacattcgaaggcgagctttggacctgcactggagttaagcagatctcccaggcctcatgttttctatcaacacgcttttggcacgcccggtgggacaaattagaagtcagcaagcaattcttcctcatggccgagaagccaccgctatcgccatcctcggctagcccaagcactgttaaataaaagatccagaagttggggttgactcgtgcccatcgatccagagaaattcacacctgagcagaagaaggattttgaagcaatgttgcagcaagcccaggatcaggtcttgaactcattcatgcagccccgcaagggaacattggttcagaagtataaagtaaaggtagttgcggatgaccctgggaccagttcttccaaaggtgaagacgggaaataagctccaaatggctcggctcaactgagtgacaaaggtgctaccgacggttctctaggaagtcaaggtgacaactctcaaggggtgcatggagttcaaggtgatggtgctcaggggttacaagagggaaatcttaatcagaatagtgatgcggcacaagatttttttaataatttccaagaccgggtcgactatgttgtgcaccatgctttgatcaatcagtctggggtgttagtcaataccttatcaaacatgacgaagtcaatagcagatggatcaatagctgagcatcaggctgcaagcaattcttcctca

SEQ ID NO: 52262 - DNA, 1442 bp, Oryza sativa
acgtctcctcctgccccttgctaatccttccttgcaggggaggggaatctgccgctttcctcatcgtcggctccacttccacttcctcttcctcctcctcgaggacgaggaggaaattggcagctggaggcttggagcgcgctgcatcatcccgcccgccctgctgctgcggcgatcgccggagcagggctgcaggggatccccacggccgcagcagctgttgttatctggtaagcaactaaagctcgctatctgctcgacggaatgccgcaccgaccaggaaccaagtgttgcttctttctcgcttgatcttctctttggtagatgagtaaatgaatgcacctgcacttggactcgagtttgctgtgttactcggcgttaagcagcaattttctgttcctcctacttcgtttttcgcctactattcctccttacttattttgaataatagaccttgaactcatacttggaagcctgcagattctgtgtggggatggaggtggttctgcatgagggggatgccaaagattgggtttacaaaggagaaggtgcagcgaatctaatcctcagctacactggctcgtcaccttctatggtatgcatcgaataggttctgcttgtgtcattattggttactgacctatagtctcccgtaaatcggcgaatttgatgcatgtgcttcaagaaggatgttttacttttgatgttctgatgattatagctatgaatgtttgggtgtctgggaggcgacagtagttcaagctcttttcatgagatgttttggatggtgttttatgaggtgatctggagatgtagccttgtgcttgatctagctaggacccagcagttggtgtctagtcgtttctgtcctagtttagctagctgtttttattttcctataagactctgtttgtttggctttcctcacaaagccggtttaatgaatgcctgatttccccccaaaaagatgttttaccaactttgatgcaacgcccagggatgcatgtcctatggccagagctgcactcttgaaatggcaaatgtttgtatatgtaaattagaaaatcccatacagctttcatgtagtcaaatagtttcactttaatattatataattcaaaagaaaataatcttagttgtgtgatcacacaaaaagaaggggtggtggcggcgccatcttagttgtgtgatctgcctgcccggtctagttttgtttttttgttcaattccttttgctgtattgctacaacattgttgtttcctgtaatggaaagagggagagcaaggttcttctgttttttaaaagaagagaggaaaaagagaaaataatcttatcttgacttggttgactaaaatttttagtttgtgaccaaagtattatgtttccctcgtatgatatgtttacaggaaaaatgttttgatgatgttttcttgaacagctt

SEQ ID NO: 52263 - DNA, 1501 bp, Oryza sativa
caagccacacagcaaatatgcaaatacacaaggataccaaaggatggcacaatatagtctcatttgcgaaagcagcatttagcaaagagttaagagtagtaaaacagtagagtaattaatcagaaactttaatcaacactgaacaacacacccatgctgcacaggcccaaccatcctgaacaaccatacccggctgtacagatctaactccaaaccaggagctaaacaaattattaccagttatagcatcaataattattgtgagaggtgtgagactaatcacgaaaaacattgctcaacccgcccataacttgggcacggctattcgaatagttttactctggccagaggtgtaccactgtacccacaagacacagcctcaacatcatgtctaccatgcatcgcgatactagaaagtacccgaatagaggctgtgacaataccctctgcacaacacaactcaccatagtgcaccattcctggatcataatcacccccttataaaacaaggcttggactccccagtgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgccatgagtacgaccttcaaaaccatgtgctcacaacccaccattaatcatattttaattaccaattaattatcataacacgattaaccatcgtgagataccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaatagattcacaccacctagtgacattcgaaaataaatgcacacttgaaatacatagagaatttaaatataggatcaacatgctcaaaggattgtgtttaggatctgtgtgacttgccttgcaataatcggtcttcaattaatcttctgaacactcccgacgcactcacgaaccttcgcaacgacagaaacgacaagctaacacacaaaacgaagaaaaaaactaataaaaccaaataaacagtacaaaaacaagcataaacagtacatgtggatatttttaacatgtagatctcgattttagatgaatttagcaacttgaaccagtcgaatacaagttacgatgatttagttatgaatttccgaagatttaatctattagataaaaaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactca

SEQ ID NO: 52264 - DNA, 1501 bp, Oryza sativa
aacaaacaaacataaaataaaatgctgaatagttatatatctatattcttatcataagtttatttatttttgaacgaaaaaatagttattataactagtcctaaaataaataaattataatatagcacatactaatactataacttttatctagatttttttagtattatagtattcccattttctatagtaggcgaagaatgcagacatgacacggacccatcgacgcgggacggcctggtgagatcatcctaggccccatccatcaatccatcacgctgggccgtctgtgggctgtctgtcggtgaccacgcccacgcagcccgcgacccagcgctcgtacggttacaggaagtggaggacggtggaaaaattccacaagagttgggggggccaaaaaggacaagggaaggaaaaaaaaaaagtcgccgatccgtttcctcctcgattgccggcaagcggaagagggagagcggaagcgaggaggaggaggatcgaggcagcgggcgcaacgtggcgcgcgctttgcttgcaacggaagcgtggggattataaaagagggggcgcgagatccagatctggcgccgatgcgccccccctccctgctctccctcaccctcgactccgcgctcctccgcatcgcccacctccacgacctctcccgcctccccgaccacctcctcatcgacctcttccgtgtaggtacccccacaccatcgctcgctcgattgatcccccctttgcccctctcgtcccgatgctcggatgcagtgttgtgttgtggtatttcctattattgtttatgttggttggtttggctgatctgtggcaattggctgcttagattgatgagattaatgagactaggttatatatgtggtacatcgtgcgcgcaattagtggaacttatcggattgggaaatgggaagaggtgatttgcaccacctgttttgtgtttagatttagatcatatcacacgaggtgcccaatgcggcccatgtttgattaccaagtggtctgatgatgctacgttgaacctgtcaattttgctgagaggatggatgggggtttatgaacatttggccatgagctggggtttagactcgtagttgtgatcctactcacttttttttttattattatgatagatcaaactgaaagtaatagttttgctattatattttgttaatctctgaaggcatctttgttggcagagaactatagctgccggtaagctgacagaaaaagtcctgaagttgtttctggcaacggattgcgaggaaatcgccttgcttgttcagttgctcaacattaagcagccgcttgtaccggtccttcccacgagtatgttattcatcagcttatctctgtctatttgattgtcatgtgatttatgtcaaaagatcttggtttttgacacgctatcctcttggctgtagggtgctctgagaagttctagaagtgacactgattaggtcagtcttggttacctgagaaaaga

SEQ ID NO: 52265 - DNA, 919 bp, Oryza sativa
aatcggcccagctattgatcgaccaatacggcaaagaggaaaaccaagtaaaagccgatccagacaaagataaccgaaataacctaaccttcagagcgtccacagccgatgcttcaccacactgagctaagaatcggctaatgtactcataagttgacacaccatcttgtctcgaaaatttggagaagtccggaactttgaaccgattgggaagaggaactctttcaaaccactcagggtaaggctgccgatacaagcttccagtctcttttggtttaagcccaaactgttccctcattacgtcagcaatcacatcggcccatggtcgctgctgagctaccccttgtgactgttgctgcatgggctcgaactgaccatattgaggcgcaaactgaggttgagccaatccccctagctgatattgggcttgcggggaaggaggctgatattggtaattcaagttacccccttggtaattatgaaggttcggctggatattacgtaccaaatgctcaggaacaacttgaggtattactgtgccatccggctgtacgtggtgaaccaagtgttctgggacaacttgatttaaaaattgttgtacaggctgaccaccaggcgttgcaaacccggccgatgcacctattgaaccttggtgctggaccggctgaacgatttgctgtcttaacggcgtctgctgaatcggctgcagaggctgctgccttggtggtgtttgctgaactggttgcatgacctgttgctggattggctgcacaacctgctgaattgggggtgtctgctgaatcggctgctgctgtattggatcaacaataggttgaggcggcagaaacgtggcatgtcacgaccggaaataacccaacgggcgttccttacgtgcgtgtattattccttgtcccaggag

SEQ ID NO: 52266 - DNA, 737 bp, Oryza sativa
ccctttttaaaattaaaaatttaaataaagaaattcgcaaatattcatttaaagagcatataaacttcaaatggccataacttggccatttgaactcggaattggaccgttcatgtctctaatttttccttaagaagtcaagaacctatttttgtgctttgtttcagcttgttatatggagtttattagagtaaaagccttttcttttccgttggtcgtgtagacgctgcagcttcggacgatccgctcttcgtggaagttgaagccaacgtttgggaaagcgagcaaggcaagtcacatcatccttgaacatattgaatcccagtttataaaattattttgatttaaattattgcactatcgctttatttaaattcccgcgttatcactgttttatctagccgtgcctatttacctttgttatgaccttcttattgttattgttattatttccttgttcaccctagcataaacaaaaccccaactagtggacactctactcatggtaccactagtatgattttaggtagatgcttcgctggttaattaggcaacattaggtggttttacaactctagactgtgggattttctcatcacctggacactatggaatggttggattattgtggaattggattcacaccgccccctctattcaaaatccccaaaatggttttaggctgggttcggggtgcatggttttgatagtagcacctcggccatataaggaccggt

SEQ ID NO: 52267 - DNA, 1501 bp, Oryza sativa
gagctctaatggtctagatgtggacatgatactcttagtaggatgagaacatgcaacttgtttgccagcttgacaagcactacaaagcttatctttctcaaacgtcacatctttcaagcccacaactagatcacgttttgaaagtttgctcaattgattcatgccaacatgagctagcctcctatgccaaagccaacccaatgaagtttttgcaactaaacaagttttcaaatttgcttcactagaattaaaatcaaccaaataaagatttccatatctaaaacctttgaacacacaagacttgtcaagaaggttagaaacaataacttcttgtgggaagaaggcacataacaagccaagatcacaaatttgagcaaccgaaagcaaattgaaatttagagatttaataagagagacattttcaattgacaaatcattggagatagcaattttacctaacccaattacctttcctttgctattgtctccaaatgtcactttctcttgttcattccctcctacttaaaatgtggtgaacatagccctatcaccggtcatgtgttgagtgcatccactatcaagcactcaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatgctaccatcatgagccttcctaagcatataatgagaatcaaacatgcatgtcttaggaggcttacctccggggcaatcactcaccaaatgcccaacctcacgacacttggagcaatacttaccatttctcttgacaaaacgagtggcatggtgagaaggtttcttacccttctttggaatgaatccaagtccctccttgttaaggatgcaccgttgctcactcaaaatcttgtcaagagtgttcttacccttgaagcatctctccaaactcttgttgagcttagccacttgctacttaagctcattgttctcaacaacaagtgaggcatcacaaatagaaacacaagagctagaactagagcaagggctaggcatatccataagatcatcacaagaggtataaatgctagatgatgcaacatgagcaatatggcaagtagcactatcatcaagcaaatcacaagatatgccaacatctatgtgagctccatgttgagtagtggaaaggaggttgtcatgagcttccttaagcttctcatgaaaaatagtgagtctctcattagaggtctttagctcctcatacaagacctccaaagaagcatgatccttctttagagccttgaacttgacaatctccttctcactataagcatggagctcctcaaacatactcacaagctcatcataggaaacatcatcacaatcatcatcactctcattatcactaagagatgttaccttagaggagcc

SEQ ID NO: 52268 - DNA, 733 bp, Oryza sativa
gattgcatacaattttctagaaactacaagaattattgtatctttattcaaatttacatctataataaagaatacccatttcagaaaagatgttgaaatatatgttgtattgttggactgtttaacaaaaataagaaaggaagtaaaaaaaccccatggagctcaatcatgttgtgttagttacagagaaaaggtgaggttgaaattaatagattacagttgctatttttccaggtgattgtgttccagtacttaaaaatctgttataatttgttatgttacaacattatttattgtaatcaggaacaagaaacctacacgcaagacaatcagattgaactggatttcaaaaataactgagataaagcaccgtttgtgatattctcatcaaaactaagggattgcactcgtatattttttgatgaaccataaaaagatcatggagtcaagaacaatcaggatatgatagaaattcatgaacgtcaggttgaaacactaaattcttctgcctttttcctgggagcaactcagagtccacataggagaaatggcgagaattactaaaactatttacgatcttcccaaagctagcaccttcagttctctcgctatcagtttctgaatctgcctcatggtgattagccgtacgagaatccacctcctgatcaccataaccaccaggatgcacgattattccgaattcagctgtgactgttctctcgctgttactagt

SEQ ID NO: 52269 - DNA, 272 bp, Oryza sativa
tgaagtactgtataggcccaagcccattagcactcccgataccctaacaaaacaccgaagtccaagcgacgcttcgtcttccccgttgaaactctcgccatttccccacttcttgctacagttcaaaaccgcgccgacgaagcaagggttcatcaatccgccccaatctaatctcaaaaatccacgaaacttctccacgcgcccaccgcaccaatttcccattcctctctagctatttctcagaccgaatcataccattcgacttgcatcca

SEQ ID NO: 52270 - DNA, 957 bp, Oryza sativa
tgtgtgtgctgagtgtgtgtatttcctatcacatgaattagtttaaatcgttcacgagaccttgtattgttgtactgtttaagattctcaccatggttatatactttcagaggattctaagcggtgacaacagttatggagcgaatcttgtctagagtggtcaacgacaagatgcagactctggggtgtttctgtggtcctaagggaaaacacaaatgaaaaacattaaggatattcctgaatcatggaatgttcatccaagaaaagatcagtttgatccaactggatgagacatcgagatccatcttcgaaatgatcagaagaccaaggataaggtttgtgaattaatgttatatgttgatcaattatatttgttccataaattttcatgattgattgaaagagttacatgtgttctttctcaaatttatgagtgtatcacaaacaaagttttttttaaaaatgtttttgtcgagattatggataccccatatctacacgacagttatagtttggttgggtatatggtaccaaatatagatagaatatctttatgaggactcgggttagtttcgaacttgtatgacaatgaaatacccaagatcctagtcggttacgattgtattttatctataatcacatattccgttagggatatagactttattttgtaatacggaccccttcccctatataaggaggggtccgggttcctctcgggaggacttttttctcccagattatacaatcaataatatactcggcggaatcatccccggacaggagtagggtattacttcttgaataagaaggcctgaacctgtataaaattccttgtcttcaaacccatccacttttctagcttgatagccacccccttttattattgccgtaatcttgtttcgacagttgacgcgccaggtaggggtagcgtcagttcttcgccgattagtgcga

SEQ ID NO: 52271 - DNA, 300 bp, Oryza sativa
caagcttggtgggtgttacagtatagtcctagagactatttggcgcgcggtgattttacctacatgaggtatttttggtgattgatgtttttatgctacaagaggaaattcgtctcaaggtagagattgttaaatatgtgatccgaattttgggcccacaatatattcggattagtttcctagtaggagtcctattaggtgtctttctattatcccctatatatactcttgtaagccgtacgggaagggttgacgttcccattgtgattcccctacgtttgtaatcatctcctctatagt

SEQ ID NO: 52272 - DNA, 175 bp, Oryza sativa
gcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaggggtttattgc

SEQ ID NO: 52273 - DNA, 728 bp, Oryza sativa
cagagatggcacgttagtcctggtcagatatatgccaggcttcatcctaaccattacaggcaagatgttgtgtgaagaagggtgagcatgtaggttgctaagctgacacgtggtggacaagaatgaccgacgtgactggtctgataccggtcatgtcgtcagcagacagccacgattccacgtcgtgcctgcttccggcggaagtggaggtaggtatgggccgtcccatcagaaggtcattcggacggcaaccatacaagtctccgtctgtttatgaaaaggtggggtaagtcccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcatctggcgcgccaggtaggggactctgcgagggattttctgagctctcgcactctttcgtgtgcgccaagcttttcctgttcagcccaa

SEQ ID NO: 52274 - DNA, 1029 bp, Oryza sativa
acgccggctccactagggacgagtgtcaagaggctctcatcattcgaacgggacggggcgaggcgtgtaccaggccgcctgctgccaccataacccgcgatctgaccggtctgtgaccggtcacacactgcgaccggtcacggaccggatatgcgtgcgccgtgctgcattaaatgcggcgtggcgcgcttgtccattccgcaataaaagtggtttggtgagcgccgctgtgcccacctaacccacacccgtggcgccaataccacagggggtcggggcgccccagccctcggggccgaaacaggagcggctcgacccctcggggagacagaggagggggtgggcacgtccccctcgggcccgaccctcccgagggggttaggccacgtgggtgaccgcagctgcccaagcctctagtcatgatactcccggtcccatgtcaccgacagtagcccccggcgttatgccagggcgatcgcccccctcgagggaagcgctcgggcgtgacgccactctttagacctggtgacaggtggggccgctctctacaggcgggcaggaacccagcggtcgcaaatcgcgtgcatcggctagggaaaaacgaccgataacaatgagtggcctcttcaagaccgttacattactcgagtagcgcgcgaatcgggacgagcaggttcatttcgcctggagatatgatgatggcgcttcggtcggcgagcgtagttaacacgcgcacgatatgtcccatcttgactgccacggccgcacatccgcctcgtgcgccgcaaacggacgagtaggattagtggaggcgtgggcgcgagaaacgagggggcgagatagtgggcgcgagaaacgaggagccgggcataacgttggcaagggtataaaggcgccaaggaagagattcgtttccttcctctcgccattattccccttgccttagccgcttgcgccctaactccttgtttcctgtgccctacccttgccgcactcactcgttctcaagctcctcctccgccggcgtca

SEQ ID NO: 52275 - DNA, 154 bp, Oryza sativa
gtaaattttatcaaaattgcatcctcgtagaagtagttacactctgttagttcaagcaacgaatttctgaaccaaaccagtatttttcatgactgaagttttcttcaacctcatcattcatagctaactcaatttctttttatcttgttgcagc

SEQ ID NO: 52276 - DNA, 1501 bp, Oryza sativa
aatactcatggttgaacaaatgggttactaactgaaagaaactgctagatataggaccactccgttttgttagaccttaaaatatagttaaccatactgtcaccaggtcattccatcgactctagtgctgcaatatgcaaccaccaagtttggcatgcgaatttactgataagctgcaccaaagccaaagacagaaatgtacatgcagccaatgatctcaaaagagtgtcatggcaatgcaaggaggaagggggtggtcaggactcgggatcagagacaggtggaggtagcagcaaggaaggcctaaggtcacctagggaacacaatgcagtgaggaggaagaggtggctgcggactgggagcaacctggacatgaggaggggatgacttaaacaacggggtagcagctaaaggtggcctgaacatgagttggtttgaatcaacagtacactgcccagtagcaaaagaaaaccaccttgcaatcacactaacaagagtatacagagcaaaacagagatgcatgctacaggatcactagtagttcatcatcaaattaacaagctaaccaaggagcagtgctggccccctgatctcaaaccttcagcttagcaaattctaatccccaccttaattctattgtgcatcagtaagcaggattcttaacccaagctctctaaaaccctgcctaatccaacatccatccgaattcgcccaaagtacaacacaaacctccatgtgaaggaatagcaacagaatctcatggatcaaagatcacggatagccagagattggcagcccaaccagcaagcaagaacgctctgctcggtgtccctccccgcaaggccgcaaccacttcgcaagctgctctactcggcgcgtccctccccggggatggcaacggggctggatcagccccgtagccgacaaccgacagaaaatccaccatcgaagcccagcattattcactaattcagcaatccaagcagcagattgagattagggaacccaaaaaaagaggcgttgagagcttgcttgctataccgaagagtatgagacgcggcggcgatctgcgcgaaggaaccgacgacgaggtggcggcgttctggtcgcggatccgacgaggacgaggcggcgtggtcgaagccggcggtcggtggccttcaactcctcgccgccactccgatggcgaggcccgattccggcggcggcggagacgaagggtttgggggatttggagcggaagagagacagatcaaacgagaggatctccgtccagattgctcaagaatccaatccaacggctggaacgcgcagccgcaggaataacgctacggcccaattaattacaatgggccacacgctcgtggcccaactagcactggccggcgagagttcgtcctccacggcggcggcggcggcggcggaaacgcaatggaccccgggaaatcgttctctgcggcggaggaggaggcgacggattcggtctctacgaagccggagg

SEQ ID NO: 52277 - DNA, 1113 bp, Oryza sativa
tgcatgtagtttatttagctgtcgttctagcataggcgtccacgccatatcgatgttgtaaagtctgatcctttagtcataagttgcttttttttaatagaaaaaggtcagagacctggcttctattgaaagcccgaaggttgtgctgggaaatccagacattagtttacaacatagggagggcgagacctctaacaaagtgcaaaaggactcgagcaagctaccacctctaagaccaactctaagacaaaagagacagtagggactgctgctaaacatagcagacatcagataagaaacacacaaccaagacaaaccaagacagaagacaggcagaactgtggcaaccaagacaactctaaaaacaaggaatcaacctatccccaatctattacttccagtattagcagcaacgatcttcatcttctcttctaaatccatcatcctgtcagcttcttcagcacgccctaaaatcttccactgcagtgaataagaagcaattcgaaaaggaagcattaggggagagtaaaccaactggaagatataactttgactgcataattctttgtataaattgaaaaaaatgttatacaagtaatttatatatttaaatgtagcaaatttccaaaactacatgacatatgtatcgcaaaattactgatttaagttccactgttacaaaactacgtatttaaggtacaatatagcatacaactaaagattcgattgtcaatttagctatgagagaaccgcatattttagatattagatctttggcattgttgttcttatggaacttttagaatatatatgtagttttgtgaaaaaaatatcactaattaaatatgtagtttctttaaccaatattttcatgtgtagtcttgttataaatttacttttaaagatatggttttgtgatagacattcttctaagtttgtagttttacgataaatttgcttctaaaatactcccttcctttcatattataaagcatttgactttttacctagtcaaaccaaacttatagaaaaatgtagtatttttcaatacaagacaaacttatgaaagtatagtcaatgttagatttaataaaattaatttgatattttaga

SEQ ID NO: 52278 - DNA, 1501 bp, Oryza sativa
cctcggtgtgtactgtggtttgtagttttgtcacaggtttttcatgttttcaatgtaaggttttgtcggtttccctttagcaaactgtacagttgtatggtttttgggactagttttccttataaatagggtcaattctcttctaaattatccggtagaactcctaccgtctactgtttcaaaaaaaaaaaaactatccaaaattcttgagtttttagtatgctcaacatgttaagagttggtggaaagattggtcatgaaagtttcaatttttctcatcatcctttatttggtagtagagatgagaatcacggaaagttcgagtgagaattaaattttatgatgatgtccggctcagatttatctttaacgtacttacgacgaaattccctcatagttatatgtcctacctaggtattgaaaaagtgagagtttactcttaaacttcgccatccaaacaacgtaattaagaacccctaccctcgaattaacaattccctccaacgaaaacacgttcttattaaaggaggaggatccaatgaaaaattaagaagacaacgatgagagagctcaaacgattgactaggtggcgcgccaatggtggtcgatcaggcaatgttgtgtcatactctatccgtcccaaaatataactaagtatcggataagacatttcataatagtatgaatctacagtatgtcaagattcgtataactaggaaatatctcctctcctccagtccaagtttcttatgttttgggacggaatgagtatatgatttatcctacgtcaaatctctctaattttagctaaatttatagaaaaacctatgaacacctataacgacaactaaaatacattatcaacacacattttatatagatgttgatatagttttatcataaatttactacaagttagcgaaatatggaaaaagagtatgtatctatactatctataaaattataacccactaagtctaaaactcaacatgtaaccatgctacatcatcacccactaacaataattacatatttaacctcatgcaagcatacaacatcatctacaatttatttaattcaacaaattaacatacaaacatatccaatcatcacccgtcacatcatttgcataatattttaacaaatctatctatcatttttataatgtttaacatatatttatcaatatgtttcatattaggttatcatttgtttgtttcatgataagtactgatacaccttatattttattattttttcttttttacttctatcttggttgtaaaaaaatatattaaaaattacttagtaattcatgcagcaatacacgaaaaatcaccgaatcacctaagaatagactggcacaatgaatgcgaagaagactacgcttcatccgtgcactagtatttgcagagtgcgacgtttcactgacaaaccgactgtcacaactagagacagaattagtgaattcagaacaagatatcgagctcgaacttgattc

SEQ ID NO: 52279 - DNA, 902 bp, Oryza sativa
tcgctgccgcccatagatgaagatccatctgctctcgctgcctcgccccttctagccgccaccacctccttcctacttattccctccgcctctcgtcgccggtgatgtcttcgcgccgaccgcctctcccgccggcatcctctcgtcgtcgtcaacactatcctgccagcgccctcctctcctaccggcatcctatcattgttttctcctcccgacgcgagctcgtggatcggcctcggccctccaccgccggctgctctgcccctctctcggccctcctctcaccccgctctcccggggcggccaatctcccctcgccagccactccgcctgccgccgccaccacaaaccaagagtacaaaaccgccagccgcctcgccctgtctaacgccgacaacctcccttgaagaaaagagaagagaagaaagtaaagagaagagaatgagaagaaaaaaatatgcacctgacatgtgggccacacataccttttttttttttgttgtctaggatgccacattagtgaaaccacccttatatactgccatagaaccttgagtgcacgatttatgtgagtttagggatacacatttctgattttgtggttaagggaactaaaaaaatctcgagtaaattgcataagtggtacacgaacttgtcaggtgggtgcaatctagtacatgaacttgtaaaacgctcgtttggtgcacaaacttgtttggtgcgtgcgaacaaggtcaaaattgcacggcaaggttaatcttgttaatcttgttgttgatttaaactctatgtaaacatatgtctaagaaggataaacatataataaggcataatgattacataaatcaaaaaccgagtaatgatgcaagggatagaaacaaagaaagataaagtggaaacta

SEQ ID NO: 52280 - DNA, 1501 bp, Oryza sativa
ctaacattccgtgctctccactgctccagcaaacatttttggttgtgtgcacgtacgcttcaatgggactatgggagctaaactagccctacaatacctacaaatatcctagagatgagcgtaggaaatatctttggatatgtttgggagagtttttaacagctgcagcttcttccataaacagaaactcacctaaatagtttggatttttgtccatatcagagaagttgtagttactgtagaaaaaaattggcaacgggcaactacgggagatgactccgcatcggacgtccgatattccaccaaatatcggacgcccgactgtttacacgtcatcacaccacctgtgtatgcagcatgcaaaaaaaaatcggtcagtcaaatgttccagttaactaacaagtgaaacatcaagttatatatggtgaaacaaaaatatcagcaactgaaacatttaaaaagtttatgaaacatgatgaagatacacgttgaaacatatcactatcacatataaaacaaccaatgttaatggatcgaaacatatgtttttctttcatcaaaatataatcatgcgatatcttgttttaaagatttaattacaaagaatacaacggtgtgatcagatcgtaggttgaataattagtttaagagaaaaatcgttttgaaactagttaaaatgcatgcatgcatgcatgaggtggagagagagaggagagagtagtaacagttagttttgtgagtgaattttgtgaaacacgctgaagacacatattgaaacatgtccctatcacgtaagaaaaaaaatgttaatggattaaaacatatgattattttgtatcggaatataatcaagcgatatcttgttgtaaagatttaattataacgaatataacggtgtgatcgaattgtagatcagctaagtaatttaagaaaaaaattcgttttaaatatcgttaaaagtgtatgttatatggttggagatagagatatagtcttgaataggtgtacgtgtgtcagaggctgcctgtccgacttttctccttacttcagacgttcgaggagaagcattatccgcaactacgcgaggaaaaacacactcttctgggatgatcacatcatgctaccatgaactaacaactgttcgactgggatcggttaggaatgaggtagtatagtaccacgtctcgtttgtctgcatggcacgcgatgagtgaacagtgatgtaagatccggtcccgctgcttagttcgcgcggccgctttgaacgattggtggtgagcgggcgggtagccgtggcgcgcgttctcccggcggggagggagacgtcgcgtgctccaccaacctgtcgcaacagcccgtcaaaataccagtaaatcgctagccccgcgtatctgcaatctacaagcaccaaaagggcaaaatgccagttggtgcaaaccccacgagccaaaaatatgcatatgatgccctcaggaaaaaaagagagaagaagacagcgagt

SEQ ID NO: 52281 - DNA, 1501 bp, Oryza sativa
gagcctacacagtagaatactgaatacacacacactctctctctctctctctccatccccacatacaggagtagctcataactttacgatattttttttcgtccacgtaataattggactggattagccgggggccagtactggataaaacggtttcctccctgattgccgaatttttgcaggctaacctgctgaaaatctagtaatcttaaggagagacggacaaaaataatcatccagagagaggaggaagaacattcgaaaggggaatctttgagaggtgtttgcatactaccactgcataattaacctgatcttctctaggagcaatagtgcaatatacaaagtcgtttactgactaccactaaatgataagctgctctcttcaggttcagtgtttcgcctgttcggtgcaaagtggacggccataccgttatgtgttgagattcgactagaaagtagtagatcaaaatgttttttttttctaaaaaaacagcttttctgaactatggctgttgctaagagcttgacgatatcttcaggcttcagggataatttaagtcgcttaattttcagtcccagagaaaagaacagaaaatagttgactaccgcacacaacattgatagcagtagctaggaatacttaagttgcagtatcaattatcagcccataattccgatcggtagctggtcgatgcatccatgataatgcatacctaaaccattgcaaacagcctagcgacagcttgaacatatattctactccagtactaagcttgcactactcctgctccattcttaattttcccacaaaaggagaagataccgtgtcaaatccttttctaattaagctacctttaattaagccccctaataatccgtacggtccaaatagtaagaagcttcagctcacacagaaatgtagtagtagtagcagcaagtacatacaggaccgtacagtagaaagaaaattaagagacagtgaggctttgtaaagaaagaatgtttcaattcacttgaaatggtggcagaataatcgcagtagtacagttatttacactggcgaattattaagtgaaaataagaagaagaagaagaaagaataaaaatctccggtgctaaataattttcccggatttgacaagggaatggatgactagacttggccgtctcaaaatcctaagactttctcagccatctcacttcaccgccaccgccggccggtcgccgatttctctctctttctcttgctccggcgagtctcagctcctctcaaatggccatggagggagaggggaaaaaagaggacaagaagagaagagaaaaaaaaaatggtggcaagaacggtcgcgcgcatgcacgcacgcgcaatggcgagcggagcggctagctaggggtgggatcacacatcgcattcaccacacggccttgtcggtggcaatgccgcggaggagcgggagggcgtcgccggcggcggcgcagcagcaggagagggcgccgc

SEQ ID NO: 52282 - DNA, 1501 bp, Oryza sativa
acaccaatgacatgtacaagttgaagaagaaggagatggaggaagcctcaccctccaagaagtgcattgctctctaagccgaagttgaagacaagagcaagagcaaggtgaatgaagtcaatgaggacttggaggaagagatggtctttcttactagaaggttcaatgatcttttgggaaggagaaaggagagaggaaggggctccaactccaataggagaagaaatagaagacctaacaagactctctccaacttgaggtgttttgagtgtggtgagaatggacactttgcttgcaagtgcccttccaaggatgatgatggagacaagtcatccaagaagaagagtggaggctacaagctcatgaagaagcttaagaaggaagggaagaagattgaggctttcaacggggactgggactcaaatgaggagatctccgcctcatccgggtccgaggaagaaggtggtgatgatgcaagctccaagaagaagaagatggccgttgttgccatcaagaaggctccatcactgttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggctctaaagaaggatcatgcttctttggaggtcttgtatgaggagctaaagacctctaatgagagactcactatttttcatgagaagcttaaggaagctcatgacaacctcctttccactactcaacatggagctcacatagatgttggcatatcttgtgatttgcttgatgatagtgctacttgccatattgctcatgttgcatcatctagcatttatacctcttgtgatgatcttatggatatgcctagcccttgctctagttctagctcttgtgtttctatttgtgatgcctcacttgttgttgagaacaatgagcttaagtagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgagtgcttgatagtggatgcactcaacaca

SEQ ID NO: 52283 - DNA, 1501 bp, Oryza sativa
ggaggaagctaacatcaaccatgggtatataggtggtccaaaggggagagaaaaggtagggagaggtgaagagagaaaccagaatctaggcttcacatgtactagaggtgatgcgtcttgttacagatgaatagggccgtatctatgattttggggcccatgtgcaaaacgtaaaatgggccccaaaaatatgaaaacggagcataacaaaagcataaaatttttagatatgtttcttcttaggaacatataaaacattaatgctaaaatagtttgacctgacctcatgttctactgaaaaacataatccttttgatattctttgaaataaaattttgaattatatcttcatactcaatcttctctaaaacatcattttgaattatattttcatacttaatctcctcatgtaacttgtacgcaatccgatgaaataaagctttcattcatccatattttctgtgttccacaactctgtgcttgtctgctattgtgctgatcagtagaatagaatggcttcttaaaatgttaccagcacgagtctccaccaagctaaacaggtaaacagctgagaaaccaatgcctaatgatcatcttgttcttaatatgcaaataatatttctactatagttgaaatgagcagaagaacaatatggcacctgaagtaccatcctctgacattctctcagcaatacatgataacatgaaggtggctctatcgctgttattgtccaattgctagagatgatgcatcctctcagcaatgcctagtaacatgaaggcggctctaccgccgttaccatccaaaggcttgagatgatacatcctctcagcattagttgatacatgatggcggctctgctaccattatcgttaaaatgctagagatgatgaaaggttcctgaagcatcggtatgtaaacttaatggatggctctaccgccgttgcccgcaaatagtggaggcaaacaaaccttctacacgaccctaaaagtgttatggatgtcctttggttctatggagatcacccatatggggccttgctgtcactaaggtcaactttgccgtcaaggctcgtgggctcatagtggagaagtgtttactggtttctattcttttttaaagtttgcacaatatgcatggagtttgtgcccatgtatgctcttcgttttgtttacatgcttactatattgtttgcatgatctttcgtaacattttattttaatgttatataattaatttcctagcatgattcataatatttaatcacgcaatctgtaatcctaaggattacttaaattaatttctatggtaaactgtgtggtaatcctaaagattacacatgctagtgatcataaaaattactcatgaccagtttatatcgaccctgcacatattatttacctgttataaatacaaaatgatgccatgggacatgtcagatagaacaaagaagtaattcatcgagcttgcgttggatggtagcaactacctcactgcat

SEQ ID NO: 52284 - DNA, 1501 bp, Oryza sativa
cggccgttcgtttccgtgaaccgtcgccgtgcgcccggtccaccgaaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaaattgagatctactgttaaaaatatccacatgtactgttcatgcttgtttatgtgctgttttggtgattttgctcttttctgcttagattccgacgtttccggagagtccgttttcgcaggagaagaatttgaagaattctaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgactactttattccttgataccttgggttattataacttgactagttgggctttatatattggttcaactagatatattagatatgattgcttagccatgcttagaaacattagcacattactgggataacttatgactcactattatttaatgatggcttaatgatagctcacgatggtcaatcgtgattggttaattaattaatgtgccaattaaaacctgataatggtgggttgtgagcacgtggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggtcgctggggagtccatgccttgtttataagggggtgattatgatctaggaatggtgcgttgcggtggattgtgttatgcaaggggtattgtcacagctcctttccgaggtaccgtggtggtattgaggcacatggtgacatgatgtggggctgtgtcttgtgggtacagtggtacgcctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagatctgtacagccgggtgtggttgttcagaatggttgggcttatacaacagggtatattgtatagcgttggattaatattgtttaattattacttaactgttttattaaattctcaaatgtttattaaatgctgtttatgcaaatgaaaccctactatgccatcctttgttatcctgtgcacttgcatatttgctgcgtgacttgctgagtatgtcatatactcacct

SEQ ID NO: 52285 - DNA, 1501 bp, Oryza sativa
tttttaaactaggaaccaccatgtaacagccatcctttttgttttctatgattcacaggattaagaaatccctttacgttgatgagttatgttaccccggttatggcaataacaactgcaattctttctattgcgatggatccatggcacgacgtcagggcaagccacttttttgataattcaactcacataataaggagcagcttattgatgcttcttggtggtgctttggcctttttcatggtatggatcatgtacccacttgtcagaattagcttgctaatgatgaatgtcgccgtgcaccaataatacctgcaatgagtcctttttttcttcagtcaggatacactaacagtttttattatacatgcctgctgattatttttgttgtgagttgtcatatcatgaaatgtatccgtaaaagatgatgacaaggacctttccacctgcaggttttgacagaatatgttctggtttctgtaacaagtgctgtaacagtgaccgtagctgggattgtgaaggaagcggtcactattttggtataactaaagcttgatttcactttaaatattcattatgtatataattcatctatgttcatgcatgtgagtttgagtcaacttgtaacaattaaaactgacaggttgctgtgcttttcttcaatgatacatttacctggttaaaggggcttgggctgggaataataatatttggtgtcagtctattcaacttatacaagtaagtcaatgttcccttttctatgttgaaattttgttttcatgttaactcgaaacctattcatatttctaatcactagattaacttcaagtcatcaactgtaccacaattctaataatgttggtgctttcttttcacttgaacctttattactacctatcgcattattcaacaatatttgtttggcacgtcagctctttgtgtgagagggtataaagcaataattagcaagcatttagcatctctgtttgctatgtaactagaagcaaaattttattttctaatgcatccgtgttgagtgaacaatatttcctcattcttctcccatgatatgcgaaggtatcataggttcaagaaaggccatcgtaataagaattgtgacaagaacccccaaacttctagcggtgcttcaaaatatgttatccttgatgatgacgatatggaaaaccagggtaattcaggctgatgtcatcaggtgagtaagaaaatatgatggataaaatgtttgttcagttttttatatttctcattgttggcaattggcttgacagtggcacatttttttttcccagagagtggactatttgatggattttcatattctggaaatttagttacctatgcctcctcacaggtgactaccatctatacatcttgccttggtatcaagtgccatcgttttttatcttttctgtgcttccacgacttagggaagttgtgttgttattcatgaggatgagcatgaacatgaacatgacgcaaa

SEQ ID NO: 52286 - DNA, 1501 bp, Oryza sativa
taccactattgattgttggcgagcatgttcttatccagttgactttgtgtttttcgccaacgaggtttttcgagcattcccataggaagtgtttcctctactactcgtcgagtatctgtatctctaagcatttcttgttgactttaaatgcctgttcactttgatgccattttcaaccttaccaaattttggtaaagttgccaaaacaatggctacatttagtttgctaccaaattttgttaactatataataaatcttgctaaatttttggcaagttgccaaaactatgccaaaattttggtaatggtaaggtttttttggcatcaaagtgaacaggcccttagtgctgtgagtagatatacctgttgcaacatgagtacagacttgataagaggaccggagatcaggcatgatgagtatcaagtctaaactagtcgcaaaaatggacgctttggagaagaccagcggtaaaggtcatgccaaattgccaacctacttggaccgactgaccgacaacgctggatgggccggtgctatctccatgactccatctgctgggccgcgcaccttcacaaatctccaagcgaaatcatgtgatacgtcaagtgcacgtataccaactcagagagaaagaaaagggttttccatgtggggaaaaaaagccctgaaaatcccgtaaaaaaaaaaagccctgaaaaacagcgtcctcctcgcccgcaggggaaactaccactaccagccgcgaagctgcaaagctaaccgctcgggaagtcgccgagacgaggtgttccgattttgacttgctaccggaatcctcgctgaaagcaaaacccccatctcccgcggcttctcgtcggccgccgccgcggtcgctcgccgtcgccgatgagatccatccacgcctctcttagatccaaattgctgtagagccggcctcatcgccgtagcgccacccgcgtccatgggggactgcgtcgtcgtcgagaatggccaccccgtcccgaaggaggaggacgcgccggtggtagccgtggagcgcctcccggagggcgccgggaagccgcgggaggaggggagtagagggcagaggaaacagggcgggatccgcagggagccgtcgttctcgcggtggtgcaaggactgctccgccatgtccaatgccccccctgggggcgcctcccctgcctcggcggccagcgacgacgattccgaggagttcgagcttccgcttctgccctccgatagtggcggcggcggcggcagccacttgccgatggatattgaggcgggggcagcggcgagatctgatgacctcccgatttcgccgtggttgatcgcgaaggttattgcgctaattgcgagttggtacacgctgagcacctgcttgacgctgtgagtagcacgctttttttttggagtgtggatgattagggggagtatgtgcttgagcacatgtttgatgctggtgttctgtttgtgctcgtggggcgtgtgttcagg

SEQ ID NO: 52287 - DNA, 1501 bp, Oryza sativa
tgagaaaacgagaccgagaaaatgtggcgtgcgtcgcatggtggagggagggacagagatgtggcacggctcggcgcgtcgcgtttggctggacacgaggacagtacgtacgcctgcgctgacaagtgggggatcaccatgggaaagagaagcgagcaaatggggatagtgtcgtgcattgagagagagagagagagaggcgatcgactgacgacgacgacgcaaggaaaagctacagcgggtagcgagggacgacacgcagcgagcgagcctgcgcaaatgaggaatcatggcttcccccctcgaaaggtcggcatctttcgcgcaaagcagccgcggtcagcagcatcacacactgcagcagcagcagcagcagcagcaggagagaggctgggaagccaagaccaagagagagaaggcaaaaggcgcaaaggggaagaggggagcacgaccaccctcctccgtatcattgccatctactgcccccatcctactactactcctacacccgtctactccactccacaacctcttcttcttcctcctcgcgtgcgtccgggcctagctgtagcacgagctcgcctgcccatctctctctcttcaccgctttgcctttgctggcgttgcgcgttttgccacactcgctgcttcttttttatacttcgggtttgggcgggtgccactggagacattcgtggggtgccattgcggcgtcttctcctctctcaggaggtgagtgggctctgtgctcttggcttgtctctcagctacttgcttcttcttagcattacccattttaagtttttggttgttctaatccggtgatcttgggtgttccctccggcattgccgatgttcttgagactacgatcacacattcatatgcatgggtgagtgatggtcttcgcttcttgtgaaaatgcctcacctgggggaaggagggctggtactagtgctactagaggggtggcgttcctgttcccttgttcgtaggcattcgcctggagttgtgtttgcatttacaagctgcacggcagaggatgattgccaagtggcatttcgtcgagcacgtagctgatatattcgtggtgacatttactagtactagtgctactactctccgcgtagctttctactgctactaatcctagagacatgagctgtgtggcgtaaaaacacaaaagccgcctgctttcttgggaaagggaggtggttttggccgccatggggacccaacacccaagctatagctagccaatgcattttgaacctcccttctccacgaattcctattttattttggctctccactttgactgctgctcacactgcacaccgtatgaaatgatatcctctgcctctgttgcaatggtatgcaggcatttgtgacatttggtcgatggtgaagtgtggctaagctgctcgcttggcttagtactctggaattgaggttttatcagaatcttggcattcagattgcagctgttcttgggtttcttgg

SEQ ID NO: 52288 - DNA, 1501 bp, Oryza sativa
tacaatatattgaatattgaatattgaatgctgcatcaagacacgggatgaatcatcacgattcttgagttacattgcatcaatatttttctgaaatgttcaacatctggtcctattttccccatataacagctggtaacgcacatcacgtatgaccattctggtatatatcatatatgtggttcacttgatttttttttatttcaatactagagtgccaatcttctttatgtggtctgaatgtgccatgaagaaaagtatgtcatgcatatctcattgaaaaaagataatgtggttcacttgaattttgatttcaatacaagagtgccccgagatccattatggcgagttgtagattcatgcatatctgtatagtatccttgaaaaaaaaaagtcactccgcagatgtgtgcagtttgtacattcaagcatgccattcagaaaatcattaaaaatgttcttctccaaaatgacattctggaaaatgatatcagttaaaaccaatgtaccagttaatttatattacaaaaacaatggatctccattcaccataatgagatttttacaaaatggtatgtctgttacatctccatactgacattataccaaaaaaatgcacatgaactaagattttttacacaatccaacttttctttctccaaatataacaaggtcagaaattagcatcactaatcactgatccggaatcaagaatcccagctcacttgctctgccatcttaatcagtcgctccagattcctgctcacgcagaaagtaggaacgcggccaccacatgcctcacctcatggccgcctcgacgcgtgccctcaccatcgcagccacctcgctgcttgccgtgccagtgctacatggtaaaaacgccagcctgctcctcctcccttctggcttgggagctcaaccgcgccagccgccaatcccgcaggtcctaggagccgagccccatgtctatgaagccattgcagagcgacaactggtgcagcggccatgaaagtggctgcctgatccggcgacgaggctcccgtcgacgttgacctcggctgttccttctacttcctcaccggcttcgtccgaccgtgggggatcgggagcagaagggcatttgagaactggagaggggtagagagatgattgaggaacaggggcgtccacactccacaatttccccatggagatgaaggggtcagtggatgaagggcattttgggaaggacacggtacaaagtgcaccatccatcagcaattccgcagcgcctaaagggaggaaagcaggcatggtacatcctattatcatcagtcccaagattcgtgcaggggaatggagggtgtagattgcgagtgcatgtgcactcgggtgcaaataatccaattcctatatatatatatatatatatatatatatatatatatatatatatagacataataatccaattgtgagtaataactaaaacactccccctcacaccctacccccacctagg

SEQ ID NO: 52289 - DNA, 1501 bp, Oryza sativa
cccagatttgagggatgatcgatttttgagatcgatatatagccgtcactcagcaacggtcgtgccccacgggcggcagttgatgctcttcgttgctgaagtcggagatcttggggatggacaagccatactctctgagatggccgacgacgaggtatagccagaataggcactcaaacacaccacaggtgacgaagaaccggcgccacgacacggacatgtggtggtcgagggtcccgatgagcaacaaaaccacccaaaatacgaggaagacagcggtgccgatgactgtcagcttgaattccctgagcttgtgtttgtacctggcgacttggcgacgcacctccgcgtccacgatctcacgcgccgtctcatcctccgccgtatgctcgctccccgggtcctccgaaaccgctctgtttgggccgctgccgccgtttccaaggcagagtaccggaataatctgcgtcttctcggccgccatctccaaactctctgtacttccggacccgccgctcattacgccgacgacgacgagaaacgcgccggagactcgattcgatacagctcgacgacgaacgcgcggcgtagggcgcgaatcgacgaggaggaagaaaaggaccagcgtggtctgggcaaattaagaccgagtcggtgtcggttttggagttctggacgacgtatggttgggctcggctcacattgcaaaggcccattgatctgtgagactgtgacgatcagcagcccttttttttgggaaaagctagataccggtatcccgtccctagcatccacgacggtatcttctttttccttgttcccagagcacgagcacacacatgcagctgcggagcagcgctagcatcgggcatgcgacaacggaggaagaagggagctcactggagaagctccccgctgcctcgcgagcacatcaacagagaagatatgcagtgccgcgggcgacgcgttccggcgtgacggcggagcacgtggccgctggtgacgagttccggcatggggcgttgacgatggaggtgttaacagtgaaatttggtaagccctgagtagtcatcggcttagagtcagcatcggctttgaagtcctgagattagccgatgagagttgtcaagtcgtcagttgtcggattcttactatattcggttaagaaaattgatctactaaaggaagcttatccagaagagaccgagttcaaagagaatgcggcatggcaagttatctattaattaggaatagtttgttagttttcttttatcttgaggaaaatgtgtttagtgtcctataaagactttatcttttccttttatctttagaaaagtttctttcttgtccgacaatgacttgtatcaacccatgggtataaatatgtacaccaggggtctatgtaatctatcgctacaatcaatacaattcggcgcatcgccaccttttaccttttctactttattttatcgtccggcgggacttggcacctgacgcgggg

SEQ ID NO: 52290 - DNA, 1501 bp, Oryza sativa
cgcttttttttttcatgaaggttggttacttgtgaatttgtgtttgacagtataaatccgacacgggtattcttcagttttctgatggttttgaaatttttgaattgtcggcctttctattagagatgggattgtctagtagtgtttgaaaataccaccatgatataatgaggtgatacccacgtttgctttgaaatacatgttaaatctctactattataaaaattgaagatgtttttaccgtattttggtatgtcatccatatttgagtcgggttttaagttcgtttgttttgaaatacagatccatgtctgagttagattttaagcttgttcctgtcggaagtataaacggagtcatataagaaatcttttaaaaaaaactcgtatgctaacttgagatgaaatacgtactcctaataaatatcctaactaaaccataaaacaataataaaattaaaatagcatttatctgttacaatgcacgggtattttttagtattataatataaaagataataatattatattctaaatgatgtcatgtttgaatgaaatttaagatactcttgagtagttattggtacaattcaattttttttgagcgattcgatccgccatgctcgtagtttttgacgaatctaaattgtttggttagactccagctataggaaaggtggattcgagagatggagttctgctaaacagggccttacatgatctttattttctaataattgctagtagatgttaattatatgtaaggtaggagtatatatttattgccatgaacaccaatataaccattggggacgctatatagctaggaagtgactatgattataccggtcatcgataactgagtggtagtaattatggatatccataaaatgtgctgggaaacaatactcgttgatatatttttcactctgctaccaataaccatggttcattttaaaacatagattatgaaaacacgggaataaagaaaacacataaatgaagttatagccccataggtctataggaatatttaatttattatgtttttatttcagtcctattcttttgttgtaacttgtaaagtctactagaatttatttttaaataaataatgaaattccttgatgcaaagaatccgtaagcgaagccacctgatccaaagcggacgctgctatatagcaaaaaccggctcattctctcgagtccgagcagcaaaccaaaaaccaaggctctctcccactcgaccgaaccccctctctctgcttcctctgctcctcggagagccgcagccaaggacgccaagatagggaccgaaacccccgccgccgatggcgacgccgcccgcaagcggcccagcgccggcgacgcgcccgccccagcccccctcgccgacaagcgccaccgccccaaccccccgtcctccggctcccgcgaccgcgaccgccaccaccgccacggccacagccacagccacggccacgcccggccgtccaccgcgg

SEQ ID NO: 52291 - DNA, 1501 bp, Oryza sativa
gaaacgtcaggaacacatgttgtatctgacatgaaagagcaacaaacaaaataataagaaaattatgtgattaactgctatatatcctcctggttatgcatgcttttagttctgttgcaaagagtgacgttgaacccccaccaaagaacaatctttccaatttccacaaatgacagcagcatttgcacttagacaatccaaccaaaccactcaaactcattctcaagcaatgcaactaaataaatgaaaatttaaaataccatattattttgccatggtttattaaatataaattagaaaaattctaaatcgttacgagtcattcatgttaaaatacattttcaatcatgtgctataaattaaataacatgatatggttagaggtaatggctagcacagcatgtgtatatatcagaagcccatgtatcagatgctaaaatgccatggcacatttaacaatgtcctcgataagcaaaatatgacttatagagaaaaccgtaattttggctcaaactgaagatcaagacagagagaacaataattttgctcaatctgaagaccaataactgcactgaaaggaaattctaccattataagtacgagaatcagtccaccatttgggtaattttgtttggcaaaatttgctacaggacacgtaaaaaacatgtaattagctgggattagctgggagacaccgcgaaaacgtgatatggctgatggacactacaaaaattgtgtaattggttttaggacactggtcgtattattttattatttctgggtcaaaagagatgagatattttcctaaatacccggattgccacttctctttcttcgttttctccttcgccgggaacgcgcgcggtgagggtgaggtcggcgaggtcggcgcgagcggggcggtggggtgagctaattacatattttttgtgtgtcttgtagcaaattttgccattttgttttactaattacattatgaggcaagtactaattgcaagcatattctcattttacccactattatcttgtaaaaagtcgaaaactgaaggcattcctaggcccctgacaagtcttgtaaatcaaatatgttaaagataaaatagcatgtttatcttctttctgcttttgccgatctcctatccaatcttcccgattctgttatacatcggttgagagattctggtatggatgtagctatatatgtacacatgttccgtgattaatcgatatcgcgttgagctatccctgctttcatggtatcagatactcccgatccaatcgcttccgctaaaccctaaaacctcatcgccgacggctctctctcctgccggcgcccatgtagtccgtcgacgacacggctcttaccgcggcggtcgcctccatcaccgacgccgccacctctgccatccggcaggtccttcggcccgacgactcggcctcacctgacgaccgtgccgccgccacggctctcatcgacgcgacttcggccgcgactgccaag

SEQ ID NO: 52292 - DNA, 1501 bp, Oryza sativa
ttgctttttttttttctcaaaaggattttctcagcatgtgatggctggctatattgatcttttgtggatatttgcattcagaccatttccatccctgggactattaagcactattatgagcatgcacatgagggactaagatcacaaaaacaacgcacgatacactagtaatgaattttcttgcaggtctattgttccctgtgcgggaaattattacctgcccaaatcggaataaccacttgtgacatcacaattaagttggaatatcttgggctgggtggtctcccctattatgtcgctgccataatgaaatgatgcttttggagacggttattctggcagatgcgttagcatttggcacagtatctgacagggaacatatgagttgtaattgaggtctcatggtttgctagtgtgattactatgaagtagtgagaaggagacggcaataggtgtaagctgacagaaaattttgatattgtccctttttttcagatgtctcctatttatctgttctttctattccacatatatgattaatatgtttgcaaattatttggtactgtttatcttggtgttagtaattttttggtgcgaaaaaggagaagaaattgcaggggagcaaagtgccacatgctattgtggcaactaacttggttcttctcacaaggaattcatgtccatgattctatttctactgatgattcttgatttcacacttctcttactagccgagacctcataattaagagtgatcttactttcgcagtttatggctgcaggtccatttgaaagaggcaagatgcagaaggcttttgagaaggcagttcttgctctgaaagttggggagataagtgatgtggttgatacagacagtggggtgcatatcatactgaggactgcctgattacggcggcagtacgggccttctcaatctctcattctctatacactccgtcgctgtctgcaactctgcatatcatattgaggctgtttgggggcagaagtatgggccttgtcaatctgtatacactggggaaattggatgttggttattgcttcgttacaaacctgtgcatgtactctcgatctgcgaaaagtttatgttttactcttacattttgctggagacatttgctctggaatgatgctcaagacaacctatgaatattgattgttacaacatgtttggaattagctgaactgagcaggaagttatcgatgcattcctgcttacattcttgtttttgggtcgaaatgcgagctcagtcagatgatgaattttaaaaaatttctacacaaatccagctgtttggtagagtttgccactttcgaatgaaattcgaacgaaatcgtgaatctgacaggcgtacgagtgctccagcgtacaggaggcagctgccgattggatcccgcaaacctcgcgccttttccgcgattcagccacgtacacgcaccgtccccttcctgggctcctcttcgtcttgctgctgcagctttc

SEQ ID NO: 52293 - DNA, 1501 bp, Oryza sativa; identical to SEQ ID NO: 51968

SEQ ID NO: 52294 - DNA, 1501 bp, Oryza sativa
ctattgtgtccatgaaccaatcatgacagaatatcctcgcgttcccgagggagaaaaatcgaactgaatgaagctagagtttacacgaaattcgaataaaataatccaaatgaactaggagtatatgtgcattcatatgtgtatttggtttccttctaatatactccatccgttttataatagtcataataaaaaaaaattagatgtatatgacacatccatccaaaatctcttatattatgagatagagggagtaacaccacgtaaatccatcttatgtcgttacaaacacccttttattcttataagtagttaaaataaaacccgtattttaaaagttttagagggtgtctcgtaaagacctgtttttgcgtgtggttgtgatgtcgcgcgcgcctaaaaattgtttcaactgtttacagatatttggggatagacggttgctacatccatatatgaaaaatacattttagctgtttgcaaagactttctgtagtaatgtgagagttcaaaaaagaatatgggtatttggtacatggagtatagaagtcagctaaacctctatctttctttcccctgcgtaccaggctaccagtagcttacatttcttctttgtaatttctctcatcaaaatgcaaggttgaaaaggctatatacctactagctaatagtatctctcaagatcaaaacattgtcgaatcacggatcaaaataacgtcagatttcaccattcaaacgcagtactgaggctatgtttagatgctaccctaaaatttttcatcatattatatcaaacgtttgaacacctgtatgaagtattaaatacatgctaaaaaataactaattgcacatattgcgactaatttgcgagacgaatcttttaagcttaatgacggattaattaggcttaataaattcatctcacggtttactgatggattccgtaattttttttgttattagactatgtttaatactttaaatgtgtattcgtatatccgattttcgatgtgacacggtaacaaattttacccttggatctaaacacagctataaagcaccggacgaactggattattttccctgtcaatctgatcgacacacacctctcataacgtaacattattcacagagaactgaaaacacaggcaagtttgaagaagcaacatggtaccaactctcacatcacaaccacaaaccatgccaccaccatggttgcctccaaatacagctcaatgaaagcatcaacatgcatgctctctctctctctctctctgtgtatgatgagagagaaggcttgcagcttagctaaggatcggagaggagaggagaggaggaagaagcgattgccataaggaggcgcctgcatggtagtacgcccccttgcgtagtccccacatgcctctcttccttctcctacctcgtgtgtcaacttcacttgtccatctccaaaagatatccatgattctccctcagagcgccccaacctatatcacccccc

SEQ ID NO: 52295 - DNA, 1501 bp, Oryza sativa
accctaaccctaacatctcattattgttccttaacattactaacgctgatatatactgtaaaaaaacttcagcatgtacaaattgatgaaaaatgttcattcattttgaaaataatttacatgagctcttcctactattcttctgctatatattggctatttagttcaaccgcttctggatagataaacctgtgactcgggggtggagctagtgttatagcaatggtgtcacatgacaccaatggtctttgctataattttgacaatctaacgcttttagaaaacatatttgaaaagagaactatatcaaaaacttatttcaaaaataagccgtcacctcagtccaatggctctgtgccagcaatcatggcgctaaccctatatatctgttaagtgagagtatatgttcctatcgtacataaaccatcttgtaccgaagtggtgttggtcatccgtttttttaaaaccacaagtagacacgtggtttgatcacccggttcccatgttttttttgtaaatttttgcgctatttcccgtgagcgatgatcataaaggcaaaaaatacgtcgagggggagattcgaacctgggacttcgtgacatctcactaagcaagtgaaccactacaacacatgcaatgaaatgctcaaatttagcacacgctgtgtgcgcggatggcggagtttcggaaggttgccgatggcggtgcagatctggccgtggctgctgtgcacgaggaaggagggaggagtcggcggcgttaggatggaggtcgccatggtcatggcacttcgacggttggccatggcgggggcaactcacggtgtcactgccggtgtggcggtgtcccctgttcggatcgtggccgatgcatatggtgcaagagatgctgtcgcgacatgacgaggcgacatccctcacagttggcagcatgtagggaattttctgggcgttggtgttggctcatgctccactggtggataggcctccccctgctatctacagtaaaaaaaactttcactaattgaataatcaaaatttcaatatttggtccaagatatagcgaaatacccatgtatcaacttatggcatatccactcgtggatctatgaggctatggaatggtgtatataagggatcctttgtgcgataacgcatgaagcgaacgcaacctagttcaatctatatgtgattattgaattatttccattgttttgtctgtcttatttcggttttatcgtttaaattggcagagttcttatcaatcatgaaaattatctttatctgttgaacgcacaaatatttttgctagtccttaaaaaggtacaagggtatcatattttctattgcctttgtacttccagatactaagtatctcaaaaaaaatatatcttgatgtaccaaaatttgtttttagtgtattccaagtttccgcatcctaaagcaaaaccatacattatacatggaactccagaaccaccactaaagtatataaaaaaagt

SEQ ID NO: 52296 - DNA, 1501 bp, Oryza sativa
taaaaaagaaaaaacaaagccacgcagtgttgtttcagcagagagagagagagagagagagagatgcgttcttccagaggtgtcattcgccattccgtgtggtgtctggtgtttgtatggtcatggcgggttgcagcagctcaggatcaacaagcaccaaaaactgatccagtcgaaggtaagcaagccagcaatcatgtacggtgtgtattgacgcaccacgtatgtctatcttctttcgttttttgacatttacatatttaagatgtgaaatttaataaattatcatctatagtcgatgacatgtgagcactcatatatcaataacctaaaagtgacgaatagttaaatgtctcttggttttcctccatgcgtatagttagattgcaggagtagtaatttgtggttgtgctcgatatatgatgtccctcgcactactacagaacacctgttagagcacctgttagagcatccccagtagatactctctcccgtcctccttacatgaaatagcgtatggtgggagaaaatccacctctgtagcggatacgccgtttgggcatccaaagatagctcatgcgctatcccgaagagagaaacgccggatatggtctttctctctcctcacgcaattccacaactgctgctcccaccctcatcagatcgagctatggaggggtgaaggaatgaatgtagagaagagagagaggatgcgctagtggccaccttagtcggccggtcctgagcgtcgccccatgatcatatgagccggccactcccgacatcggtcacatgcgcctgccctgcacccaccgtcggccaaagcgccacgcgcccacatatccgactctgccctcccccctccttctatagactcctctaagtaggcagacgcccgtggcatctcccctgccgtcctcactgctcctgcgcttgtgacttctccccccgccacccgtgccgaccctccgcacgcctgctcgcgccgctcctccgcccatgccgccaagccacttctctccccatcgcgcgccctgttactcccacccattgaactacccgtcggtggtcagccctcctcgtatgtccttcccatcctctcaggctctcagcattggatatagaagagagagaaaggtgaggaagtttttttagaggttgaattatcaaatttctcaacagttcttctcatacattgtctatttttgatttttgggagtgttgaaaggtagttgaaagatattagtaaaatataggtttttggtacatggagaatgtaatatgaatgatctattggaatcaaaaggaaaatggagtaggaaacatttttgaatggccatccaaatgggaatatggaggatgaaatttggataagctggggatgctattagggaatgatacatgtataggtgccggtttctattgagaaagagttagaggaatttgatttcattaatgacctagctatcatccatatgattattagtggtgagttaattag

SEQ ID NO: 52297 - DNA, 1501 bp, Oryza sativa
tgatctgtctctcttccgctccaaatcccccaaacccttcgtctccgccgccgccggaatcgggcctcgccatcggagtggcggcgaggagttgaaggccaccgaccgccggcttcgaccacgccgcctcgtcctcgtcggatccgcgaccagaacgccgccacctcgtcgtcggttccttcgcgcagatcgccgccgcgtctcatactcttcggtatagcaagcaagctctcaacgcctctttttttgggttccctaatctcaatctgctgcttggattgctgaattagtgaataatgctgggcttcgatggtggattttctgtcggttgtcggctacggggctgatccagccccgttgccatccccggggagggacgcgccgagtagagcagcttgcgaagtggttgcggccttgcggggagggacaccgagcagagcgttcttgcttgctggttgggctgccaatctctggctatccgtgatctttgatccatgagattctgttgctattccttcacatggaggtttgtgttgtactttgggcgaattcggatggatgttggattaggcagggttttagagagcttgggttaagaatcctgcttactgatgcacaatagaattaaggtggggattagaatttgctaagctgaaggtttgagatcagggggccagcactgctccttggttagcttgttaatttgatgatgaactactagtgatcctgtagcatgcatctctgttttgctctgtatactcttgttagtgtgattgcaaggtggttttcttttgctactgggcagtgtactgttgattcaaaccaactcatgttcaggccacctttagctgctaccccgttgtttaagtcatcccctcctcatgtccaggttgctcccagtccgcagccacctcttcctcctcactgcattgtgttccctaggtgaccttaggccttccttgctgctacctccacctgtctctgatcccgagtcctgaccacccccttcctccttgcattgccatgacactcttttgagatcattggctgcatgtacatttctgtctttggctttggtgcagcttatcagtaaattcgcatgccaaacttggtggttgcatattgcagcactagagtcgatggaatgacctggtgacagtatggttaactatattttaaggtctaacaaaacggagtggtcctatatctagcagtttctttcagttagtaacccatttgttcaaccatgagtatttattgttttagaaattgttctgttgatgtgcctgttaagttcttcactggaaagtctgtaatcagcattgcttctcttacacatactatgcccaaagatcatagagttgttcgaccaacagctgaatagtatacaaatggatttttttttctgcttgttttttctgttagtgatggaccagcattgcttgtttctgatatatatttgcattctgctatggttccacaggttagcattcgacagcca

SEQ ID NO: 52298 - DNA, 1501 bp, Oryza sativa
gatccttcttaagaaccagcaacactggagaagaaaaagggctagaactcggctgtataactccctgctgtaacatatcagacacttgatgctcaatctcattcttctgagcaggattatatcggtaaggtcgaaggttaactggatgagctcctggcagtagaggaatagagtgatcaaatatccagctggtggtaaaccctgaagttcgtcaaagacagcagaaaattcctcaagtaactgagcaatttctgtaggcagagaagaagatgacgattcttccaccaacgaacaaaattccacagcatgcaacaccgcattacgatggactagtcccttaacttgattaccagtgatactagggaaaagagcaatattagctgaaacacctttaagacaaactgcacgctgcttatactgaaactgcaaggttttcgctcgccaattgatttgcattgggctatgttgctctaaccaatccatgcccaaaattacatcatagctgccgagtggtaaaaccttgaagttagattgaaaggatatcccttgtacacaccaaagacaatcctccaactcagtaacacactccaaaatacccccatcagcaactttgaccttgataggtgacaaaacatgtcgctgctgagtccatttatcggccaatccctctgaaataaagctgtgtgaactgccagagttgactaacattagaatttcattgtgttgaatcaacccttgaagtctgagagtaccacttgtctcagtgccttgcatagcttctttggaaatctgacacacttcaccttcatattcagagttaggaataacagcagaatccttctcctcatcacccctctctttagaagaagaatcccggaattccaatagctcttccaccacatgaagttgcacagttggaccatatttatgatctctgctccaacgctcaccgcaagtgtaacagagccccttagccttgagaatagcatgaagagcagctactttgtcctccacccgagacatgcgcttatcagaacgagttccagctgccaaaatggtacgaggttgtcccactggaaacactgtggccgaacaaaaattggtagtccgactgctggaacttgtctcaggacgacgagattccctcctgatcgcctccaacacctcctcctgtaaacgggcaagatccacagcagtacccaaatcttcgggtcgatgcattataacagccgctctaatttcagctctcaatccttccacaaactgggtgacaaagaacattgtattccaggatgggtgattgttcgtatttcttaacgtcattactagaaatataattcccagcaatagcgcagaaatacttctggtatattatggttacagagttcatccgcaagcgcatgaatataccattgtagcatttcacccgagagtattccaagggtatcgtatttattttatcctgtgggaagatcatgtagagagaacttgactaataatt

SEQ ID NO: 52299 - DNA, 1501 bp, Oryza sativa
ggcttagattttcaatagacaccgaatgagattggggcttagattttcaatagacacctgatgcaaagcaggtcatgtctctgacacatcagtatgcatgataggacgtgtatttgagaaatgtctcattatttaccctctataactcgaataccatgaattgtttagcttgcaaaaaatgctggattttttttacttttttttttacctttaattgactaggcattacatatatttcagaattgtcatatattgggatgaaacacaagcaatgttaatttgaagcatgtgactgttgtctaggttcaaattgttaacttttatatattaaaacctaatctaaaggatgttctaatgtgttaataggatacaaacaaaaataattcaaaagtatggctgtttatggtataatatattggattgtgcttcattttgggctcaagaattgaactgtagcactacactcaatagtaatgtaaacatttaatcaggattgtgcttcattttgggatcaagaattgaactgtagcactacacttaaaagtaatgtaaacatttaatcaggctatctcgcttcgtctcattttgaccatttcctgccattaatgactctaataaactttgatgattcaattcaaagtgtcctatagaacttaatgaccaatatatcatttttaacatattaagctatgtggagcttatatcacttgttaacacatgactttaaaggatgaaagtaagacatgaaacaaatattctatgagttatatgattcatctcaacctttttttgctttgaagtacaaagagtgatctctaattgattcagcaattcacaataatctctaatttattcagcaattcacaataagctcatgagatactaaagcatttatttcaccgaaaccaagtaatcagcatatgcagtaagcatccttcaaaggccacgtctatatatatgtaatcacacatgcatgttgcttccatgattgttatatcaccagtattttttttagtgatatcaataccatgctatgttgtgataagtccagagtccagagttggctccttgttccactcatccttatgctatgttgtgataagtccagagttgactccttgttccactcatatcctttttgtacgtatggacggataactgacaaccgtatgaaagtgcatccatatcaccaatacaacactccttttccccttgcacgtgcacctttctttcttcgtgctataatggtattcattgttgttttttaaatggatcaacaatgtgaacaaaatattcctactgccaatccagctaatgaacagctaaattggtattcatatcttaagtatcctgtttgtgagatgacatgttagttgcagatttacataggactgaatgaagtactttcctcgaatcttgattgctggtgcctggtagctgatatgttatggactgtgaaatctaagaagttaatatggatttgcatatacaacgtgtcaaa

SEQ ID NO: 52300 - DNA, 1501 bp, Oryza sativa
acctaaggctatgatctataaatctttcccaacttctcaacggtgtaatttttaaaaagaatttaaaaaaatatttatagaaaagtttttaaaaaattatattaatttttaatttttaagctaagaatatttaattaattatgcgctaatccgtcacattgtttcgcatggggaggaatggatttgaacccgcgtttgcatgccgagcaccgtgtggtggtgttggcatttcgtgcattaggaattgggactgtctgtataactttgtgggccacatttggatcgttgatgtcagaaatttaaatggactttcctcgcaaaaaatgcttcagttcgtaactccatttgattttgttggccagacatgattgtgcgtctctttggactgggcctagcgggttcattggtttgtttttttttctttccctgcgcactgacacacgggagtagaagacaaaagatagagcaagtcaatttcttgtcgacagaacctcatacagcggtcaggcatttctcactccacaccaacatgaacatcaatattggcaaatataacagaccgctgttgcattacaagtcaagatatattacacacacaaatcattcattcattcattaccagtcaaataacaacaaaccaagaaccaacaaatgtacattataggaaagctgttgctgttcttctcccaagttccaaccataccgagtattccaacaaagaataaaaaaactgacgaattagatggtggtgtgcggtgggaaaacaagcacaaatctgagtcatctcatcaaatgcttctatggcacctcgctaaaaactcttgctaggcgcactcatcatatatgccatctcctatctgcaaaccagaagttcttgtttagatatatgtgcatcatggatggaaatacagtctatcgtattattctatactgttcaatagatggtaacacaaacatagcaacagcactggtagatgatcatactgagcaagcacaaaaccacactgaagagagtaaaaatataagtacatgataatattcagggattagtgcattaccatttatcagtaatatagccagtaataaactgaaaacaatgaacattacatataaaggacgaaaatgttctgaggcgacactaaaagcaccactgaagagatcacaggtcgctgggaatgttcagggaaggcggattaccggtaatgcccaaacactacatttctatgttcatcttaattttaatgttatgcagttccctgaaatagcttgtgtatgcaagtgggtgcttcacaaaagtggacctcacaaattagagtagagtttaatgacctaaactgcatatcgaggctacaagatatttgttgctacagtgatccagagaaaaacaggtaatcattacaaatcatcttcgtaaactaagctttcaagtgcaaactgatcatactaagatcataggatgatagtagcaactagcaaaggaatagacttgtgcgcacttagt

SEQ ID NO: 52301 - DNA, 1501 bp, Oryza sativa
acatcaggttcagaaggatcacattttatgtgaatggattttgaagtcgacatgctgtccatgagctgacagaaggtaacaaacatgagaaaatccaaccaagaactaacgtatgataatcttagttaataagggttctttcatctaaccttcagagcaaatccattattgagtaatttctcacttgaagaacagatcaaagagtcctgcaaaaagaaatgtaaaatcatgaacaaacaagcaaaatgttcaagcaaggctactattcagtattgtcacacagaaacaagaattatatacgtgttaagtgcagcagataaggttttgatccaaaattaatgattgtgcgtgcatggaattcaacatcgagatgcgagatatccaatcaatgtagcaactaaagtggattgcctccgcacatactaaaccttaagatcaattgccaacaagaggttgacagctttcaggttactagaagaaggaacttggcgaaggaaggataagaagatcatagacttcacatagcatattaaacttatattgaataatattaaaccaagcttaactgactggcagcaaaagagtttatactgtctagatacaatgataccatacgtgtctaaatgagagtgccttgaatacctgaaactttcctccatattgctgtgcttgatgaacccggacaagtccttgcattttaacaatagcaagcaagcattgtaatgattctgcagcctgcctcctaacaagatgcccacgtatcacagcttgcagtttcacaaggtccttatcatttggtagttcttgctcttcctatagtcatgtaaatgacaataatgtaataacactaacagaaaaataattaataaatataaatagtgggaaatactgcaacatacagtgtgcactctgatgccagactgaatgacagcagcagcagtctccgcacaatcttcctgatggtcttcactgcttccatcaaagagagagacggtttcctcctgcttcacctcagttgatgaaacaaaaatactttcatccgtcttatcagtgtgttcctcaacatcattatcatttggctttactattggagtttcagttaccctttcagttggttcttggattggcacttcagttactctttcagctggctgctcaattgacctttcagttatctggtcagctgacttttcaattggttcatcagctggcttttcaattgattcatcacctggctgatcaattggcttctctatcagtttttcatcaggcatctcttcattcaaaggcccctcatctggtttatcttgctgcaaaattttctcgtccggtttctcttgctgcagaattttctcagctggttcgtcttgctgcagaattttctcatctgatttctcttgctgcagaattttctcatctggtttctcttgctgtagaggtttttctgaggcataggagtaagttgaagaatagatgttgcttggagcaatttcagcttttg

SEQ ID NO: 52302 - DNA, 1501 bp, Oryza sativa
caaaatattcttaaaacaaccaactctagcaatgagtacaggactttctcccttcatggaggtttgaaaaccatatcctgctcctgtatgtcgtcgaggatgagtgatattgttctttgtagacttggggcttgggaattgatttttttttccgttttgttgcaaccaaacatgccaccatgtctttaacaggattccgatccttgacctggtttggcttttaaggccagtggaccctagagaacacatccactgttagtggtggaaatgttaggattgggaataatccctttttcagcggcaattcttgcccatacctgcttgatgaagttgcattggcaaaacagatggtctgtatcttcaaaagcttctctgcataaagtacagatccagtcgcattcccagtgtctaattagcaggttttctgctgtaagagccttttgatgaagaatgagccttccaatttaggttgaaaatatgatcaatcaccgaacccatgaattggaagcggcaggcgcttttaaccgagaagattcatgaggcatttcttgtccaagatatttcatcatgatgttgatcagaaagagttatttgattgaggagggatcccaattgcactaattcatggatggtttctatattagtgatctgtctaaaagaatgtagccaggtgttgtctatcatttatgtttccaccttcctattctttatttttgccaatttgaagaggttgggagcaagatctttcgggcacaaacctggtaaccaattgtctttccaaaaaagagttttttttgccatctcctactgtgatttttgtgcatgcctggaagagttgtacatctcgcatattgcaaggcatctccatcagctcccaaggtctgcttgtatcaaacagccacaaccatcgtagcctaagcgtagatgtgaatttttccatttcgagaattcccagccctcccatgatgatcctggatgtgactagcttgttatctctcctaggtggacaacaatgctcattattaaaagtggccacttggaaccatttagacctacttgtctttgacacatatattagccatttacatcctggtcaatagcaggttgccctaaccttgtccctttcatcctttgggaatagaatatgtctgtgtgttgtcagcccgtacttcactagtgccttctttaactgcctacttgatctaaatgccatgctaagagagaacacaggaaatgatgccttttttgttaaacctattattagtgctcttccatctaattgtttctccttcactattctcctcataggagtagtcatcacttgagttataatacagactgccatcatcttctaagttgatattttcaggcaccagtgcatcatcaagtatctctacagcctggctactatgaactcctagcttccttgccctaatgtttctcttgattttctttgcaaatttcctaagttgttcagcttcttcatcatctccagagctat

SEQ ID NO: 52303 - DNA, 1501 bp, Oryza sativa
cacatcgtgtgccatgctgaatttccagcttcttatgtttatcgtgtaggattaattagtcactaaccaaaagaagcacaagccatgccattctttttttccttttccttgtataatactacattttattaatatctcataatcataatcatgtcgttagatggctaccatctcaaatttctaaatattccttaatacttgcaagatagatagtttgttaatcattttatcaaaatcgatatagatgaaagcctatttatctagacttttatctcggtcgatattttcaccgcttatgatatatttgctcaacattcttatcatgctaaatttcataaataaataagtatatgcagtataacttcctgcctatgttttttgttgtaatatgtttttcatgttaatacgatgcatcattacctaaagaaaacattgaaatttgcatataatctatctattatatactaaaagtccattaaacttcctacaaacgctctaaggctgccatgtggtatcctataaatgctcttaagtccccatgtgtcactctaaaaaattagtaaaatctgaccattgatttttatttaaattggtgggcccattaattttcatatttagatctatcttcacaagaaaaataactccgtccggacgtgagcctccgcgcgcacgtacgtgcgattcctccaaccaaccgttcctctcctttttttaaatccccatataatttaaattaaatacctttttatgggcctaaaaagcccatcaacctactagatctagccaacttcctatattctcacctaataaataaatagttcaatcaacatcatataaatatttctaaacacatgtccaaattcgctgttctcgcatatgccacatcctattttaagttcaggttttatgggacgggatgagtatatagcactcttaaattagagaaaaccttaaaaaaacattcgaccatctatatacattattttaggttattagatttatctttttctaaaaaaatatatcccaaacctccctccgcgctcctatgcggcgttaaagcccattaaccatcttataaaccacacagtgacactcctaaattataaattagagaaaatcataaaaaattaagaacaaaacaccattttgacttaaatcgatggacatatcatttaggttgttattagatttttatttaaaaaaactcacaaaccttatttcctcactctcggcccctgcaatgttaaatacattaaacatcctataaatatttctaaaccactactggtctctcttaagttaaaaacaaaacatccgaccattgttttcgacttaaacatccaacacattattttaggtcattagatcaatcatttttttaagaaaaaacatcctcctccctcccttcccgtccccgtgcggtgtgatgttccttttctcttatttttatattatgataattaaaattaaattaatctttatggaggaaaaaccacaaatt

SEQ ID NO: 52304 - DNA, 1501 bp, Oryza sativa
aatcgaagctgcccatggtgacgagaatacaaaggcgaaggtaattcacctcgctcttgatggcattgctcgatcttggtatattaatttgcctactagtagcatttactcatgggagcaattgcgcaatgtctttgttcttaactttcgaggcacttatgaggagccgaaaacacaataaggtcttctcggcattagccagaggccaggagaatcgacaagggaatacgtgcgccgcttctcgcaagcacggtgccaagtgcaagacataacagaagcctctgtcatcaacgctacttcgaccggcctacttaagggcgaactcactaggaagatcgcccgcaaggaaccaaggatgctcgaacacctctttcgcataatcgatggttatgcatgaggcgaaaaagataccaagcggcggcaagagatacaagccgaatatgacaaaacagccgcagccgagacggccaccgcgcaagctcacgcacaagctcaaattcaagcccaagttactagttcggcacccgttctgattcactcaacccctccggtgaatcaagggcagcctttaaggccgaaccatgccccgatgacatggaaaaatttagaactgatcgagctggcaaagcagtgatggcaggagaagaagtgcaagcccttcgcaaggagttcgacgctcagcaagcgggcggccagcaacaaccttttcgcaaaaagatcaggaaagacctatactacgccgttcatggacactcttcgcacacaaccgagcaatgccggaacattcggcagcaaggcaacactcaagagctcaggcagcagcaagccagggctgaagaggcaacgcgcgaagcggtcctcaaccaagcacctcaggctgaacagcgccaagatgcacagtgaagagtgatctaggtcatcacaagatcttatccccccctcgcaagtgtcgaaacgacaaaaaaagatgcaacttcgagcagtgcatagtattgtttcggcaggcgaaggggtcccaagatacttgacgcaacagatatccttcagaccgaaggatgctgaaggagtccttttcccacaccaggatcggttggtgcagagatggttggtattgaagttcggcatatcttgatttatggaggcagttcggctgatgtcatcttcgccggaacatatgccaagatgggtttgccgacactggcattgtcccaagcaccaacctcgctcagggggtttggaggcgaagtagtgcaagttttgggtcaagcccacctcaaagtcaccttcggcacacaagaaaacaagagagaagaagagatactcttcgacattgttgacatcccatacaattacaacgccatcttcggctgaggcactttgaccaagtttgaagcagtctcttatcacaactacctcaagctcaagatgcctagcccagccggtgtggtagttgtcaagggttcccatccttcggctaccatggtggccttatagatcgcca

SEQ ID NO: 52305 - DNA, 1501 bp, Oryza sativa
gactcctcgcaaagatcggcaaagtgaggttaaatatagttttgatgtggccaagtgtgataagattttttattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcattttccggtgaatacaattaatttcaatgataagaaggtgttgattcggccggagcaagccgaatctactaaggggaaggaagtggtcattggtgaaccaaggtccaagatgatagtgctaaagaagccggaggttggcgtttggaaagagaataggagtggagcttcaacttctaaagcccctaggaagaccaaggtgacttttaatatgcttttggagaaatatgaaaagcaaggtggtgagaaaattcgcaacaaagggaaaagaccaagatcacctcctaaggagcgatttggtcattcaccaagacggtcgcgttcaccttcgtatcattatccacaagatatgtcatggggttcctatccaatgccgccgtcgggttatccttatccttgcttcatgccatgggggccgacgccgccaatgttcaatcatatgcctcctatgcaattcaaccaagggaggggaggaccacggaggccaattcatgagcgtttgtcttcaccaaacaatagccgattttatggtaagaatcgggctaatgaagaaaagtgggaaggaaagcgcgtcaaggtggaggagaggacttcggaggtgattactatcaaagtggggtctcatgatgtgccaataccttctggagatggagttggagtgtccccaaacaagaaatccgaagccggtaccagttcttcgcagtcggccggtctgaccgcagccatacggctggtctgaccgggccatcaggccggtctgaccgccgacccgacagcggttcggccgatgcctcaggccggtttgaccgctcgccacatgttggtctgaccagcgcgtctggccggtctgaccggtggtctacggccggtctagccgggctccagcttcggtttgatgagagggctgcaaagggcgatgtgagggcttcatcgtcttcaagcaaagttaataaagggcattatttacctcctggaatagagccgaatcctaggtggatgcctaaggatttgacggctacacaaaagagaaggttgcaacgtcttcgggcccaagaaataagagagaaaaaggccgaagagcaaagagataaaaggtttaacgagttgcgaccaccaccggtatggaggcctaagtccatagagaaggaaaaaccggttgatataaatgagaaggaagaacaatcggttgacaaaggtgaatcatctccaaaagaagaca

SEQ ID NO: 52306 - DNA, 1501 bp, Oryza sativa
ttggttgcaatctactaatgctcacgtagatttgataagttggggtgaattctgtgagccagtttgtgctaagttcgggcgtgaggggtttcaaactctaattcgacagtttaataggctacgccaaactgggtatgtgcttagctatgctgaaaaatttagtgagttagtacacagcttccatgcacatcactgttgacggtcgttatcaattagttttgaccgtcaatattaccaaaatagaggagaactagtgatgcttgcaatgcatatatctgttagaataataatattccactagtattaggtatactaacctattgcagagaatgacaataaagtggaggagaatcgacatcaactcaaacgataaatcaatcaaacgatgtcgatgtcgcgcccagaaattcccgaatagaattccaagcagaatgtgcattaaattccccgtccaggaccggccggggtacacaaacaagaatgttgacattcagatcctcgtcttacaaacaccataaaagacttacataaatgcagcggaaaaacgaaagacaacaggagcaaagccttgactagatctgcagtgggaacaccactccacaggcatcctcgacggcacggacgaagcctactcctcggagaaaccttcatctgacacgtactcgtgctctggggttgggaaaaatagagcaagactgagtactacccactatactcagcaagtcataccggaataggggtatgatgcagggaattatcaaaggagagctagagtggttcatttgcataaaacgagcatttataaacagaagttgaaagatttaaacggttgtaataattaattaatattaactatccactgtccaacgctatcccacgttgcgacaggcccaaccatccacctaaactatccaaattcaaaagattacactagggtgagactaatcacggtgaatctggttgaccgcccataaccgcgggcacggctattcgaatagttttactctgatcagaggtgtagaactgtacccacaagacacagccccacgacacgttcccgtgcgccgacatgccaccacgacataccggaaagaggccgtgacaggacccttcgcataacccccctctaaccaagcacaccacacctcaggtttcatccccactcctcgcaaggcagcgggcagtcccctctcgtgcctaggtgaatccggaagccgcataggccgtcgcagggcccatccgaactccatcacgcccatccttgcctggatgcgtcggctagaggaaagctacactacaagcccagccattgcccacgctggcttgtgattagtatgataagttcttccagggcatcccgcgaaccggtccttaactgccatgggtgcgaccagcaaaaccatgcacccacagcccaccatgtgatttattttaatgaacaaacacaaagcggtggcactaatccaacaataccattagaaccaacagtctaaacattaat

SEQ ID NO: 52307 - DNA, 1501 bp, Oryza sativa
ccagtcgaacagttgttagttcatggtagcatgatgtgatcatcccagaagagtgtgtttttcctcgcgtagttgcggataatgcttctcctcgaacgtctgaagtaaggagaaaagtcggacaggcagcctctgacacacgtacacctattcaagactatatctctatctccaaccatataacatacacttttaacgatatttaaaacgaatttttttcttaaattacttagctgatctacaattcgatcacaccgttatattcgttataattaaatctttacaacaagatatcgcttgattatattccgatacaaaataatcatatgttttaatccattaacattttttttcttacgtgatagggacatgtttcaatatgtgtcttcagcgtgtttcacaaaattcactcacaaaactaactgttactactctctcctctctctctccacctcatgcatgcatgcatgcattttaactagtttcaaaacgatttttctcttaaactaattattcaacctacgatctgatcacaccgttgtattctttgtaattaaatctttaaaacaagatatcgcatgattatattttgatgaaagaaaaacatatgtttcgatccattaacattggttgttttatatgtgatagtgatatgtttcaacgtgtatcttcatcatgtttcataaactttttaaatgtttcagttgctgatatttttgtttcaccatatataacttgatgtttcacttgttagttaactggaacatttgactgaccgatttttttttgcatgctgcatacacaggtggtgtgatgacgtgtaaacagtcgggcgtccgatatttggtggaatatcggacgtccgatgcggagtcatctcccgtagttgcccgttgccaatttttttctacagtaactacaacttctctgatatggacaaaaatccaaactatttaggtgagtttctgtttatggaagaagctgcagctgttaaaaactctcccaaacatatccaaagatatttcctacgctcatctctaggatatttgtaggtattgtagggctagtttagctcccatagtcccattgaagcgtacgtgcacacaaccaaaaatgtttgctggagcagtggagagcacggaatgttagatagcacctacccttcaccgtcaaatcggaactacctaagcttatcgatcgggtgatcagttatgctaaaggcctgcagctagctagagaacacaaacgcatcgatgagtagtagttggaacgtgccactgcccactgcacgactttagttcttcgaccctgtgtgagtagtagcgaacccagcctctctatgtagcgtgctccacccgtacagtacgcccctccctatatacggatgatcacgcagtacacgctctccctatcgtaaaacccgcgaaaaccacaaccgaaacgcaagggtcgatccatccacgcctatcgcgcgcgcgtgcatcgggtcgatcgatcgaga

SEQ ID NO: 52308 - DNA, 1501 bp, Oryza sativa; identical to SEQ ID NO: 29807

SEQ ID NO: 52309 - DNA, 1501 bp, Oryza sativa
tcttggtaccaacaacactaatgttaataccctcattttcttaaaatacttatgtcatcgatgtaaaggggatcgatgctaatgataatggcaggatctatttgtcagtcctggaatctagcacaccgatgatgactgtgtcttaattctgagttcggcgcacgagctgatatgcacgccagcttcgcgaaggttcggcagagtcctcctgccgtcctgcgtggtgaacgtgcgcgtttgagcggttgagccggatttaacggtgaacaggcagtcggtgctatacctgtatagctatgtactcctagctgaatagctgcgtccagtttcggggaaagattgttgatcagtttgggaactctccgcatgtacctgcccattgaaccaggggtaagctatttttacgtttgattccaacctccagaactgagaatactggaacaaaaatgatctatagtaaaagatccagactagtaagagaagactgtaagaaggctaaatgctgatatggatgagagaggagaggaaagagaggagaaacgggtaataagcttacagccggcttagatacataaaaataaagggcttgtttggtttggtgccaaattatgccctaccaattcattggtaattttgaatagtgcttctatatgtttggattggtgccaaattttaccaacaccatttattaggtagtacaaaatctgtccacccaaatttggtagtgccaaaagttgcctaaactttggtactaccaagattttggtagggcaccaaaccaaactggctcaaaaatttgtgagagagataggtggacatatattaatagttaagagctaatcactatgtgagttggttaagaggtaaactgtaaagatctactagtatacagtaaacaactatttactggctatattattagccatgttctaactcgatacgttgattatgctccaggaactgagacaaacaatatcttttgcttttgtttcagactttcaggtgtgctaatgaccaggttagcatccctgtaacatgtgaaagtgaaacatgggattgtaagcattcccaatctcgtgttttcactttacactcagcagtcaggactagagcagtactcgtacggtggtagcacagcaatcagcagcacccagacttcgagaaacgacacaaaccgcttaccgatgccaaagtatcgcctcacctgcgaaacatacacgcacagtcacacactgacacacacaaaagaaagaaaaacaaaaggtgacacatgtcgatgccattcctgcaattttcgcccaactccagtggccaacacctaaccaaactgctatatattccaagtccgtcttgccctcctccaaccaacagctcgcgcgccaagcaaagagccaaagagagatcgaaaagccaccgccgagcaacaaacacagctcgctcgttccgccattggccgccgctcaatcgatcgttcgatcagcctcattctcgccgtcaacca

SEQ ID NO: 52310 - DNA, 1501 bp, Oryza sativa
agttggctttgaggcgatgccccttgggcttgacttgtgttaacgaccaaatttcataatctgagtatcaaagatagagatcagatcgaagcagaatctaaatccaagatcttttaggaaacagagcaagaatcggcaagagtccgaatcggctttgatcaggattagtagagtccgagttggacagggttagccgattgagccgaatcctacaatatgacaaagaatacattgtcgggttgagttaataagcttcatgatgattgccacgcatggatagaatcctgagaagacaattgtatctattaattaggatattttacgtaatttccttacagatatgtttgggcaaaagtctgccgcaaagacttatggtatcatagagtttgttagagataagagtcgtgtccgatgtgtacatattttgtaaatctcgggtataaatagaccccgagccccatgtaatcaaactaatacacattcaatacaatctcggcgcatcgccacccttttactttcgttttgtttcgacgagttcttgctttcaggttgagttgcatcgatttcgatcttcaacaagaggtaaaacttgttatggcgccttgcgttctcgggattagtgcttccatcttcatgatactctaatcttgtttatgtaattcgtcgagttatcatatatcttatataatctccggcaatatcgccatctaacctacaatcggctaacgtctgttaatagaaggcagccgactaggttaaataccaatgttgacttagattatataggatatctaccactctatgaaacatccaacggcttgattgtctagatattgtccttctttttatacttatagctgcatcagttgagtctgatcttatgagtcgtgattagaatctcaatctctagcctgcttttggttgccgattagggtagcatcggggtttcagccgatcttacctgatttaactacttttatcttatgtgcttgattgacatgttaaatctgccctttatgttaagatcttgtagcatttaagtatattaggctttcgtttggtatattttacttgctttaatatgttaatatagagtggtatctgttaacaaccaaatttggtaatatcggcattgggaaagaagattagatcgatgcaaagtcggaggcggagatcgagttcggaaacagagcaggaatcggctggagtccagatcggctacaaattggatcggctgggtctgagtcgggctaggtaagccgatgcagccgattccgacaatgcaacctgatgtatgatatcgggttgaattaaggcgcttcaaggtgattgccgcacatggatagagtcctgagaaggcaattgtatctattaattaggatgttttatgtaatctccttggagatatgcttgggcaaaagtctgccgcaaagacttatggtatcttagagtttcttagagatagtagttgtgtccgttaggacatatcttgtgattttcg

SEQ ID NO: 52311 - DNA, 1501 bp, Oryza sativa
gtatcctgaggtgttcccagaagacctcactacaatgccaccgaagagagaaatcgagttccagattgatctggcacccggaactgctccaatctacaagaggccgtacagaatggcagctaatgagctagcaaaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacactagagttgaagtccttctcagttgaagatgtcacaaagaagttggtttcgtcgctaccgtcaaggatgcctgtggaatggagtcgcccactgtagaagtcaagtcttcaggcttagctcgtttttttcctcttttttccgctgcatttgtaatcttttatatttttgtaagacgtggatctgtatgtcaataattgtcgtttgtgtaccctggctggtcctggacaggggtttaatacacattcagcttagaaattcttagttggtatcagagccgaccttgaccgtaggacaagccaactggaaaccctaagagtcctcttaaaccttttcatttgcacatgccttttgcacttggatttgtttcggtataattttggggtttgctcttttgatttgtgggaaaaatcttgatcgctatttaatcgtatttctcggctagaggcagtctagggttctagcaaaactttatttggaatttatttggccttcagtcgggaatttgttaggtgatatgcactaagtcgtgtctagattcgatgggcatttttatgtgtatattatagctacgcatctattttgtgcattaatttatcgtttagtcagttgcattagtatctttgtctgggttcatgaaaaatgttccacgcataaaaatcatcatgctcggcgagttatttgagtcatttgttgctttatttaatttggttttgagcatgtgttggttcctatccctctgtcctctttagatgtcagacctgttctctgatcgcaagcgctgctccaagcttcagagtcgccgcctttatccttaacattttcttagttttggctgcttgctagtttctgtgtttaggtttgttgcttgtgggttagtcggcggtcgatatcatgtgttagtggtatgactgccttaattaggagttgtttgctttctttttagttttttaatcaagattaaattaattgcacttaaatctataagaaagattagtttccaagccatctgttttcttcctttctcttatttctacctatcctcgtccaga

SEQ ID NO: 52312 - DNA, 1501 bp, Oryza sativa
gcggtcagaccggccgactgcgaagaactggtaccggcttcggatttcttgtttggggacactccaactccatctccagaaggtattggcacatcatgagaccccactttgatagtaatcacctccgaagtcctctcctccaccttgacgcgctttccttcccacttttcttcattagcccgattcttaccataaaatcggctattgtttggtgaagacaaacgctcatgaattggcctccgtggtcctcccctcccttggttgaattgcataggaggcatatgattgaacattggcggcgtcggcccccatggcatgaagcaaggataaggataacccgacggcggcattggataggaaccccatgacatatcttgtggataatgatacgaaggtgaacgcgaccgtcttggtgaatgaccaaatcgctccttaggaggtgatcttggtcttttccctttgttgcgaattttctcaccaccttgcttttcatatttctccaaaagcatattaaaagtcaccttggtcttcctaggggctttagaagttgaagctccactcctattctctttccaaacgccaacctccggcttctttagcactatcatcttggaccttggttcaccaatgaccacttccttccccttagtagattcggcttgctccggccgaatcaacaccttcttatcattgaaattaattgtattcaccggaaaatgatcatgatcaagcttcatcttggagccatcggtgaacttcaatcgtccttcatctatggccgattgaacctgtcgtcgaaacacattgcaatcattagtagagtgagaatgagaatcatgccacttacaatatgctcgacatttcaactcttcttgagaaggtatgacatggcctttaggtaatctaatttgtttctcttgcaaaagataataaaaaatcttatcacacttggccacatcaaaactatatttaacctcactttgccgatctttgcgaggagtcgggattaggttagaacaaacaaaagttttatttttgttagtccatgaccattcggcaacataaatatcatgatcaccctcttcctcactatcattagcttaagggtaatcaaccacattaacattaggctttttatcaaatggtctagcaagttttctattatccttaacccggctttcttgagccagagccctttgcatgagttgactaacatcaagaaattgttggccatctagtctttctctaagaggagcaactaaaccattaaaagcaagaccagccaaatctctatcagttatattcaaagtataacatcggtttctaacatctctaaatctcttaatataatcaatgacagattcattatacttttgcataaccgatgtcaaatcacataacctaagctcagtttctctagtatagaaataatcatgaaattgttcttctaattgagcccaagtatgaatagaatttgctggtaaagaagtaaaccatgtga

SEQ ID NO: 52313 - DNA, 1501 bp, Oryza sativa
ggctctggacacgtgggggtaggacatacaggcggcgacgttcctctccgggtaaatacggatttacgggcggtgaaatcctgtatgacgtcaaatttatttatttactccctccgtccgaaatactccctcctttcaaaatgtttgataccgttgagtttttaatacgtgtttgaccattcgttttattcaaaaaatttaaataattatttattcttttcatatcatttgattcattgttaaatatactttcatatgcacatatagttttacatatttcacaatttttttagaataagactaacggtcaaacatgtgctaaaaagtcaacggtgtcaaacattttaaaacggagggagtataagggattttaggtggatgtaaaatcccttatatttcgggacggatgaagtatttgttatggcaaattttatcaaaatgtactcaaaatttatataatttatccgtggacatctaaaaacctgacacggttagaggacaccatataaaattaaaaactagtaatttgatggagaatatcataatcattattctattattgagtaaagcacatgaacgatatctaaacttgtacggatgtattatgtagatccctcaactttcaaaacgtatttttggtaccgaacttgttttgggtgtcatataattctaaacgggttccaacccactctatgtactaacgtgacatgccatagcggtttctaaatgacattttttttgatagattaggaatctaaatgacatacccgcataattttaagaaccgtccgtgcacttcactctttactatttttatccaattggagagagatttttaaaatacaaaaaacacccttgatccatgagcttctaacctgtcacaagcaatatgatatagttggggtgatcacaggttgcgaattgcataatgtacggtttgaaatttttgggaaaaaaaagaaaatttcaaaaaaaatttgaaaatatagataattatgctaatattttaagaaaaaaacttttcatcctgcttttgattgaaagcaaataagtatgatatagttatatttaaaaggtttgaaaaaaactgtggaaagttgtatagctaatcccacattaaaaccggcataggattccactaaaaagaccgacgtaggaaaagaaacagaaatctagcaaaacagaactgaaaaaaaaaattcaggctcacacacggggcccacaaggcacgcaacgtcacggcccacaaggcccactcagcccacgccacaacacacacaagctcccacaagtcccaaccaaccctagagccgcgccgcctcgcttctccccgactcccgcgtgctcgccgcgccgcccaccgtcaccgcctggagcgtgcgaaagctcgccggtgcggtttctccgctcaggtaagtccacctgctgcttccgcccgcaccctgtaatcttcgtctccgtcggttcttgctgaatcgccggccctgccttgcagcgtgaa

SEQ ID NO: 52314 - DNA, 1501 bp, Oryza sativa
ccgttagccttctcgtccgttttcctctgttgtacacttggtaattggtactcccctgtttttcccgataaaattacccgttcttcgctcgtgataactggcgaagttggcttagaaagtcagaattgcaattaagtgttaatgttatctcctcttctgattcaatttagtttgtctcagtgagccctgtaatagctgaataaaatgactgttgaacatcttgtgttcacgtatcagcagtgaacaacgtagacacaaagttggttcctgttggtcgaaggagaaaaatactgctgagtagcaatacctacgagtgatccgaaagatgttgaagaccacttgacgttcattggagtcggtaactgatcacgtaatactgtcagatcaactagagtttgcatcggcgccgtcacgcggcccactcagctgccaaatactactacgacatgtagaaatatcgaaataccgaaaatcgcgttgccttctttctcatctgtgcccattgctagggaccatgtgtatgtacagagatgtgctactaccactactatagcagaactgcagaaaccgttccagggagactgaccggtgagacgatcacgcacgcttatatggatggatgatgtacagagaaacacgtggccgcacacgtacgttacgcacgcacgcacgcacgcacgcatgcccgggagcggttgctggcttcggacggatggatggatggatcagacgaagtcgtcctccatctcctgcatggagttgccggcggaggcgatctggcggttggaggtcatcttctcggcgaccatgaggcccttgtagctccgtatctccgcccgcctctccttctccagcctctccatctcctcccgccgcctcttctccttcagctgcatcttcctctccgccttctccgccgcgttcgacgcgtccttctcggctgcggcgtacaaaggccaaagggattagtcgattttaattgtatgtgtaatgcctgaatatctgatcaatcgatcgatcgatgcgtgtcgtccgtgcgtgcgtgtacctttcagatcaggccggcgctctaccctggtcttgttcaacctgttgatgatctcattgacgcgcttctcgacgatcaccacgcgaacctgccatgcatcagtgatcagccagcgtcgtgacacatcctattattgctgatgagatgcagctggtttggtggatgagtggatctcgattagatgccaaaggaaagcatgacaggagatcactggcatctgatcgatcggcggcagctacaacttgcggtggctggctaacaagagatggatttgcaagttgcaaggctggtcactctctgtctgtcagtgttcccgtgcagatcgattatgcaaatgctcccaaaattgcatctgcggaattgacaccccaacccctcgacgaatcagctggcggccttttccagtgacccttcggaaacaagaggcgctagcttctttttcttttctttttc

SEQ ID NO: 52315 - DNA, 1501 bp, Oryza sativa
ttacctataatttcacctatttgaagtatatgcctacaatacctctaaatcttaggacatataattcagaccaaacaaggatgaataattcctttttttcaggataggtcatttaggtaacttaagttagtgaggtacaatggagaacaataaccttccaacattccatgataattaacaaaatcacaggatgtaaacggcaattatatctggcagaagcactacttcaccaagaagatagcaattaatgggcaatctcatgtttttgcatactcatcacttcatcaggtacagcaaacccaacttcttaaatatgtacaagggctcacatttgatgtaacttatctgatgagatataaattggttgtgcgtaatgttaagtgcaaggtaatgtaatgtccatagtttataattatgtactgtattaaattggattagaaggtaatgcataactcattgaattatgaaggaaaaagtgagatgctactctgatgttagcttgtgttgcatatcaatactcagaaactaaatttacatgacgataatcgaaataatttcagaatggaagcttacggagaagtgtaactcttagcgagcagaaagtatatcctccagaactgcttatccttcatgtggcgcgggcacagatcgtaccggatcttggccaattcctgcgcatcaagcacgcatgcgtttgctcaaacttccacaacatcctcatcacagacagagagaagcgagcgatacagaaccgagatccgccgggaagcgtaccttggctttggagagcacgagcacggcgtgccgctcctgccagccggtgaggtcgccagcttccacccctgcgagaagcacgcacggacatcacgatcgagcccggatcggagtgggaaggatgaaatcgagatggagatggcgagtgtgtggctgttgccttggagctggagcgcggaggacttgaaggagtccggggagagcgtccggaggaagtcgagcagctgcggcgtcacgcccagctcctcctcctcgttcccggccgcggcggcggcggcggcggcggcggaggacgcggagggtttgctcgggccgcctccgcctccgccgcctcggcggcggaacggccacgagaaagaggagaaggccataggggggacgagctgcgtttgcgcctcgcgatggtgaattcggcgatgggttggagaggatggccgcgaccgcgacgattcgattcgctacggcttacgaattcgccgagtcgtaatcagcagacgcacacaccacgcaaaccgttctggaatctggaggatgatttcgacgaattttgtcttgtgccttgtgccgatggagtttggaacgggtttattattattattattattattattattattattattattattattattattattattattattattattattattattattattattattattattattattattattattattattattattattattattattattat

SEQ ID NO: 52316 - DNA, 1501 bp, Oryza sativa
tggcaaacactgaagattcgtcaagctcatctgtagtgggtacacacaaagcctgggactcaatctgaaagtgtaagatgccacagaagataaaggtctttgcctgaaaagctgcctcaaactgtttaccaaccattgtcaacaaaaaggtacgaaatttggagtcgacagatacctgaatcatttgtaatcaggagaagggggatactgctcacgccctctgcaggtgcccacacgcgaggaacttgctgtcagccatgttcaatgcaggcaacatctctcttgatgtggaaaaatctcgtttcggtaatgagtggctatttgacatgctggagcaactccctgcccatgagcacgagatgttcttaatgacgctatggcggaattggcatgttcgcaatgaaatcacccatgataaagcagcccctccgctggaagtttcgaaaagatttgttgaaagttacatagcccgcttttccagatcaaggaatcaccgctgaaagatgtggaaaaagggaagtctgtagcgagtttgtctgtcactggcagggtaagagacagagcttctgatgatcatcgagttccgaatcccgtattgcattaggtgaaacctcaggttggttggatgaaactcaatgttgatggatcctttgatgctgccctatgtaagggaggaattggtatggttttacgggatagcagtgggaatacaatcttcgcgtcctgtaaaccgctgaacagatgcacaggtgctctcgaatcagaactgcgtgcctgtgtagaaggtctgaatctagttctccattggaccctgctcccaattctagttgaaacagattgcatgtctgtagtgcaactgttaaatgatggggaaagggatcggtcggaattggctaacattgttcatgaggctaaacgcttgctagccgggactaggagaattctagtcagtaagatccatagaagccagaatagtgttagtcacctgttagctaacagggccaaagttgactctgtctctggggtttggttggaaggaagttgtaattttatcttacgtttagtgcgtgaggacattttaagagagtaatatatttcttctttccccgcaaaaaaaaaaagaaatacaagttaatttatatataaagcttttatatatttgttcgtagcaaggtaaaagccaatgctataaagaaatttacgttgaaaataagttgaaatcaactttaaattcaagttttaaaattcaaactttagcttttgctttgtgttattaggccaaccgatgaggctctaagcagttgtgttgggggaggctaggcctcctcccgccccctggcttcatcccttcgtgattgacaagtgcacaagcaaaacgaaagaaatatagtagtccctctaccccaatttgaccgtccactaagattttgaggttttttctaaatgaccatcatacaataagtgggagtaaatgggaatcgctgaatgcgctgcacgcatg

SEQ ID NO: 52317 - DNA, 258 bp, Oryza sativa
agatctcctcctattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccacaagaagagtaggtagaagtagtgcatgtggtatccccttgagatataaaaggaggaccttgcccacctaaaaaggggggaggagatcgagagtaaaaaagaacgag

SEQ ID NO: 52318 - DNA, 777 bp, Oryza sativa
caaaaacccatgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgagtagccgggcacagcgttggcaagagtataaaggcactgaggaagggatttgtttccttcctttcgccattattccccttgtcttcgccgcttgcgccctaactccttctttcctgtgccctaccttcgccacacgcgctcgctcttaatcttctcttcctccggcgcca

SEQ ID NO: 52319 - DNA, 1501 bp, Oryza sativa
tgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaagtggttggttgggcctgttgcaacgtggtgtagcgttggacagtgtttggttaatgttgattaattactacaactgttttactgccttcaactaccgtttttaaatgctagctttatgcaaaagaacctctagcttcctttggttatatcttgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatatgcatatgcccttttgcacctggaattgtttcgggaaaatttggagttttgcctttttggtttgcgggaaaaatcttggtcgttctttcggatcggattttttttttaaaaaaaagaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 52320 - DNA, 1501 bp, Oryza sativa
cacaaatcacagtgcagtcggaaaatttactgttcccatctatttttcttcccccttcccccttaatgctgttattttcttgctgctgattgattgctctggttgtagttcactcaatgttaacacaatgtatatttcttagtctttactggtggttaactaactccatttatcattgaccatgtcaaactgtcagttaagcctcctttaatttgcctgatgcagcatgtctatgcggtatatatgtatggtctttaatgcaaatgcatagtaccaagctatttgtcttgccccgaccttttttgtttctttacatcttactctagtacttctgaaatctgaatgatatcttctgcttgaatttctttgtcatggtcaacaaatgagaaatataaggtctcaaatgttaatacatgaccactattctgcaatagtttgtgttgtcatgcacaccagatttagcattcgctttgttagattctctaaaatgtgcagcttgaaaactgtccctagacatgaaagttccagaatagattggtttttggtgtccagttaggaaaaactgaacatgcaggtcaacaagtatcgaaggtcgatgtaagttttgtattaagtctggtatgctttttgttgcatctgtgtatatgatggtattgattctatcgaacttgcttgtttctagggaataatttgaaaaagaacgagttaattttgaaatagctacaaataaattatggtgatgaatcggatttgttccaaaaggagcatgtgtttatctcatagatatccttttgctcattctcagtgagtatgctgtatttacataatctccattaatgatcatgattattgcttttcctgttgggctcttaagactttatataggagaacctctcactgcataggaaagtattgcttaaataacagtcttgccgtttgcaatgctgccctataatttctggtaacttttaggctaaccctagttagttaattagtttcagtttctagaagaccttttgagctgtgaaaaagggaggttccaagaatgtattgcaatgttggtggaggtaactttgtactcttcattctaacctagtataattggcggtaatgtcagtgccagtgtgccagaaagaggagcttttattgctaactatttaagagttcaaaactagttagaatgaatgaattagcttgattgtgtgctttaactctagttagaatttaatattccgtgtttcacttaaatcactaactgaaagatggttcacttaaatcacaccacaataaattgatttttcctgggtgctcacctgtgtttggtgttatgtagtgacagaatagtgtttttgggccagagtttttaactgtttttcagtggcacctgcacataattactgaatagctctactttttgtgagtttctgatggaggtggttccaggcttccaggcggtaagatttaggagtactccccaagttgatccggctaaccagttagc

SEQ ID NO: 52321 - DNA, 857 bp, Oryza sativa
aagaaagtatactatatatatgtagtttgtgtgtgtgtgatgaaatataaagtgcccttgttaatactggtgggttactgttagacagacacggtgcttacatgtggttaagcgctatactaagcactgatgctaaaaataagcacgctatctatgaagcaaacaaaagcagttacatattgctaagcacatctgtaaacactagctgatgtgcgcatcgtcgcatcgacggctgggcggctggccgggtgccacttctacagttccaccgctacagttctttcccttcacaaatcacagtgcagtcggaaaatttactgttcccatctatttttcttcccccttcccccttaatgctgttattttcttgctgctgattgattgctctggttgtagttcactcaatgttaacacaatgtatatttcttagtctttactggtggttaactaactccatttatcattgaccatgtcaaactgtcagttaagcctcctttaatttgcctgatgcagcatgtctatgcggtatatatgtatggtctttaatgcaaatgcatagtaccaagctatttgtcttgccccgaccttttttgtttctttacatcttactctagtacttctgaaatctgaatgatatcttctgcttgaatttctttgtcatggtcaacaaatgagaaatataaggtctcaaatgttaatacatgaccactattctgcaatagtttgtgttgtcatgcacaccagatttagcattcgctttgttagattctctaaaatgtgcagcttgaaaactgtccctagacatgaaagttccagaatagattggtttttggtgtccagttaggaaaaactgaaca

SEQ ID NO: 52322 - DNA, 1501 bp, Oryza sativa
catagcccgcttttccagatcaaggaatcaccgctgaaagatgtggaaaaagggaagtctgtagcgagtttgtctgtcactggcagggtaagagacagagcttctgatgatcatcgagttccgaatcccgtattgcattaggtgaaacctcaggttggttggatgaaactcaatgttgatggatcctttgatgctgccctatgtaagggaggaattggtatggttttacgggatagcagtgggaatacaatcttcgcgtcctgtaaaccgctgaacagatgcacaggtgctctcgaatcagaactgcgtgcctgtgtagaaggtctgaatctagttctccattggaccctgctcccaattctagttgaaacagattgcatgtctgtagtgcaactgttaaatgatggggaaagggatcggtcggaattggctaacattgttcatgaggctaaacgcttgctagccgggactaggagaattctagtcagtaagatccatagaagccagaatagtgttagtcacctgttagctaacagggccaaagttgactctgtctctggggtttggttggaaggaagttgtaattttatcttacgtttagtgcgtgaggacattttaagagagtaatatatttcttctttccccgcaaaaaaaaaaagaaatacaagttaatttatatataaagcttttatatatttgttcgtagcaaggtaaaagccaatgctataaagaaatttacgttgaaaataagttgaaatcaactttaaattcaagttttaaaattcaaactttagcttttgctttgtgttattaggccaaccgatgaggctctaagcagttgtgttgggggaggctaggcctcctcccgccccctggcttcatcccttcgtgattgacaagtgcacaagcaaaacgaaagaaatatagtagtccctctaccccaatttgaccgtccactaagattttgaggttttttctaaatgaccatcatacaataagtgggagtaaatgggaatcgctgaatgcgctgcacgcatgcaaccgtatgcatgtaactagccaagattaatttctgatggtgtaactaggtatgaaaatggttcataaagtttcctatttcctgagaggtttttgaaacggaaagtgtcagtcagaattttatcggaaatttttagaaatggaaatgaattcagattttttttttcaaaatcggaaatgaatacggtgaggctactatcggtcgaaaaccggaatcggtcagaaactttccggagataaatttgaaaacttttcgaaaacagaaactttttatatatagcttattagcttcagccttctctactctatatatgtttagatttctacataatattgagatggttagttgaatgtagataattttttagtacggtgctttagatacgtgtccaccccctacagtagcaggctcaccatgagcttctcactaggctcccgcgccgctcccttcctgtctcccaag

SEQ ID NO: 52323 - DNA, 1501 bp, Oryza sativa
ggaaggaagttgtaattttatcttacgtttagtgcgtgaggacattttaagagagtaatatatttcttctttccccgcaaaaaaaaaaagaaatacaagttaatttatatataaagcttttatatatttgttcgtagcaaggtaaaagccaatgctataaagaaatttacgttgaaaataagttgaaatcaactttaaattcaagttttaaaattcaaactttagcttttgctttgtgttattaggccaaccgatgaggctctaagcagttgtgttgggggaggctaggcctcctcccgccccctggcttcatcccttcgtgattgacaagtgcacaagcaaaacgaaagaaatatagtagtccctctaccccaatttgaccgtccactaagattttgaggttttttctaaatgaccatcatacaataagtgggagtaaatgggaatcgctgaatgcgctgcacgcatgcaaccgtatgcatgtaactagccaagattaatttctgatggtgtaactaggtatgaaaatggttcataaagtttcctatttcctgagaggtttttgaaacggaaagtgtcagtcagaattttatcggaaatttttagaaatggaaatgaattcagattttttttttcaaaatcggaaatgaatacggtgaggctactatcggtcgaaaaccggaatcggtcagaaactttccggagataaatttgaaaacttttcgaaaacagaaactttttatatatagcttattagcttcagccttctctactctatatatgtttagatttctacataatattgagatggttagttgaatgtagataattttttagtacggtgctttagatacgtgtccaccccctacagtagcaggctcaccatgagcttctcactaggctcccgcgccgctcccttcctgtctcccaagggtgtgacctgaggaattcccgcgctcacaccgtgatctccgccggagattcgccggcgacagggagcgccgccgcgtcgccctagaatcgtcagtccatcgcctgacatactcttcagtattcctattccttttcatatgacttaaaaatcgatcttatgtttactacaccatctaataacaataaaaatactaattaaaaaagcgcaaggagtatcatttaagagcgggttgtttcatgtgtggttgccaccacttccacgtcgctaacagacttattaattgtaaaagtaaggtactctgttcatcgtactccgtacagagtagcatcaatgatagaaacttcaccttttttttaatgtttgataaaatgggatgcgtcacctacggatggaccaacggattgttggtcgttggtatagcaatatcaatattattatggctcttagttgactcaactgacaagtctacgcctgctcttactatttaagaagcttccaatgcgctaacgcagcccagcgatctgcgcgtcacaactcacaaagccggggtagcttgaggtagtggtg

SEQ ID NO: 52324 - DNA, 505 bp, Oryza sativa
tcccatcagaaggtcattcggacggcaaccatacaagtctccgtctgtttatgaaaaggtggggtaagtcccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcatctggcgcgccaggtaggggactctgcgagggattttctgagctctcgcactctttcgtgtgcgccaagcttttcctgttcagcccaa

SEQ ID NO: 52325 - DNA, 1501 bp, Oryza sativa; identical to SEQ ID NO: 52015

SEQ ID NO: 52326 - DNA, 1501 bp, Oryza sativa
tatatatagtaacatttaaaaaaaaatgcacgacggttcaataaaggaagattgctattattttggcagagaaacaattttgtgtggttgaaagcaaaaactatggatttttaccaaatgggtaccaggctagctaccagctgactcccggccccatccccctccctcctcaacttttagataaataatcatttcttatttacataagttattatataattttctgcatgtcatggttggaactaatgttagttttgtatgacaatctatctatatatgcatacctttactaaatgggcgctctgagaaaactcccatattaactagatgaatacaccgccgcgttgctgcgaaaaattaagttgcataatatagacaaataagatgtaatttgattgtcaatacgagaacaatttgatacaattttgagactaaaaataattgagattgcatgtttttaagaaataagagataatttggaccatagatatatcatctaaaggctagaaataattggggtgatgtggcttaatgagagaaaagagaaatagcattaactacagttagtgggatgaactatataagtatatatgatatatgatcacataatatttaggctttaaatgtaggtcattttatcatggctgtagattttattgagaatctgtattaaacaaaacatgtgatttctaggaggtaccttggactatttagatttattttatttcctaactccaaaatttgatattgatagatcgatatggagttgaacctatcttggattggatttgctagaaaactttcttaagttttttgccccccaaaaaactttcagatttgtgaccatcggatcgccttaagatttgtgcgtgaagagaaaaagttgcaagaaataaattttcaaacatgtcacgtgtaagaatttagtgctagctaatcaaaccatagttgaatgcaagttttacataaactatatagtagttacagtgcagttatactgttacagtgtagttacaatgcagttacacttcaattatactatagttatatctgaaagttttttactcaaaagacttgcggtatttttttagatacttccatcttggattctcgatgtagcattttattagtttatagttttaaaatcgaaaatcggtacgtagtaattgagttgtaactaattactaatatggatcttttcttttaatatgatccccacgaattcagaaaataacatgtctttattgcgtgagattgatgactattatagctaaattacaagagatgtctgagaattgaacctcatttgtttcaaaaatcaagccagcagaatccttaatgataatatacgcaagtcatatgtatgaaatataagggagtctatgtcatatatcccatatgtaccatataaaataaatttaatatttatccatattgatagtactatatatgtcacatatcgtactatattgtttttatttgacaaagtgagtatgttgat

SEQ ID NO: 52327 - DNA, 1501 bp, Oryza sativa
tcaaatgtgaaatatgtctaacttttgtagatggagggagtaatttatagcacacgattgaaaatgcattttaacatgaatgactcgtaacggtttagaatttttctaatttatatttaataaaccatggcaaaataatatggtattttaaattttcatttatttagttgcattgcttgagaatgagtttgagtggtttggttggatgtctaagtacgaatgctgctgtcatttgtgggaattgggaagattgttctttggtgggggttcaacatcactctttggaacagaactaaaaccatgcataaccaggaggatatatagcagataatcacatatttttctttttattttctttgttgctctttcatgtcagatacaacatgtattcctgatgtttcttacacatttctcatcagggggatatgttctaagctcaaaaccggacatttctgtatagctaatatatagattatgtattttgaacactgctaaagtgttattagtaaacctacaaaattacaagattaattaaaatcgacttcaattattagatataatattaacaaaatagttaagaaaaaaaaataaaaactcaagaacaaagtttttagccatttaatttgttaatttaatgactccgaaactaagtttagtttggtcttacaattttatatggttatcttcttacttatattgtgcgttttaaaagcttttgagtttttttttgattgtctagccggcagttgtctagcaaatccctaaattaattaattaatccgagattgtacaattatgtcacatcctgatttttgttttatgatttataaattatttaataaattattattagaatttatgttaaatgttcattaatttacaagtgaagttaaatgtgagaaataaaatttcctaaatataaatcatggctgcatttaatttttattaaattctccataattaaatatacgctctgcaattttctcgaatttttcagagctcaattactaattttaataatacaaagagcagttcagcaatgattcgcatattaaattaatcattaaatggtcttcttataatttttttaaatacttatagtgttcaagtattttaataatttttcttggaattattagagcaccggaagtatttttaacaatttagagatcatttcagtgattaatttaattgggaaagtaataaaaaaacacccttttcctttccgggccgaaactagaaaagttcacttttagttctcggtccattctctcttcctttcggctggttctatcccttctccgaagtccatttcatgtccctccttcaatcgggctgagtaaaagaagcccagctgaaagtctgttttccttccctctgctacagtagtcgcccctaacctccagccggccggagacagagcccgatgccgccattgccgccgccttccccctccaactccggcctcctctctcgtgtatttccaaaattagttgaggca

SEQ ID NO: 52328 - DNA, 1501 bp, Oryza sativa
tgtacttattttagaacggagggataattaatctctcggatcatcgattaattaaggtatagtacttccatctagctaagctctcgttccaaatgaatatagtgacctagatcacacacacacacacactttaacagagagctacatatcggatggccgagtcccttaaaaaaatcgggtggtcaaatattttagttgaccatctgattaaacattaagtcatacaaggttaaaaaaaaatcaacaattgaattttttttttgtgaaacatggtaaaaacacacaatgaaacatgtcgctatagcgtatgaaacattgagtttcaacggtttaaaatacgtgttttttagttagaatataatcatgtgatatcttgttataaagattaattacaacggatatagtgatgtaatcggatcgtatatcggataagtaatttatgagaaaaaaacattttaaaaaataataatatgtgtgtgtgatagcgtggggagagaagcatgtagttggttgggaaattgaagcgtccgatatttttcttttgatcgctataccgataagaagtgttctacatgtgacaaaccgacaggtacatatgagcatttcgtctaaaatgagagagcacttcaaggaagaaaaatgtgggagatcgacggtgatattcttttgcatctttatttcgtttatttttctagctacttctccgctagccataagatagaggtagaaagtacaacggtctgtgagcactatatgcaaaagagcgtggcctagctggctactggggatctgctcctatggcagtagaaagtgacctatcctcagcatcttcaaatgggaaagagagcctgcaatcattgtgtgccatgccatactttacctatcatgtttgctgtctgatcgagcaagctgatgactgatgagctgagctgagctcgctaccaatgcactctgcatttctgcaatgcacaggggggagagggagagatcagagatagatagagagagaactaacttttttacccctaatggcagcttttccgttctgcgcttttacttcctttaacgacgtaacagaaacaatctgtctctactgattaatttttcttcttacgaacttatgatcagtaatgatttcctgctacgagattagagatgtcatccaaaagcccacttaatttcataattattgaaggcacaaaactgcgcacgttgcgtaccaaacatgatttgtcatgagagcatgagagttggcaggggagagatctaggagcatgcaaaaacaagagcatctcatgacaaatcattatgtaaaggaaaaagtacgaaatacccttgaactatcacggttgactgaattaccccctgaactagaaaaccagatattgatcaccctgaacttttagtaccaggagaattacccccctcaactcaatttagagctgttttcttctacattgcgtccgcgtggcaatccagtcagcatttttcattaaaaaaa

SEQ ID NO: 52329 - DNA, 1501 bp, Oryza sativa
ccaataatctaggaaagaaacaactaactgcttattatattacaaattataacaatctagtttatagtaatctggctcaataatctagattataataattttaagctgaaagaaacagggtattagtcgttgctagttaatcatgtagtacatccgtccgtatttgtgagaattattgagaagctaatcaatcattgcatccattcgattggattgtgtatgtggatcaataattcagcccccattcgccgaaataacatacatactactagtagctagctagtaataattagtttaaataaactagctagtaattaagtggtactactccactaatataaaatctaggggtttgcttcacctgcatatgatgatgaatgcagactagtcgtccactcctccggccggccgtatgtacgcatgagtagtagtagctgattgggggtatgtatgtggctttgttgccatccggacacgtagctgctgtgcagtcaagcctgagcggcatccacgcgtcggcatgcatgtttatctccactcaatcatcaacacatatatatgatcggatggaacttacataatgtactactagtacacatttgtcagcacaccacgtatgcatgccctgctttatcttcttcttcttctggtcaaatactatacaacaaatcattaattaggctcaaaagaaagaaagaatttgaagaaaaagccaggaaagaaaagtctgaattattattttggttatgctggatatatatatactgtattaatttagctaggtggagtacaataataatatcgaagatactctagtctcactggaatgggacgtgtgagtgtgagaagcagatcgagcatcagagggggcagatccggtagagtctgtgtgtagtgctttgccttgattggatcagctagtccttcgtttgagtccttatataacattgatagtaccagatcgatctggagtacttcctaattgcatgatagatgacagttaaggcagcccagccaccaacaccaccaaacaatatcatgcatgcaatttaattaggatcagagccacaggggagtaataataatatatacttctagtcagtctatatactgtacgagtgtgcctagctaggagtacatgcatattttgttccagattatcgatggtggacaggacaggagccaactgcaacaagatatactcattctcgatcgatttctaagagatacctagacacttgctcctcctgctataaggtaattaacgcttcgctagctaattaattgcattagtttcaattctttttatgatcttctttcgatcgagcaaataactcaagtaagtgcatgcatatatagatgaatagtgtagtagagatcatggcgatcagttacccgccggaggatggccggtactactgttcttccgttgccgccggcgatgattcacctgcggcccatcatactaacgcccacgacgactgggactgggactgggtac

SEQ ID NO: 52330 - DNA, 1501 bp, Oryza sativa
aacgttgctagagcagacaatactttccctgtttctaatggaatgcctagaagcaaacaagttccaaaggtgaccatagcaataaaagcaggagctccaaagaagacagatataagcatagctgaggtgtatacatctttctttagccaatgcatctcctccttcctcaactccatgatcttcgacaagaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataacctgcacaggaaacaaccaaagctcatgcatggacgaattgaaacccgcgacacgcaccgcatcaacgctcacggcattgatgatctctccacttgaaatgctttccctggactgatttgagagggagagacccttttggtaaatgatggcgacaagagctgagcgcacccgcacaccaagttgttgcgatctgaagagcaaatgccttgatgagaggcctttgatgaactgcgcaacaacaaaactcaacaccaaaatgtagccttctttagcggtccgtggacttcgattcaggtaatcaacaaagtactcaatcaggtatggaccaacatatgaagagacagtacggagtaaggcacaaactgcagtgaagaggattaatttccaggttgtaagaacaagagctttgaccagcttaattgttgtaacaccggtgtacttccctgaaccagaaactgagatgagcttcgcctcaaagttagggaggatgccttgaacactgtcattatcatccaaagttggcacatcatcaagatctagtgctttcctccttccaagatcaagtaacggccccatccaagaaaaagtgataacactaaagaatccagcatctgtgaaagctgctctactgcctgtggccttagacgaggaagaagctgcacggtccaatagtggctgatccatgataaactaataactcctgaacatagaacaacaaactttagcaagttacaactgattatttatgagaaagaaaagtataaaagtgttaacgtaaaaatgataatttaagtctgttcatggacattaataggattacagaaagtatagctaatttaaaggaaacaaacataactgtgagtgttaaagccatatgttgcatgaaaaacatccggatgaatccgcacgataccacagaattccattgtcacacatggtcaagatgatatcacaaatctccaagtaaacaaaatcgagacctagattacataaatagcatatgtaatatgtatgtaatctaatatgtgctaaacttcctagaagtaaaaaaaaaagaggatgtaccgaacttttaaatttagcaattgagt

SEQ ID NO: 52331 - DNA, 1501 bp, Oryza sativa
cgaagaaatctgcagcggaaaaataaaaataaaatctggcaaagcttcggctccactcccacagcagctcaactggggtataagctaagcatcttctccttctggatcatttttcttcaactgagatttgattgattattgcaaggtgagtacatggaatactccgcaagccacacagcaaatatgcaagtgcacacggataccaaaggatggcataatataggctcatttgcaaaagcagcatttagcaaacatttaggagtagtaaataagtagagtaattaatcatcaatattaatcaacactgaatagcacacccatgctgcaggcccaaccaaacctgaacaaccaaccccggtcgtacagatcaaacctctaaaccaggaatttaccattccaaaccaggagtcaaattaattatcacattattatcattaatgagtagtgtgggactaatcacgaaaaacattgctcaacccacccataaccgcgggcatggctattcaaatagttttactctggccagaggtgtacaaatttacccacaagacataactccacaatatgtcaccatatcaccatgtgcccatgctgaacatgccaccatttgtgtagttgtgacaagacccctcgcatagctcaactcaaagcagcgcacctttcctggatcataatcaccccctctacaaccagaggcgtggactccccagcgacccccacggacttctcgccgcttcacagtctagcgccccacaatgagccttgctatacaaagtgtccagccgttgcccattctggcttgtgattagtacggttaatgtctcacaacagtagcttgcgaaccggtccttaattgtcatgagcatgaccttcaaaaccatgtgctcacaacccaccattatcaagttttaattatcaattatttatcacaacacgattaaccatcgtgagctaccataaagtatccatcattaagtaatagtgaaacattaatcatcccaatagtatgctagtgtttctaagcatgactaagcaattattctaatatatagtcgaaccaatatataaagtccaactagtcaaattataacccaaggtatcaaagaatagggtaatcaatgcaaattggccataacaaatgaataggttcacaccacccggtgacatttaaaaataaatgcatagttgaaataaatagagaatttaaatataggagcaacatgctcaaatgattgtgtttaggatctgtgtgacttgccttgcaataatcggtcttcaattagtcttcttgaacacttctgacgcactcacgaaccttcacaacgacggaaatgacaagctaacatttataacggagaaaaaactaataaaaaccaaataaacagtactaaaaagtaaacaaacatgtagatcatgattttagatgaatttagagacttgaacggcctcattccgacttcatatgaattagttatgaattttacaaaattaattccaatta

SEQ ID NO: 52332 - DNA, 1501 bp, Oryza sativa
ggttgcgtcctaccattcctagaccatgtgtgtgctggtttgctatatgcaattgtcgtgttggtacgctagcctggtagcagcccaagcacaccatgattagactagtcgtaccagcacgacccacaactaaatgggtcgtgttgttactggggcatgaactatacacgcgtgctcgggcgtgcacgaaaataaacaacccatttaacaatctataggaggatttggcaaactcatagccattcttctatttctatatatgagatcaattaagacacctcggtcacacttaattaatttgattagaagggaaactattttttaaagatgtttccttccatagtagcgattgcactccaactaacgtaaaagaaaataacatactcatttcccaaaataacatgcaagcacaatgtaatctagaacacatatccaattcttcttgtttttattaaatcgatttcaagtagcgttgtccgagacaaaaaaaaatatattcaaaatacataatgaggataaaccgatcttatggggatatacacatatgtaatgcttgtcagggatatggataccacatacccgataagaataaaccgatcttatagggatatacacatatgtgatgcttatctcattggtgaaaataaaaatattttctcaccaaatcaacactgcttaagagagttaattaggagaaattaatatcagccggtagaaataaagggatggttgatattttacaattacaccaaatggttttagcaacatctccgagggatccacaggtccacaccacacaaggagtcggagtcgcggccgagcgaacaggaaatatcctcgggatatccaggacgatgattttcttttgcttcttaggcattacgcaagggtacttggtcaaccagagatatgaaatattgatccattttataatatttttaaaattatttttcctttttacttatatgttatttaaactaatattttttaatcgaataggtaattattttttcatggttcctatacggcaagcattgaaaaaatatgatctaagaccaaaaaggaatcaaaatcttctgcaccccacgtcagatttacagcttacgtttccagttattccataaggggatcgggcacctatatcccaagacatacatacccattacatgaaatgtgccaaaaccttaagcaagcaaaattatagtataaatatatgaaattcacgggtatgcgtagcaaaagtggtaagaaaacatggtatgtgtagcattttctttctgaaagagagggcatttaacccctcgttgagcacctcagcataggaactagcatcattatatccggaccaacaatgcgtgatagacgtcgatcatgtcgcggtatttttttttcccacaaaccatgtttgttggtaaatgtattactactacatataaaagaaaagtacgaattaccctctcctaactatcgcggtcgaccgaattatccccctaaatttgaa

SEQ ID NO: 52333 - DNA, 1501 bp, Oryza sativa
actagtctaatcatggtgtgcttgggctgctaccaggctagcgtaccaacacgacaattgcatatagcaaaccagcacacacatggtctaggaatggtaggacgcaacctggcccttgtgacatgatggcgactgacgactggtgaacaattgctagttgagcaactgtcgtccgaacaagagctataaagaaaggaaaacgaaagaattgagaaagctagggcttgtgttagaggaaacaatggtgtgagcttgccgacgtaggtctacacgacaacgtggtaacgcggtctacccttttcgtgagcacaaccactaagcgtgtcagccattgagagctcactagttcggggtgaaggaaatagcaagtgaagggagcttgacgaggaggaagatgaatgtgctattgtgagcggaggatcttaccatagttttgttgaagtttatgcgataggatgcaagaaactctttcatagttttttccttggtatattatcaattttgtgctaacgggttttcacacagcccacgtacccaaatgatatctcacaaggttgtgcctggcctccagcttcaacacgtgggtcaatacagtatgaccgttcgctgaatcgtgctactgattaatagggcattgcccaaacatatctatttatccaccatttcaaccctataaaataataaaaataaaattcaccgtcttaaaaattcagctcagaagttccgtttgaaaaatgggattatttccattttttaaatttcaccgtttggtagtgtggggatgggatgtgcaatccgggtggcggaattactaaattaccttcgccattttgacgtgtagttggcctctgtcgtcagtttgcccgccgccgccgccgcctccgcctccgctgaccgcgagcgagcagggcgccgtcgttcgtcctgttgcttccgcggttccgccgcatcctggtgagtacatcctccgccaccgccgtctgcgccgatccccatccatcgcgcgagcgagcgagcagggtcgccgtcgttcgtcctgctgcttccgccgcatccgttatgcacatcctctttcccatctccctctacccacgcactttttttctcgaatttgcgttaaccctagcttctgttctagaaatttgctttaaccttaatactcataacagtttgtttgttccccaaaagtttgggggtttaactgaaccacgatgtcccatgttagatccgccactgcatgcagacaccttccctgatgtttctctgagaaactaccccccccccctccctcccttccctctgttctccagagctacatagtgttatctgaatagaagtattgttctagagagaagaaggttttattgaaaatttgatcatctataattcatattgttctagaattcatctgtgatttgtcaagttttaagtgacgtgtaggtggatatagtttcatcaacatgtacaattttttttttggacgttctgcatgtatctaacg

SEQ ID NO: 52334 - DNA, 1501 bp, Oryza sativa
tacccagtcccagtcccagtcgtcgtgggcgttagtatgatgggccgcaggtgaatcatcgccggcggcaacggaagaacagtagtaccggccatcctccggcgggtaactgatcgccatgatctctactacactattcatctatatatgcatgcacttacttgagttatttgctcgatcgaaagaagatcataaaaagaattgaaactaatgcaattaattagctagcgaagcgttaattaccttatagcaggaggagcaagtgtctaggtatctcttagaaatcgatcgagaatgagtatatcttgttgcagttggctcctgtcctgtccaccatcgataatctggaacaaaatatgcatgtactcctagctaggcacactcgtacagtatatagactgactagaagtatatattattattactcccctgtggctctgatcctaattaaattgcatgcatgatattgtttggtggtgttggtggctgggctgccttaactgtcatctatcatgcaattaggaagtactccagatcgatctggtactatcaatgttatataaggactcaaacgaaggactagctgatccaatcaaggcaaagcactacacacagactctaccggatctgccccctctgatgctcgatctgcttctcacactcacacgtcccattccagtgagactagagtatcttcgatattattattgtactccacctagctaaattaatacagtatatatatatccagcataaccaaaataataattcagacttttctttcctggctttttcttcaaattctttctttcttttgagcctaattaatgatttgttgtatagtatttgaccagaagaagaagaagataaagcagggcatgcatacgtggtgtgctgacaaatgtgtactagtagtacattatgtaagttccatccgatcatatatatgtgttgatgattgagtggagataaacatgcatgccgacgcgtggatgccgctcaggcttgactgcacagcagctacgtgtccggatggcaacaaagccacatacatacccccaatcagctactactactcatgcgtacatacggccggccggaggagtggacgactagtctgcattcatcatcatatgcaggtgaagcaaacccctagattttatattagtggagtagtaccacttaattactagctagtttatttaaactaattattactagctagctactagtagtatgtatgttatttcggcgaatgggggctgaattattgatccacatacacaatccaatcgaatggatgcaatgattgattagcttctcaataattctcacaaatacggacggatgtactacatgattaactagcaacgactaataccctgtttctttcagcttaaaattattataatctagattattgagccagattactataaactagattgttataatttgtaatataataagcagttagttgtttctttcctagattattggg

SEQ ID NO: 52335 - DNA, 304 bp, Oryza sativa
gttgaaaattaatgagcatgcaattgagaagaaatatggtaattccgaccgagtcgtgcgctggttgcatccatccttttcgcccaagaccggccggttggctttcctcttattctttcagcctgtccgtcgtctatctgtctgcaggttatatgcgtcgtcgtctgtcatctcctcctcatcttcttgctctgctctgcttctttcctccagagactgttcctcttgcagaagcagaagcagaaggagaagcagaattgaaagcaagattttaagtgactgtagaagaaaaggaggtaggata

SEQ ID NO: 52336 - DNA, 160 bp, Oryza sativa
attcctgcagcccaaagtgtgtcttccctccccgccgccgccgcctcgtcgtcgccgctgccgccgccgccgcggccgcgcgagaggaacatccgttggctctagggactcgcgtggaagatggtaactattccttctgatccttccccttctccctagc

SEQ ID NO: 52337 - DNA, 274 bp, Oryza sativa
gtgtgcgcgccctggaccctcccagccacaagttctcgcgacctttttcattccttggccgcggtcgctttggggtattttttttttggctcgcggcgcgcgtgcgtggacttgagggagggggtggggtgatcgcatgtcatggtcgtggacgaatcgcgttggttgggatgtggagtgacctggcggtgtgggccaatggggcttcgacgtgtccgaactcgagtagctggggggccaattaacccaacgcaaccatcacgctacggaaagg

SEQ ID NO: 52338 - DNA, 1501 bp, Oryza sativa
gagtcaaataagtaattgtccctttcgataaccgcaaagcagaattgtactcaaacccactcaaatctgagtaatagtcccttctagctttgtttgtcaagatttgtgctgagatgggcttttgaaatattgagaactcataatttatcaaaaacgattgtaataggtcccgtgtgatttaataaagtctattttccctgcaaaagaaaaatcttgatgtagatcaaccagccataaattcgactaatcaggctaaaaaaataattcgacgtctataacaaaaacggttgaagaatacactcaaacttaaatccatcgaaatttgaatattaacagagagctaagcataaagaaataaggctcaagtccgattgacccccccccccctccaactataacgaaaatatgatttagcctcctcaactctaattccaaacaagtcacaccccgtaactaggggatgactagggatcggtcgcccgatacaaatctccaaaaagcgggcgctgacatcagcgccacccatatgtgcaaaaccactttaaactaatttttctttaaaattatttatccaaatcatgatccgattgcaccattaagtttgttgcaattaaatcttcaaaacaaaaccacccatggatatattccgacgaaaaaagtttagcttattattgatattttttaaatgttgcacgatgttccaccaggtatatcggaattatttcactaagtagatcgaaaatgtttcaatcgtttaaatcgggcgttgtttcgccttatataaaaacaggtttcagcaaatagcgaaagaatgtttcagttaactgcaacatttgatccatacatagtgaaacattatataaggcgaaacattttttgtggaacaaaaaatgaaacgaattcccgtaatagagagtttccaaaatatatgggtgatttgttgtaaaagaatatttcagttcactgcaacattggatctatacatagtgaaacattatgagtacactagatgaaatattttgggtggaacaaaaaaatgaaacgaattcccttaataaagggtttctaaaatatgtgggtgatttgttgcaaaagaatattttaattcactgcaacattagatctatacatagtgagacattataagtacactaggtgaaacatcttttgtgaaacaagtgtagggacaagtgggtgggtccagcggggcgcgcgcgtgggggaggggaaacaaccaatttcccccctcccccagtcgaccgatcgagcattttcaccataactattcagtccggacacacaaccccctcattcccatttatagccagttttgttccagagttatctcacatgacactccgacggatgacatagcaaaaaattaaataattccctcctctcgtctctctttccctcaaattccccatcctctagagcccaaatccctaacactagggtgcaggaggcaccggacggcacgactgcttctttccggtgagca

SEQ ID NO: 52339 - DNA, 594 bp, Oryza sativa
aagataacaccgttcgttgccgccaccattgttccaatgcatgaccttcgtcctcttaatggcgttgccctagagtcacatccaatcatgagtcatgactatcctcgcacactcctctacaaacaaagagagagggaagggacggaagaagtaaccctcgttgacatgtgggcctctcaaacattttttatttttgagtgaatagcaaattgggccatattttattacccaagtctcactttataccacccgtaaacaaatctgatcaatttggaccgagtaactttgttatcttttgagtttggatcacccccaaacaatttcttcagtactcatcaagaatctcaatcaaatcaattttgatacaacgttgaacttccccgtctatatgcaggtaatatattcagcagcatggtgggtggatacaaatagtaaagagagttaggtggtccaaaccgaaaatatggtaaagttacccaggtccaaagtgaaaagattagtttatggatggtccaaagtaaaacttaggcgataaaagatagattagactgtacttttttactttttctctaatagttactactgtaagtaagc

SEQ ID NO: 52340 - DNA, 386 bp, Oryza sativa
acccctcatgggtttttgctccgcgtatgggttaggtgagcacagtggggctcacctaaccacatttattgtggtttggttgagcgtgtcacgccgcatgtaacgcagtgcagtgcactcgtttatccggtctgtgaccagtcacagaccggtcagatcgcgggttaggtggtgacaggcgatctgacgcacgcctcgccccatcccgtcaggacgagggcttctaggcgctcgtccccagctggagctagcgtgttacctcccagagatggcacgttagtcctggtcagatatatgccaggtttcatcctaaccattacaggcaagatgttgtgtgaagaagggtgagcatgtaggttgctaagctgacacgtagtggacaagaa

SEQ ID NO: 52341 - DNA, 1501 bp, Oryza sativa
ataccattccatccaagccttctttttaccaaaagcaattatgttagatgaaataacattcattggcatcttggctttccctcctatcttcagtgcagatggacattgaaacacaaacataccacacattactcattgttagcaatgtgcagtgccactgtgtgctagaaagcttgagtttctggagctgctcgatctctatgcacagtgaggcgatgaacataccacacattactcattagtcggagtaatggcgatggtgtgcttggtggtgggtcttcatgcgggatgcctacttttcatggctgcagcgaggtgaaaagcttgtcaaagcttgtcagtgcagaggtccttgatcttggtgttgccagtgaagactgtgttggatacgtgtcctcatctcttccctcttaattgccagcaccacccattcacctttgccatcatgttaagcatcctgccatgtctctgcaccacctcatcctctccctagggttggctgcaacaatgtagagtggagacagacaaaacatgagggtggtcagagttgggcacacactttagaccccccaagctgatatctttctcttcaaactctgtcttcgttacaaagttctccgattaccatagaccccccaatctaatatctttctcttcaaacttagtcttcattacaaagttctccggttaccagatctttttttggtaaaggtttgtcttgagaggtccgataccagctttcacacttaaattgatctgtctggattagccaggccaaattgtagtgccgaaatcgttttatggctgttgcgagcttagccttggatggaatggtatttggatggaatgatgttaagaggaacatgagtgatctttggatggtattaaagtgctcatgtgaatcagtggtataaaacaaagacggtaatcttttggtgtcaccaaaccaaaatttccttataatataccataatactcatgctatataggtgtatgtatttgcttctctgctgctgggtatgattaatatgaattcattatctttgtatgtgcatgagatttatcaataaaatttctgccacgctaaaagtagaaattaccctgcacagaataatagatggcccagaaatataaaacctgcttcaaatcaatatttttaatttttgctcgagggagtaaaggagtcagtgaaacaggctagctgttttgttctgggaattttgtcgcgaccagtttgccagcacggcttggtatgttcaggaacaaattgccctttattccttgtatatagtaattatataaggaataataattatgagcttatatatagtaattatatacccaaggacacaaacttatatacgttgttgctaacgtttctgcattgggtacttttttttttgttgcaaactgaccatatagctgacctgtgttacacctgtgctattatattctttcccgccaaagtgactagttttaatggattgccatttgcaactta

SEQ ID NO: 52342 - DNA, 1501 bp, Oryza sativa
taacacagaaggatttagcaccaaatatgccatacgacaagtgttcctgggtcacaacgacaagtcctcaaagaaagatgatagttgctgtcagtgacatcataaaaatttgatgctcctagcaaaagaagaataaaatcaccgttttataacatttattcagtgtggtcaaggtatcgatcccgtctgaggttcaagaactgatacgccattcaccatctttgaaacttgtacttacttaactgctgtaattttttcccctgttattttatccatatctgacgcctagtagttctttcagttttttagggggacatcgcacgtgaatagcatgtaagcaatagtatccaattgtttctctctcaaaagaaaaggtttccaaatgtagaaaagatgtttaaaaaaagtgagagacccttatgccatatgaccaccaacattaaaagttatgctcttgtcactccctaattcaaaagtttctcatgcatcgaccactttctgtttcatctcctgaaaatggagtgaatataaggctagaccacactcatctgcacaaaattcactcctggtttctcaaatcaacacctttgctctcacccaaattccgtagcttgagcactttacttaggctctgttcgtttcctggagttcccaactcccccatctcattttccgcgcgcacgcttttcaaactgttaaacggtgtgttttttgcaaaaagtttatatacgaaagttgcttaaaaaaattatattgatccatttttgaaaaaaaattagcaaataattaattaatcacgtgctaatggactgcttcgttttccgtaccggagggatgggttcccaactcaaccaaaagaacagagccttatagggtgtatatactagtatggtcttacctttatcttctttcatcgattcctaccacaccagatgccatacaacacaagctaacaaaacctgagtgcgagtggatggtgagatttactccagaccattacaccaatctgtcccattcacttgtagacttgctttgctgacctccccttttttttgcttacagtgcatcagtaatccgtagcctaccagtagatcacaaatccattgcatatccctcctccaaaaaaggagtcacatcttctcatcgccatcatcattagttcattttgcccccaccggaaaatccagcgcacagaaacactagcggcatggttagaaaccccacaagcaaagcaaccaaaccgagccccaaacccacacccgcctactaggcggcggctatgatgcaaactgttgaagcgatcacgcacgcctcgcttccgcctaatccgaaggagacaagcaaatcaaacaagcgaacaaaagcggcagcccgaataaaccagctgcgcagcatgtgattcccacctaggttcctcccatcatcccgtgtacttcttcgcttcaaagggctcacactcgtcgagtgatttttttgcagctggctgcgtgagacggggaga

SEQ ID NO: 52343 - DNA, 1501 bp, Oryza sativa
aacaaccaaacagttgcatgtgtatctcttcatccaggctagactcaaccaggatgagagagatgagccaggctaggaaaatgcaagcaaccaaacacacccttaatgattcattgctgagctgttgatctatccttgctttatgcatttttggcataggatgtgagctcagaatgtaggccttccttggactgacttgctctccatgtttttaccaatgaataaattgtacttgtccaaaagtaagaattgaaattctttttgtttgcattgttcccatgcattcttaactcacaagagcaggacatcaaatgtgttatgaaatctgttggcaatggcaagcatccctgaaacacacaacatatgcagaataaacttaaagagcaagtgtttgatgacaagttttcaaatttttcaatgaaaaacccatcttaatgaatatgcacactgctgtacaagcctgtttgcaaaatttacacttaatatgctaggtccataattgcctacagctcaaagcacaaaaagatgtgatccatccctgaaatatcatgtgcagagagtatttccaacgagtgcacagttcaccaaaataaaatctaatgagatgaaaccttagctcttttaacctactagaaataactaaaccgttgaatatatatagcatgccatgtcacttttatttttatcaaaattggcaatattatgtcataaatatgattttcttactatctagcagactcactaaaacttggtagtttgaagcaaccgtttctagttgggcttggttttatattctaagcagtcttttgatgagaaatgttctttggtgccttagcgcctggctgctagtagagcatgacttgcatagtgcaccgtgctttggataatttgagatgcattttctttgctgcatctcgctattgtgcatgtgtgcaccttgtttgcctttggcagcactgctgctggagctggatgttctgtagtacaattttgtgaatatctcaaacagaagaacattgtgcgaggtgacctaaggtcaaatgataatctaagcatctgtggcaagttatatctaccacacactggttaccatagggaatctatcaaatggtaggttgttcgtgtccagtcactcttgatgtgctgttttctaatttttaattggagtatactgcattttctgattttcatatgttggattttgggatgtttgtgtcagtgtttttctgaagaattgttctaaaaacttcttacttaacttctgttatatatcatacaatttcattaacattttacatcttgttgtatctggttggttcaattaatttttaggtgcatatatatattgaaggcctgaaatggctgaacattgggcagaaggttcaaagcatgcttctgcacaagcatcgtattctagatatcaagcaacatctgcaagatctaggcaaaggtaattgtctacttaacatcatcatttagttttctgctagagaagttggta

SEQ ID NO: 52344 - DNA, 419 bp, Oryza sativa
  unsure (1)..(419): unsure at all n locations
ttgcttggtcaagctctagtattaataggaagtaatgccctcaagggcatttataatctggaaattggtgctaaggatttcccatataggggcttcagacaattcggacttgatattgcaaatttagcttgagtaatgaatggcccatatcaaacatgtttggtcacaacaatctgcaacgatctgactggcttgatgcacgatagcttgtcagcattcattcaaatgcatatcttagttcgcattattagcttaaagtgcatctctgttggttnnatatgttgaacatatttcccaagcttttcgttgatcattttagtcaaagcctcaaaggggaaggaaaactatgtccagccttcacattagtcaatagggaaatagctctcaattgcaatgtattttcatttaaccagataatg

SEQ ID NO: 52345 - DNA, 1501 bp, Oryza sativa
ggctttgagaaagcaggtataaaacaaatgagagaaatgaatgactggcttgaacaatttctttttcattaatcacttagatgttctttgtaaaatcaccacgaggctctttcaagaatgacttcattctggtgttatgtgcacagcaccaactacagaaatcagctactacttctgtcccaaaaagaatgcatttctaactatgcacctgataagagtatgtctagatgcatagccagaataacattctttttgggacggaggtagtatcctttaccagaggggccattctgtggttagcccccaaaagtgaggaggtaaatgccatggaatgtatatatcctcaataggggaagccaaaatagaacacagataatgatgtggtacggaatgatttcaaacagaaaattggatgtctgctttcgttcagtttcaaacaggggttgtacagatgtgagagaggacaggctttaatcatgtgccattaatccctgggagctccggaaatacaagaaattcgaaatacctggtgaatgatatcaggcctgtaatcagctggattcctgttttgcttcctcaaataattagcatggtcatccgagttcaggatttgcatagtctacacaaagagtcaaaagaatcgtcaaaaatatcattcgtgcagcttaagctcttcaatcatcagagctacagactgatatgttcagatacaatatagctaacaaagaattgtcaaaagtatcattcgtgtagcattaagctcctcaatcatcaggtatacagaatgatatgttcagatacaatacagctaactcgttaacaaagtatacagctgaattatcttctagcgcaaacaaatttatcaagataagcataagaacagaactaatccaactatccaaactgtacatccaaagccagaaacggattggtcgaaaaaaaagcgcaagaaaaaggtgtaataaatttgttggcgaagcttcgccccataccttgccgactttgccgacctcgaggcaggccctctcgagcacgaagatcgcgccgggccgccgcttcccgtccaccggccgtggcacgacgggtagcccatcagcaacctccccggccgccgccgccgccgccacgtcctcctccttcccctcctcctcctccaccccctccggcggcggcagctcctccgccgcctcttcgtcgaccgggggctcgcgggaggccccgccgtcgtcgagcttccgcttcttcttccgccccttcaccgcgtacggccgccccatcggtctcctccttcctctcgccgccgctcgcacgcgttgcagtggtgtggtggggtttcgagggggaggaaagctagggtttttggagagggtggcggcgatttcttcttcgtccggaggtaaatactgcgagtgatgtgagccactcatccaattaatggacagctgagactttttggcaaaataaatttgtataatatttagaaggagaaaactagaactaa

SEQ ID NO: 52346 - DNA, 1501 bp, Oryza sativa
cgtgccttgtcacgatcttctcattctataggttcttaacgaatagggtaatcagagagatcaaaagctagtccatgccttaaaaaaaaccctttgcgattaaaagacccaagaactttttggatatgatatgccatcgtcagaaaattgctggtatctacacaagttgcattgctttaactatttttttcaggtcttaaaccaaattaaatcgattgtgctcgatggatcgagctgccgtacgtcacggctaaaccttttaattttctgctctgttcatagtttcatatgcttttcgatggggccttggtatcagacgcagcctatcgacgaacaggttcatcgagcggttgttgggttggccggttaggatggtgtaattaaaatacaggtagggtacgtttagttttgcctcttcagggttcagaaagcgtaatactactagactagaggttgacggtcgactgaatattatatgacgtgtgctagccagagcttcggtcactagctagctattctgcaaatcgtcgaagcgattggctttcttgtttcttattttcaatctccattaatctcattagcggctggtgcgcgtgtgtatactaatccggtttaatttggtcttgcctttttatgtttctctcttaatttttcgctgagatatggtggttggatcgagcaattcaagatgagtgcgcaattagaatttttccattgtagtgatcgagcaattcagattcagtgcattgtactggaaatattcatgaaaccacgctccactcgaccactccgggctcccggaggctccactaacgattctcatgtcaggatttcaattaaaagtttgtcatttccaattaaaggatcacacaattgatttaactttcagctcaagattgaataatctttcagctaaattttgcaattgtaatttaaatgggatgacacgctttttttttcctaaaatgagggagacaattaaatccttcattgcacaaagattcttggagagaaacctttaaactcaaatcgtccatggtattagtttgagaaaaggtcggtgcaggcacaggccagaatgcttactgtcaagagaagataagcaaggcatgcaccgccacaccggcaatatgcaggcagtaggcctcgatcggtctgccggccaccagaaattaaagatactagtaattaatcaatactctggctagcatgttattgatattctagtatagttagctaatgctaatgatccaagtcagacatgatcatggtccaacgcagcagatgcattgcatatgcatgaggagaaacgccaatgccttatcaactggtacctaccgctaacgattccaacattgccgcggccggccgccgccctgtaccttccatgtcggccaaaagaacacttagtatatatatatcaagcaaaaggagatcgatcgatcggtcagttcatggatgggctatatatcggtcagttcatggatcggtcagttcaggg

SEQ ID NO: 52347 - DNA, 1501 bp, Oryza sativa
gcggcatcggcggcggctctgccgacggttctcgggtggtggcggtgacggcgaagggaggcaaccgtgcgcggcggtgacggaaggcggtcgtcgggggccgcggcgatggcgacgggaggaggagtcgtggggcgcgacggcgactgcaacgggaggtgggggtgcagtgacggcgacgggaggagctgttttggggcgcgacgacgacggggggcgcggtgacgactgcgatgggaagcgggggcacggcgacgggacgacaacggtgacagagggcatggcgagctcctcctcctccccctcccccaacccttccccctcccacggtttcgctggtgagcccggcttcctagatcggggcttggtacagcagaagagctcagcggcggtgatgctcggcgacggggctcgcacaaccggtgctgctcggtcggtgacggcgacgacggcctccttcctctcttctgttgttgctgtttttctttttctttttttcatgttcaaaatgcttgtatgctgtgttcacttccatgttcaaaatgcttgtatgctgtgaactctggatgaggatttgaatcgatgctcgaaaatttggaagtggatttgaatatgtacacgctgcgaaaatctgattttggggatatttttggtgtaatttttattgcagacggctggctagggttgcggttccgttttgattatttttcttccaaattattttcgctggcgggtctcattacctgccgccagtgaaaccaaatttttgttggtggccatccactgccagtaaaaatgaggaaccgctagcaaaaatatgttttcgctagcagtccacataagtcagttttcgctggcggctgccttacatagaccgccagtgaaaaatgaacttctctagcggtttttcgccgccagcgcagatgcttcatcttcattggcctttgctttgtggcggctccaaataccgccagtaaaaacccaaaatggctgccatgaaatatagatttggtagtaatgaggtgtaattgacatggttttttaattgatacatgcattattggagaatgtgtgtgcatggtgtattgattgatgtcatttaaattatcattggtcttggtgtataagtatatatgatgatcaatttaggatggagggagtattttttgatccatgcataaatacgtgcttacctaaaaacacacggatatatttagctttatgcgtgcataccctgcgtatagctattatcatagtcggaatacactttggccgccgcccctaataaaccgagaagacaattcgttgtagcctctctctctctctctctctctaattagtggctgagcatttagaagaggtggcaaagttaacatacttttgtcttaatttgcatggtttcttagtcagcttgccctcgactgtagagatcatgtccgttactagcttatagctacacacgcatcatatctatcttacgtggacgccacaaggttctata

SEQ ID NO: 52348 - DNA, 1501 bp, Oryza sativa
aatttgatagccttaaacctctcttaattcaagtaataacagtttgtttcttcacccaaacccccatgtcccaagttggatccgccgctgatatgagtttgtggctttcttcagtatagatgaaagttctcaaatatttacctgcaggggatcttaagtttgttgttcagttgagtctaggcagagtagctccgaccatggtttttctgccatcatgatcaactaagattcggttcttaaatagtatattttagaatcaaccaaaatacagtttttgcttatccttcttatatacttgatctcgtacgtttccaacgtgcacttagatatttgatctctcaagttctgaacaattaatctgcaagggggaaatgacttaactttttatcacttttctctacatgtttataattaaagctgccacaatatgaatgctccatatgtaaatgaatctgctgagtccttcttaattggtcataaggatatatttacaaaatatgtccactcatagttttttcagtgtacatgtatgagggaataacatattgagatgcttatgctgagggaagaagtgctatttttttttaaaaaaaatcgtacatgagtcatggctgtacctgacttgatgtgtgtatgatcggttttagcattaatattcaagcaaattagtgcataggtcaagttgattttttcctctataatgatagtttgtggcatttctggtgttcttgtgtgagttgtgttgttgagatgattgacaatttggtacttcctccgtttcatattataagactttctagcattgcccacattcatatatatgttaatgaatctagacatatattaatgaatctagacatatatgtgtgcctagattcattgacatctatatgaatgtgggcaatgctaaaaagtcttataacctgaaacggaggtagtactacattgaagtttatggtgatcttgtggcctgctgttcgagaagctgaaaaataaagtttgcatcacgtaccatgagattatttaacgagatggtcacattttcattgcatcaatgatttgtttatgtgttgcagtcatggaaattaatactggtgatataaggggctatgcttatgttccctctcgcaaggccgccgggtcgccattatgccgacgccacgctccgcagggggcagtggcggctctcccaccacctccgcgccgcagccgcagccacaagcggtggtggtgcgcccgacgtgttcgatgcagtgcctgccctggacgaccgcatgcggtgcagcgcgctgctcagggagcgcgcagtgggaggggaccactacgggtgcacctccctcctccggtggatgctggcccggggacttcgccccaacaggctggcgctcgctgcggcggtcaaatcgtcgtccgcgctccccgactgccgcggcggcgcggcgctcgggaggtgcctccacgggctcgctgtcaaggtcgggtacgcggatggcgcggtggt

SEQ ID NO: 52349 - DNA, 1501 bp, Oryza sativa; identical to SEQ ID NO: 40045

SEQ ID NO: 52350 - DNA, 1501 bp, Oryza sativa
gttaaattcaagaaattagtaggcatattgcatagaaattagactatataacactaaaatagcaataaaacacaacctaagtaatttaaccgcctaatgcaccattgaatgcctaatcgcggcggctacccggcgcctagcgcctaatgggcgcctaggcggcgcctagggccgatttttagaacactgatacgtatattaaaagtataggaatatattatctttctcttttctttctacttagctcacataatatattacgagaatgagtagtaatgcttgtgtcactctacccttggattatcttaacctttgcttagaatatgattatcacaagtaatatataaattattagttgagttctctctacatgatctttccacgggataaaataaatacgatacccttggaatattctcaggtaaaatgctacaatggtatatccgtgtgcttgcggatgaactctgtaaccataatataccaggagtatttctgcgccattgctgggaattatatttctagtaatatcgttaagaaataccaacaaccatcatcttgagggcagcctcctcgcaagcatgatcaactatgcctgcacaagctgtcaccaccatgttgggtaggtaggagggaataccatggacctcacaacggacctggtgtgggaacttgctactgagaggacaaatcctggtgcactccagctctgctgggaaaccaaccacaaatgccatgcagacgagctcagcaacgaaaccttccatgtcctgaccatggtgcgtgttggggcggctggccatctatagaagacaaaggagagagaatcaatgcatgctcaaatccaaatataagcgaaacgataaaggactcaagtaaaacaaacaaataagagcaaaattttgtacatatattattttgcatgaacgaataaatataactgacataactgagcaataaagtaatgcggaaattagatacataataataatcacaacataaataaactttgcaaccaatacacctcagctaggacctaatgcattcctcccattaaatctcgactgactgtcaaataagtcccaaataattttactaaaacccttgactgacctctttaataaatttcaattgaacgagcgatcaagatttttcccataaaccgaaggaacgaatcccaattttcctgaaacaaatccaattgcacagaacaaatgcaataaaaaggattcggagggctcttaggtttccatttggcttgtcctacgatcaaggtcggctctaagaccagcttgtcatgcccagaaattcccgaatagaactccaagcagaatgtgcattaaaacccattcccaggaccggccagggtacacaaacgacaatattgacatacagatccacgtcttacaaacattataaaagtcttacataaatgcagtggaaaagaaaaggtaaaataaaactaattcttgtcttggatagtgagcggcgctattccacaagc

SEQ ID NO: 52351 - DNA, 238 bp, Oryza sativa
ccgtgtttatataggggcggggagctcggacgtggccgggaggagcacgaaatggccggcgaagtgggggaggtgtgagaggagagagaggcgggattcagatttcgaatcccgggcatctcgtgggcgcgggcgagtggggaagggggtagtggggcgcgggggaaggcggggcatgctcgttcgttggcgacgtggctcgggaggggcgaagaaggtgggagaggcggttgcagca

SEQ ID NO: 52352 - DNA, 1501 bp, Oryza sativa
aaaaagagagaaaaaggggaaaaagagagaaaggatttccaggggattatttaatgcttgtgcttaattttaattgattaaaattatctccaaggctctgaaaattccactaaaatttttgttagtatattttgacatgtagaactcaagaaaaatttcacatgccattttacggtttctctcttgacttaaaaattttcttgagatgatttattaattttaatttctgcttaggaagaacttcaggttgtggcatgctgtaactcccgtaatctgaaactccctcctctaactcctcctttcgtgatcgtgatcgctgtaactcctctaactcctcctttatgtcccgtactctgtaacgtaattgctgtaactctgactccccctcttggctactcccacgtaagcgctgtaactcctctaactcctcctctcggtgtcgcgcctgctttaactcctcctctagcttactcgctaacactggtggagaaaccatcttttatcggtcagccaaattccacaataatcctggttctaataaaaactgggactaaaaagcatctttagtcccggtttaaaagttgaggggtacttattaccaaccgggactaaagatcatttttagtcccggttcaagaagttgaggggttcaagacagaccccgattatttttactaccggttggtataaacaaccgggactaaaaacagatctttagtcccggttgtttatatcaaccgggagtaaagagtaccccgaaccgcgcgccagatattatccgtgcgccacaaaaataattgtttataccaattgtttttacttccggttggtataaacaaccgggactaaagatatctcccccttcatccccttcctctcccctttcccctcccgtacctccccttcctctccccttcccccttcatcccgggcgggctggcgcggcggccagctggccgggcgggcgcggcgggcgcggcgctcgggcaggctggcgtggcggccggccggccgagctcgcgcggaggccgcaaggacggtggccgggaggccggcggcgccctcctctctgctgctgattttttttgaatttttgattcattggatttgatctgtgatttatgtgatattagatctgatgtgggagttgtgatgtatttcttttaggatttgtgatgtattttttgtttgagattttgtgatgtgatgtattgtgatctgtgatgcatttctttccaatatgtgatgtatttctttccagatctgtgatgctactttgatttggggatgatttgggaatatgatcggggatatttagggagcagatcgatttgagaaaaaaaaataaccggaactgctcctgatggatttttagtcccggttattttacccgggagcgtaactcctctgactctttcaataggtgtgtctgcgcaattcccgttccagttgctcatccacttgctgcagtagaagcaagcgccctcgttcccgttccagt

SEQ ID NO: 52353 - DNA, 1501 bp, Oryza sativa
cgctgagctaatagatcgaagatgttcctgacaataatgggcaaaccaaaggttatatatttaacaagtgatctcatattataatgccattagaaaacaggttactgaaaatgtttttatattatccagaagatgacccctcatgcagtttatttttggagggggccatggggataccacaatggctcaatggtggcattaacactgatggtgctactctatcagggagttgcatttgccattaagctattcccgcagtacttaagtattatgataacaacaatgtgttggtcaaaggagcttttgcaaattacattcaagatgaatgttaccctgaaattggttaggcataatgctaatgttatagtccaataggccataacattatcaaaatactaatgctaattcatgtggtattgaccttttgacatttctaccagtggagacgacacttaatccaacacagctgacctctaggtgaagtggtgtaacagtatgcagaatatattcccatagctttggtccattttctggaacaaatatgtgaggttcttttcacaaatgttgttttaaaagggctttgtatgctaacaaatactgtaccaagagtagaagaagataaataaggccagggtgctaatcaaacttaataagtcacaagagggtttgcagatataattccacctttactgtgtcaaatattgcacatggatgcaatattggttccaaacacagaatcaaaagaaagaatacattttatcaattgaattgtaacagttagtttctcataggattgtaccaacttctctagcagaaaactaaatgatgatgttaagtagacaattacctttgcctagatcttgcagatgttgcttgatatctagaatacgatgcttgtgcagaagcatgctttgaaccttctgcccaatgttcagccatttcaggccttcaatatatatatgcacctaaaaattaattgaaccaaccagatacaacaagatgtaaaatgttaatgaaattgtatgatatataacagaagttaagtaagaagtttttagaacaattcttcagaaaaacactgacacaaacatcccaaaatccaacatatgaaaatcagaaaatgcagtatactccaattaaaaattagaaaacagcacatcaagagtgactggacacgaacaacctaccatttgatagattccctatggtaaccagtgtgtggtagatataacttgccacagatgcttagattatcatttgaccttaggtcacctcgcacaatgttcttctgtttgagatattcacaaaattgtactacagaacatccagctccagcagcagtgctgccaaaggcaaacaaggtgcacacatgcacaatagcgagatgcagcaaagaaaatgcatctcaaattatccaaagcacggtgcactatgcaagtcatgctctactagcagccaggcgctaaggcaccaaagaacatttctcatcaaaagactgctt

SEQ ID NO: 52354 - DNA, 1501 bp, Oryza sativa
tggagagtataatggcaagtcattagaccacatttgcgcaaaagaagtatggcaaaatgtgctgggtcctttaaccctatattagacatgctcaaatgtggagttaagctcaacttagggatcaggtggaaataaaaactcccaaacccgatgttgggacaatagaagaagctttttctcatgtgcaccatatatctcgctctcggtcacaaacactaccttgaacatccacaacaacataggaatcatgaacttttgtgtcatcaggccaaggaattcttcacagcacgaacatcacaggaatcatacatgttcacctcagcgccatggcactccctttccctagaatgtctacctgcccacttcccttcacttccatcatgtcttctacatgaaaacgaccgtccatctcatgcaggtggttgcagttaatacacaaatcatggagaagaaaagcgttgctacaacataataggaatttagaagttgtttgtcaaattctattggtccaacctttagagggtagcggagtaatcccatatggaaccgaaagggtcaccatgttggatcaaagacgcaataagaaaccaattcaaatgtgacaattgaacattgtgaagatccagcttttttaatatataatgattaaatttggatgaagggagtttgaatatagtcacctccttctaaggctacgttcggaacaattgcctaacttgactctaatgttttccatacacacgctatccaaacggttaaacaatgcattttttaaaagtaatatttatagaaaagtgcttaaaaaaccatattaattgattttttaagtttattaagctaatacttaattaattatgcgttaatggatcgtttcgatttatgtgctagtacgaaaggttgccagccttagcttagggtgtgtttggatggagggatttgggtggataggacatggcggcccattatttgtgggtgtttggttggtgggcggaagtgggatagggcggcccggaggggaatattccctctagatgccggatggtggtatctggccgatttggccggatggagccgcccgagcgctcgggtgagcggggcgagcgacgacgtgggtcgtgtcacccttctcaccatgcgaaacagcgatgtgggtaagcggcgatggcagcgggatgaaggaggcggcggtggcagcgacccggtgcacggcggcggcaacggaataaggatgaggggacggcagcggcaagcccaaaggcggctgcaacgggaggaggaaaggagacgacgacgacgatgacgaccggtggggggacggagacgacgacgacgaccggaggagacggggacgactgtgacgaccggtggggacggagacgacggcgacgactagatttggaggatacggggcagcggccggtggggaaggagacggggtggcggccggtgtagaaggaaacgacggcgacaaccggatctggaggagaggtgagacgagcgt

SEQ ID NO: 52355 - DNA, 1501 bp, Oryza sativa
gccgccgcctagtaggcgggtgtgggtttggggctcggtttggttgctttgcttgtggggtttctaaccatgccgctagtgtttctgtgcgctggattttccggtgggggcaaaatgaactaatgatgatggcgatgagaagatgtgactccttttttggaggagggatatgcaatggatttgtgatctactggtaggctacggattactgatgcactgtaagcaaaaaaaaggggaggtcagcaaagcaagtctacaagtgaatgggacagattggtgtaatggtctggagtaaatctcaccatccactcgcactcaggttttgttagcttgtgttgtatggcatctggtgtggtaggaatcgatgaaagaagataaaggtaagaccatactagtatatacaccctataaggctctgttcttttggttgagttgggaacccatccctccggtacggaaaacgaagcagtccattagcacgtgattaattaattatttgctaattttttttcaaaaatggatcaatataatttttttaagcaactttcgtatataaactttttgcaaaaaacacaccgtttaacagtttgaaaagcgtgcgcgcggaaaatgagatgggggagttgggaactccaggaaacgaacagagcctaagtaaagtgctcaagctacggaatttgggtgagagcaaaggtgttgatttgagaaaccaggagtgaattttgtgcagatgagtgtggtctagccttatattcactccattttcaggagatgaaacagaaagtggtcgatgcatgagaaacttttgaattagggagtgacaagagcataacttttaatgttggtggtcatatggcataagggtctctcactttttttaaacatcttttctacatttggaaaccttttcttttgagagagaaacaattggatactattgcttacatgctattcacgtgcgatgtccccctaaaaaactgaaagaactactaggcgtcagatatggataaaataacaggggaaaaaattacagcagttaagtaagtacaagtttcaaagatggtgaatggcgtatcagttcttgaacctcagacgggatcgataccttgaccacactgaataaatgttataaaacggtgattttattcttcttttgctaggagcatcaaatttttatgatgtcactgacagcaactatcatctttctttgaggacttgtcgttgtgacccaggaacacttgtcgtatggcatatttggtgctaaatccttctgtgttacgcctctaagacgcttttttggctaagcttttattgagcttgcactgccagctttcggtgcactagagtaggcactaatcacaaaagagcgacacctcacagcctatttctatcacaccgcaatctgaatctctctggatgtggatggagaattagaaatacggactatggagctcgtaaacggtaaggtctattcattcagaagcgaagataaaaaaaaaaa

SEQ ID NO: 52356 - DNA, 1501 bp, Oryza sativa
gataaattaatgcacaaaatagatgcgtagctataatatacacataaaaatgcccatcgaatctagacacgacttagtgcatatcacctaacaaattcccgactgaaggccaaataaattccaaataaagttttgctagaaccctagactgcctctagccgagaaatacgattaaatagcgatcaagatttttcccacaaatcaaaagagcaaaccccaaaattataccgaaacaaatccaagtgcaaaaggcatgtgcaaatgaaaaggtttaagaggactcttagggtttccagttggcttgtcctacggtcaaggtcggctctgataccaactaagaatttctaagctgaatgtgtattaaacccctgtccaggaccagccagggtacacaaacgacaattattgacatacagatccacgtcttacaaaaatataaaagattacaaatgcagcggaaaaaagaggaaaaaaacgagctaagcctgaagacttgacttctacagtgggcgactccattccacaggcatccttgacggtagcgacgaaaccaacttctttgtgacatcttcaactgagaaggacttcaactctagtgtgggggaaaagagagcaagaccgagtggcgaaggctgtcttgggaatatcctcttcccgaattctcaactgatgatagcctgatcgcaggtctatattggaaaacaccttagctccttttagctgatcaaacagatcatcaattcttggcaacggatatttgttcttgattgtgacctcattaagggcgcgataatcaacgcacatcctcttggtcttgtctttcttttccacaaagataaccggagcaccccaaggtgaagtactcggtcggatgtaccctttctgcagctgttcgtcaacctgctttttgacttttgctagctcattagctgccattctgtacggcctcttgtagattggagcagttccgggtgccagatcaatctggaactcgatttctctcttcggtggcattgtagtgaggtcttctgggaacacctcaggatactcttgtactataggtatatcctccaacttcttgggattccactaaaattatttccaaggctctgaaaattccactaaaattcctgttagcatattttgacatgtagaatccaagaaaaattccacatgccgattccaagaaaaattctctcttgcctttaaacaaataatttcttgcgacaatttattaattaaatttttgctagggagaagaacttcagggcgtgacagtattcaaatcctagtttcgccactgcaatcacggatggagggagtatgttttatatggaacagtggcatgtcaaacaatacctcgtatacatttatgggaaaataatatttcttcttgtgaattctacactaggatatcttttattatcagagttttacattggactagggaccaacaatattttctcttctacaagttttatattgaacatttgaattcggt

SEQ ID NO: 52357 - DNA, 1501 bp, Oryza sativa
attttaattacaccatcctaaccggccaacccaacaaccgctcgatgaacctgttcgtcgataggctgcgtctgataccaaggccccatcgaaaagcatatgaaactatgaacagagcagaaaattaaaaggtttagccgtgacgtacggcagctcgatccatcgagcacaatcgatttaatttggtttaagacctgaaaaaaatagttaaagcaatgcaacttgtgtagataccagcaattttctgacgatggcatatcatatccaaaaagttcttgggtcttttaatcgcaaagggttttttttaaggcatggactagcttttgatctctctgattaccctattcgttaagaacctatagaatgagaagatcgtgacaaggcacgtcgcaagcaatgacaaaaatgaaaagttgcatgcttacctcgatcggtagataggagaagagcagactaattaaagagttaatgctcttttccttgattgaaaacaagaaactaattaatgcttgagtgactgttgtcagagcagtgtgagtccagagctacctttttttttcctccgttattcttggcatcggtcgaggtctttctttttagacctactgcgataatcgtctgtcgagtcttgcaaggccacacgtacggagatgagcttttcatttcacgttttactggatgatacttataatacgacgttgctacaagaatttacatgaagcattaattgttagatatagatgataaactttgggtgtgtttgaggaggagaggattgagtgattgggaagatacgcaaaacgaagtgagccattagctcatgattaattaattattaactattttaaattttaaaaatggattaatgtgattttttaaaagaactttcctatagaaaatttttgcaaaaaacgcaccgtttagtagtttgggaagcgtgcacgcggaaaacgacgtgctttcttcctcaaactcactggaacgaacgctgcctttgtaatgatgacatcatgatgaataactttaatcactttgttgaattttgtaaatcgcagttctgttctcgagcccaaagagtgaactctttaatggggtggccttggtaatacgacgttgctactaaattttatactagaaaacgtgataccttccggtattttttgaatgatggtaaaattaccccctgaagaatacgtaacaaaaaaaaaaaactagaggacgtatgcacacgaacatggagactcgtcctaagctgtgcctgtgggcttgggtgaactgagcacttcccggtttttggcctggttagccaagatcaatcaacaatttattgtaggcttttagacattgtgtgtaaccatcctagttttattaaaaaaatatgtagtaagtattatttattttgttatgacttacttttgtcagtgaaggtatttcaagcattcatatcatatttctcacatttatacaaaacttcaaataaaatgaataatcaaacgcgaca

SEQ ID NO: 52358 - DNA, 1501 bp, Oryza sativa
gttgaactcatgcaagtactctgtaactatcctggtttcttgatgcagtgcgcggaactctcttttcttttgtgccataatcccctcaggaatttgtgccttcctgaagctttgacaaaactctgcccaagtaacctccgttgaatctggacgggtcaccacgtagttatcccaccaagcagaagcgggaccttgcaactgatgtgtagcaaaagcaaccttctcttggtcattgcattgcagaaggttcagcttcttctcaatcgcacggagccagtcgttggcctacattgggttggtggtgcttgagaaagtgggtggctggatatgatgaaagtctaacagtttggacaggtgtgatgatggaggaccagactgctggttctgctgcgcctgctgcaacatctgatggtaatgttgctgcatctgttgtatcatcattgtcatcatctgagtgaccgttgggttctcgggcggtggagatgaactgctgtcagatgcaccactgatatgagctccatcggtctgctcttcgctgcccctagcgtcattggaggcacggggatcattccctgtcttcaccatctggacgaggataggtagaaataagagaaaggaagaaaacagatggcttggaaactaatctttcttatagatttaagtgcaattaatttaatcttgattaaaaaactaaaaagaaagcaaacaactcctaattaaggcagtcataccactaacacatgatatcgaccgccgactaacccacaagcaacaaacctaaacacagaaactagcaagcagccaaaactaagaaaatgttaaggataaaggcggcgactctgaagcttggagcagcgcttgcgatcagagaacaggtctgacatctaaagaggacagagggataggaaccaacacatgctcaaaaccaaattaaataaagcaacaaatgactcaaataactcgccgagcatgatgatttttatgcgtggaacatttttcatgaacccagacaaagatactaatgcaactgactaaacgataaattaatgcacaaaatagatgcgtagctataatatacacataaaaatgcccatcgaatctagacacgacttagtgcatatcacctaacaaattcccgactgaaggccaaataaattccaaataaagttttgctagaaccctagactgcctctagccgagaaatacgattaaatagcgatcaagatttttcccacaaatcaaaagagcaaaccccaaaattataccgaaacaaatccaagtgcaaaaggcatgtgcaaatgaaaaggtttaagaggactcttagggtttccagttggcttgtcctacggtcaaggtcggctctgataccaactaagaatttctaagctgaatgtgtattaaacccctgtccaggaccagccagggtacacaaacgacaattattgacatacagatccacgtcttacaaaaatataaaagattacaaatgcagcggaaaaaa

SEQ ID NO: 52359 - DNA, 1501 bp, Oryza sativa
ttaatctttatggaggaaaaaccacaaattaacctccacatattaggtctagccatgtatcccactgtccctgtccttctctctcttactagcacttataggaacaatataaataaaatatttataacttttcaaatcatatattcaacttatgatctgttcgaactattatatttttagtgaaatcaatacattaatattcatattgtctatatttaaatgctaacataaaaattatattctagacccacatccatcttgaggccaacaataaattaaaaaagatactaaaattcgtcattgaaaatcagaatatcccaccttaatttttaataaagctggttgacccattacttatatcctgttagaccctaacactttctatcaaatttattaatttctctcaacatgtatatgggggctacttacctatataatatgaccttggtgcttttttatcaatcaatgatcaatttagaagataaataaataatcttaagatgatcatagagtctaaattatctatatgatctatgaagtcaccaataaattagaggaaaactttaaatgatatcgtgttttacgtcataatttgtaccccatctagcgttaattttttatagacaacataataatgtgtatttattacatgacctctattttaatatttcttactcaattgaagtgagataattcagaagagatgactttaccccatgtcaggttgtaggctcaacccacttatgtttttaacccaaattgcagaaatcaaatcatttcaaatatgcttcatagagtggaattctccaaatttctttaaaaaatgtacatgaaaagaatcaaaatttaacaaaaattatcttttttaaaaaaaaaattggtttgaaaacccattctaaacagaaacattcaaacttctagcaaagctagatggaatgaaaatatgtaaaacttcaaatactatctagcaaaaaaatgactttttgagcaaatgtttgggggtaagatatctatgcgagaagtcaaaatgaccaaaattttctcataggaactacatctattgtttcgacataatattttcttataaattatgaagtgtacagtctcaagtaattttagtttagaatttatgtgctgcaagggtaatcataagaaaattataaccagcattcaaatcacattaaataagttcaatttttatttagatagagaaacacccacacatggacatccctaacaaaatttcatgcacattaaataaggtgcacgcgcatgtgcgcgggctaccttcctagttttaagaaaaaatataattatgatcacttgtcaatttagttccccctcgtaattgtcacgcccagatattcacgaaccagaatttctaagctgaatgtgtattaaacccctgtccaggaccagccagggtacacaaacgacaattgttgacatacagatccacgttttacaaaaatataaaagattacaaatgcagcggaaaaaa

SEQ ID NO: 52360 - DNA, 1501 bp, Oryza sativa
ggtgccgacggtggcctctcttcctcgcattggcgacggtgcatcagcggcgagccagtgacgatgagatttgaggaggtggtgacaggaacggtgtcggcacccctgcgcctctatggccagtggcttccacctctccgggcatcggccggcggtggtgcgacgcactccagggccgcaggctagctagctcttagttttttcttcagtatatgtaatttgtgatggataatatatgctgccaaaatttagttaaacttcagttgtagttttatcgattcttcgtcaaatttttgtgtcacaaatatgttaaaatgttatttttaaacaactaagtgtatgaaattagaccgaatagaaaacaaatcacggtcaaatacgcaagggcataaatgtctttttagccataagttaacactgttacgttggattgacagaatagggtcaggcctgatgtttgtttttgaaaagcagggtaaaataagctaagttaaaaaaaacagggtcaatttagtagttggctttcaaaacagagtcaaatatgcaattgccctaaataaaattggtagatctcaattagttctacaactttgttttttacaactttttcagatgagttcatctagtaccataaaattcaatttgaaattcatttttgcctagaagtctgatttaccctactcgtgataatacttgctaaatatatatttgatgcaattaactcggttttgctggtgaaatatatgatcaaaatggatgttatatgaatgtggttgtattaaatatattgatagttaggtatatgaataaatgtatatgaatagggaatgctagggtgtgacatccttgcccagggcttaataggattaatagaatactcatgccaacaagttacaatttctttttcggaatccaatcttaaaaaaaaactatgagattaagcgtgcttggcctagagcaatttcggaatgggtgaccgaccggaaaaattctttccgggtgcttagagatgagagtcatccgtgacaggctatagcttaggcccattagagatgagagtcattcgttcgtgatggccggatgcccgattaagatattttctcacattactgatctttgcttagtgacgggtgccctgtccgaaagagatgatgctttaaacccattacagataaccgatcccgtttctttagtggacagcggatgcggagttgtctcagagaactaaacaagtctaaagtcaatggataactcaggacaagccgatatatgctatactctcttttcccataaaaaatagtattttttaaagaaaaatctgaacaaatacacgtcaaagatattcatgagatggacacaaggaggcggacagggccagcggactagacaagcacctagtgcagacggctaatgctttacgcctttagaagtactcgaccctgtgctgcaactgcaagctgtctcactaacacacaagtctgacgcacaaaccggaggcacg

SEQ ID NO: 52361 - DNA, 271 bp, Oryza sativa
ataaacaaaaccccaactagtgggcgctctactcatggttcccctagtatgaatttagatagatgcttcgctgattaataagacaacattaggtggtttttataactttagactttggaaatattcatatctcttggactttatgaaatggttggactattgtggaattggatgcacacctctccctctattcaaaactctcaaaatggttataggctgggcttggggtgcatggttttgatagtagcacctcggccacataaggaccggt

SEQ ID NO: 52362 - DNA, 1501 bp, Oryza sativa
ataccaagataattatgagctcaaagtatagattacaaaatttgacatttgtatctgaaaattacattgaaacttgtagcagaatttcatgcatatataggtttatagatatactctagatgccagtgtatcaaaactttatacataggtgtatagatgtatgattaactatcatacatatatttggaatgttgatcccaaagtacatgacattacagaccacttgttctatgcctagatatgtcaaactacatttatgattaattatgccatgttattaacaatatattatgttcatgccatgtgtacaccatatttgtcacaagtgtagtccttaatttaaaacagcctaatatgatctgttcatgccatgtgtacaccacatttgataattaaatatgtgtgttcttttaaatgcttgtgtatataccaagataattttgagctgaatgtatacatcacaaacctagacatttgtttctgaaaaacacaatgaaacttgtaagtgtgtagttcactcaaaaaaacacagaaaaatatgaacttttcatgccatgtgtagttcacaactgatattacatctgcagattgtgtgcaatgtttttgtacatagaatgataagtatgagctcaatgtatggattacaaaaaatgatatttttttctgcaaattaaattgaatgttgaatgttttctgatctgtctagggtactgaattaaagtttacatgttctgatctctctactatgatcttttcatgccatgtgtagatgacaagagcacatttaatttgaacatgtctgcaatgtttctgtatttatcatgataacaatgagcagcatgcataggttgcaaaataatccaaggcgatcagccatgacatgttgtaattaaaatctgacctgttagtgccatgtgttgaggattactgataattgaacttgcacatgtttgaattattctgtattaagcaagagatttaggagctgaagttattgtttgcaaagttggcatgtgttacatatctaaaacaatatttccagcaacaacgtgatcaaaccacataactgaattgtgtgttgtatttgcagcaaaactttaatttatcttagatgtaatgacaacaataaataaaacttatcttttaagtaccaacttgctgcatctacaatttatgaacgcatatttgtgcacttattttaactactcagttgtattgtggtagaaggtgatatgcttccgttttttttttcttaacttcaacacatggttgctgccatgtgtacactaactgcactacatgtattttcacttgctactgttatatactttgttataacaaatgtgtgcctatgtgtatttgattccagattctactgttttgaacatgcttacatgtttacatgtgctgccatttctatatcctgccatctgtacatgcatacaagtggttattttctgattaaaccaactatgtgctgtaatttgtgtagcttagaaga

SEQ ID NO: 52363 - DNA, 1501 bp, Oryza sativa
gaggaagatgtgtcttgtgggtaaagatgtacacctcttatcagagtataacctatttgaatagccgcgccctcggttatgggcaagctgagcaatgtacccaagttagtgttttaattcttaaaacctgcctaacagctaaaatgtggaatggttagcctgggttggcttgggacgagctaggacccagggtcgggttgccagttcggtctgaatcatcgtaggccttgggttaaggcaggttcgtgtgggtttacggccttggttaataatattgtatagctctaggaccgtgtttacaaagtgacttttaatgctgtttactgcaaaccctaaccccctatattatggctcccttgtactcccttgcatttattctgcacttgtgggtgtatcttgttaagtacggtggttgtactcagtcttgctcaatttttcccaaacccagaagaggagcccctggatgatgaaggctttggtgtctagctcgtgcctgccgtcaagcgcctgtggtcgtcgccctagtcttctgctgtttttcgtttgtcttcttgtgtgctgggtcttcgccgcccatgtaataaattaattaattacgcttcagcttgttaaactctgaattgtatcaacttttggtgtaccttgcctcctgggacaaggaataatgcacgcacataaggaacgcccgttgggttatttccggtcgtgacactgctggtcatacaaccccatcggctgaggaattaggcaaacagaggtattgcaaatggcataattctaggtcccattctactaacgattgcaaggtttttagacagcagattcaggtggtcattgagggaggcaagattaggtttgatgattccaaaaagccgatgaaggtcgatggtaacccttttcctgttaatatggtgcatacagctggccaagcagccgatagggcccatgcaaggggttttcaggtgaattcggctaagattttcaagaaatatcggaagaagtatgacaagcagcaggagaagcatcatgagaaatacgatgatggttttgatcctcattggggttgtgagttctttagattctgctggaatgaaggtatgaggttgtcatctattgaaaactgccctgggtgcagtgatatcatcgagaactccggccgatcatataataggagcaatcggctaaggcagatgagagtttctgttcatcaaagattgggtccaattaatcaagatcatggccactaagcatatcgacaaggacaatgtgattaggaagaatcaatggtgtccttctggtattttcacgaagaatcagaagagaagggttcaaagattgaggaacagggagcgcctttagggggttgaacaagaaattaatcatcggctaaagaaagcaaagccaaggcaggagtggcgtgttaagaatcaagttcctgtagctgatgatgttgcagccgatgaggcaaagaggttggcaaaagggaagagtgttgtgacgg

SEQ ID NO: 52364 - DNA, 1501 bp, Oryza sativa
catcgtaccctgcacgatatagtgacgacccagtcctatacgggtaggaacctttccattggtggacttcgtgatggatttccttagtgtatacagagaacgtccgtacacgcgcagatgtaccatattgtcgtatagcgtacatccaagggtagagggtataccttatccgtaactctgacaaatatatgtaaattacttttagactctattaaatttacttttatatgtctaagaagtaatttagtcaactctaaaagtaacttttatatatatatgtatatatatatatatatatatatatatatatatatatatatatatatgagataagagtaacttacatatataataaaagtaatttataaatataaatattttttcatcgtaatataatcacgtaagattttgttgtgaagatttaattgtaacgaacacaatggtgtaatcggattgtagatcggataagtaatttgagagaaaactttatttgaagaggaaagggacgtacatgtatattaaaaaaaatgcatgcatgtagtaccatgtagtagctggacttctccacgtttctccgtatttagacgtcactagttaaggcaaaatcaagaggcctctccaaatagattttacgaaagagaaagtgtaacaccctaaatattcagttaaagatcagtaaaatttccaacttttgcatcattctaggatcttgttgcttgagttatgtggaacttcaccttaaaacggaactataaataattaaataccaaaacctaccgaggaatgtaaatgaactaatttacaaatatcaaataaagcacagagaaatcaaacaccaatttttttctatataatccaattatgatgtaataaaagtccgggaatcaaataccaatttaattcgctaatcacaaggtcatacgttatacacaaacacaagcaatatattgacgaattataaaaggggagataattcaaatacaacaaatatagttcaattataatttaagaattcgatttcactctagtccaagcaaagggctaaaggaagatcaataaaaaaaatcaaattatttatacaactataatcagactacacattaacaaatccatattaaaccctaaatataagtctgattcccatacttgggcttaaaccatcacacgttaaaaggaactccaaatgggcctcaaggctcagctacttgagctcggcttgttgcaaactcgttttctgctgggctctcgactggaaatcgagccgaatgaaatccctcttcttcctacttgtaacgcttgcgagcttcaccgagccgagctcgaccaagctgggctaagttcgtgttgcggcttggcacatcccagccgtccgatcgagccacccctcccttacaaaaccccacccaggccactaggtttcgcctcttctacctcttctcccacctgcgccgccgccactcactcccaaaccctaaccccggaggagagggaggagcagcca

SEQ ID NO: 52365 - DNA, 1501 bp, Oryza sativa
tcaaagtataacatcggtttctaacatctctaaatctcttaatataatcaatgacagattcattatacttttgcataaccgatgtcaaatcacataacctaagctcagtttctctagtatagaaataatcatgaaattgttcttctaattgagcccaagtatgaatagaatttgctggtaaagaagtaaaccatgtgaaagcattaccggataaagataaagaaaacaagcgcaatttaaaagtatcactattagcctcaccacattgcgccaaaaattgacctacatgctcccatgtggtcttaccatcctcaccactatacttggcaaatttgggaactctataatttcgaggaaacagcacattatcataataatcaggatatgactttttgtaagttctagcacgatttctagtttcaatcccgaatctattcctcataatatcactaatcatatcctccatgttattaggcccttgttgatttggcggtgggtttggtggcctaataggttgtgtttgtggcgcaatatgattatattggccttgtcttgtatcgggaggatatcccctagaaacatcattataagcattaggaatatgtgtcacgtcccaaaacgaccctaaaatatatcctctaaattatgcctagaataattaaaatccgtgtgaaagcctccaacaattaaaatgtgcaaagttaaaagtcaaataaggcttagaggatttttgtatatttcctaaaagcctaaaatgtgtaaataaattttagtggaattttcagagcacaaataataattattaagaaataaacaaagttaaaatgattttataaaaagaaaaaccctaaaatccctccttctctctaatgggccgaattcggcccatctccctccccctctctctctcctctcccccgcggcccattcggcctccctcccagtgcgcgccgctgacgggcgggcccgcccgccaccctccctgacgggtagggcccacccgtcatccccttcctcccgccgctcccgccgcctcccacgcgccctagcgccgccgccgccgcgaatcccgccacctcccgccgtcctcgcgtgcaataaagtggggggaatcactccccgtgatcccctctccctttccccccaattttccctccctctctcccttggattcgtttggaaaccctcccctaatcccgccggcaccattgatggagcccgagagcgccgcgccggtttccttcccctccggccgctctctcccccttccaaccctatttaaaccctccccgcacctcctccgtccgtttccgcctctcgccgcccttcctcctcgccggatttgagctcgcgacgtcgctctctctctccgccgtcgccgccgagctccggtccgccgctgtcatcgccccggaccgcctcccagctcggcgccgtctccttcggcttcgccgcatcctcgccgatctcgtccacctttccgttttggtcgccgaccgcc

SEQ ID NO: 52366 - DNA, 913 bp, Oryza sativa
tgatagatgtgaatcagaagtttcgacgttctcaggaagctattcgccgtattcattttggcaaaaaaacctgaatacctctcgctttacatttatttgttcttattaacttctgaattatttgcttccttgcccaatttttaatctgtatatgtctcctgaagtgaggctcatgctaatcttttgctgtatcgactatggctactactatgcgtgggaaggaaaggctctttacagtcttggcgtactcacctgagactttaccgtcttaccgagttaaactcaggatgtatataataatagggaaagtattttcttatttcgttttcttttgtgtttgttgtgtttttactgtgattttgtacagtagtacgttttcattttatttaatgatttgtcttgctagaaaaagaaaagtagaacaaagctcgatagattctaaagctgcgtcaaaagactcagcaccgaccaattatgagctcttctcttttctttattttaaacaaagtctatttctgtcccttaactattgccatggtttaattttcgtccattaactatgttactcgttttatccaaaagtctgcataacccagaagtattaagatgaatgtttggatagagtcaacaatttaaatcatgtttttgggaacttaagattctgataagctgttggtaagatctagaaagttgggtttctcatcttttggcttctagttcattatatggattctacatcaacaaattatcagaatctggttaaaaataactctttggggaatgtctgacagctggagtttctaagagaagctatagctactataaactctctcgaacaggagttgaatcaaatattgccaaacgaaaagacaagctcttcatttaagttttggatgtatagagattacaaata

SEQ ID NO: 52367 - DNA, 1501 bp, Oryza sativa
taaggaccgagccatgaagttaagcatgaaacgaccctcgtacaaccgcacttctcgtatgggtatagacctagcggagtagatagccgagcggaagcagtatccctgcatagatggttcacccctgagtgaggcaggtgcgctacggtgggacagccattgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgtggagtgcgggtaaagtgtacatccactgcagtgtgagtaaaccaaatctattcgaatagccgtgctcgcagttattgagcaccgggacatgtattgcacttggctagactctaaattcttaacctgtgtgggatgggatattgcatgatgatttttatgctgctggagccacttcctgagaggagggaaggtggacatcctcagaaaaccatgacgactcaatggcgggaagctatccttgaaatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttggaatacccctttcatatgcattgttgctgtggtggcttgctgagtacggttggtactcacccttgcaaatataaaattaatcagaagcgggagatgaagcttcggaggatccctatgcctactaccaggagggagatgaagacgatggcgctcagtaggtgttagtacggtcgttgcctgtggcaatggcatgccgctgcctgaattccgctgccttatctatttctgcttttggatgtattccggaccgctcggtccgatgatttaagacaatgcctgcgggcttctgatgtaataattagcactagactctcgtgtatgtacttttggtatttcagctatgaactcgtgtgtaccagactacttgatccagggaaatggtactgtttacacgaatgattcctgttataaaaacgggggtccacagagctggtatcagagccatacgactgtaggaaaagaccaaaaggcgctccaccccttttctaagttggccaagggagaaattcccatttagtaatactttcaaaaataaaaacgctatgtttacaaaactcggaacgattttcatcttactcttaactattttcttcacaaaacaagttttactcttagctgactttgggtttttcttaaagattagaaggcagatcaggattcacccgccacctgggaga

SEQ ID NO: 52368 - DNA, 1501 bp, Oryza sativa
gctgccgccgtcgtcgccgccgccgccgctggtgagccgtctttccccccccctcgcgtccaccaccgccgctgctcgggtggacaagagccgagagagagagaggaaaggagaggccggtagggaggaataagaaaagaaaagagaggaagagaaggaaaagaaagaaaggagccgggaggagagaaaagagagaaaaagagagaaaaagaaaagaaaagagagaaaagaggagagaaaaagaaaagaaaaaaaataaatagaaattagaggaagattagggaagtttagaaaatttaaaataattagaatttaattatggattaattatagtcgtagaattgcaaaatttaatataaattatggattattcttggcaatttctataagaaatcaattcgcggtaataatttagatgtagttaattactaaacaaatagatgaattcttatagattattatagattatttttgggtaatccctataagtaatcgattcacggtagaaattcggatttaattactagagattttagccgtgtgttacatttaatcattcagtcttagactaaattaaatcgtataatatttctagggtttcgtccgatatttagctcgcgatagaaattcctaacctattatatggatataatgctcgggtaaattaaattaaaaacttatgacaacaaaatatttatacccgcaaaatagtttaaatcgaaattgggtttgccgtagttcgcggatagtaaagttaataaaaaggaatcgactttcgcattcgactgtcatttggatttatttggattcttatttgaattctaaccgaattcaaatcaattttcgcacgtaactatagagcctgagggagttgcggatccaagcgaaggccaagacccgcaagactttgagcaaggcaagtcatcactattccttgaacatgttgatcccaattgcgaaattgttttgtttacaaataaaattgcatgcaatgatgaacatcctacttgtgattatgccatgccttgattattgattacccttagatctttgtaaccatgtttacgtatgagtccctagtcaactatgacaattgcttagaaatgctattctagaatcatgcatactcatatttatcaaatgctatatgtttgggcaattacctttgggaaggtaatggagatgcggcatgtggagacatgagcgccacattgccatgatgttgatgacatgatttgtgaaaggagaaataaaattacacaactgttttcgactggggcggacggaggatttgggtggtatctggaaaaggctagtaccgtccccggtcaattaaggaccgagccatgaagttaagcatgaaacgaccctcgtacaaccgcacttctcgtatgggtatagacctagcggagtagatagccgagcggaagcagtatccctgcatagatggttcacccctgagtgaggcaggtgcgctacggtgggacagccattgaggtag

SEQ ID NO: 52369 - DNA, 1501 bp, Oryza sativa
atgagccacaccaattgatagaataataccaatcaaaagagataggcctagtttgtagtcacaattggtaagaacccatatgcacatatagcaaatacattgattagataaactcacttaatttggagcaaggtacaaaagcatgattcaaaaaatattttctctttaacacatacttctcccaaaactcactaaaaggagggcaaaaagtatgtcaggcatataatgctatagacaagtcatgtatgcccgaaagaaaagtctcataagccaagacccaataaatagtgacgatgaagagacatatcaagacttatgtagcatcacaacataggatgaactccttctaaatatgtgcatacaaaagagtgaaaagaaatctttatgcactttcacaaaagaaatgaaggaacaaaagaatccatcctatattatgaaattaaggttgcaaagaaaatccatagaagcaataatgaagtctaccttgggagtcgtccacttccgacataagactaaaagtataaactcaatttaaaccattagtcttccaaggtatagaataaactccccctcaaggtgtgcatataaggataaatttaatgcatacatatgcactttactcaaatgagaattggggaggagtttacactatattttgggtcaggaggcaaatatcaccaaaagaaataaatttaaggactagaattgtaaagcacactttcataaacctcacatttcaagatgatggtgcttaaccaatctcatccttcttcacccattccttcggttgtcataaatcaatctccccttgatctatcattacctcttttctctatttgaatcaatagaaaagagaaagcataaaaagcacacgagtttcacatataatgatccttttgatgtggaggaaaattggatcacttattcatgaaacctcataatatagactaaattctcccaaaagtaatgcacacatatggtggaaggcaaatttatgtgcattatttgacatttaaatcaagcaagggaatttaatctatattatgaaaggtagctagataaaatatacgatgaaaaggtaattgaattaccacttgtgaatagcatacttttgagaatgtttcacttcccatgagactaaacataaaatacacttaacaagaagttagtctcaaaaatacaaaacataggacatgctccccctaaatatgtgcatgcaagcatttgaattacttgatggaaatggttatgagtgaatttaaattgaagtccaaaaaccgcctcgcgcaacggacccagaaatttccggcggccatctctctcctttccttgcaattcgcaccgttggtagtgtgcctatttaaaggagttttgggaatccattttggagtccagttgttgcaaaaactttctagcctctgaacgctcttcgtcttctacgcttccacgcaaaccctaattcgctcgcctcggtttcttctcccgcgatctccaacggcga

SEQ ID NO: 52370 - DNA, 1501 bp, Oryza sativa
tgagccctctgccgcaaccacgccgcacattagagatttaattgagttttatgtttcggatgctccagctttctaccagaagtccagaacacacatacatcagcatgaagatgagatgattcaggtcattgaattgctttgcattcatgctatcatattttgatgtgtcatttaatcatgttcttcatatatttgtttttccaagaagggcagcaggtgacagttgttgatgcggccgtgtttggtggtgttcacagttcttgaactgcaggagtaatcggtttgctaacacagacctgatctcaaggtgctatgcagcttccagtgaatgtattgtcttactatgatctgcacatccacccgggcaactctttgcttcccaaatttgattgcttgtgttgcatatttttgccgatgtagaaatcatatgtttttaatgttgtatgtcctgacggtttggcaacaaatatatccccagtatctttttgagaactatcctcaatatctcacggtattatttcatttgcactctaaatgaagaatttaaaagaattataaatgcaattttcaatctgatttacctttgtacatgattcaagattcagtgcagcagctgtagtcttcctccccatatcagaaagaatgaatcttaatggtgaggtataatcctaacgttatacattatgctttcatttgctcacaataaaacttaaataatgttcaatataagttcacatattgttctaaaagttttgttttgcagattggtaacattcactcatatatgttgtcagttagctcatgtcctattgatgcaaattttgttgttctcctctctctgcttggcctcggctcactgacaaacacctcctgtaccttgcccattcctctacaacttttaattgcaattgaaagatttggaacaacagaagaggaagagagatttgtaactatctacaatgccatttgaggtaggttatgtactgttaaaagtgttttatccattcagttaactgataggtagtctactattttgtgagttttaagtgtcaagtgaatgtgtactgtacgatgtaatggcttggtaattattagtaatcagaattaggggaaggtaaatctcttctttttatcatagagcagcacaaatatgtaatcaattattggatactttttaccttctgtatattttctgcatgtttgatatgtactccaccgatgaatggctagacttaacactcagagggaggacagaggaagaataatatactgatatatagctatgcaccgtttatcaacctttagtttaatgcctcaacaaaatgaattatcgggttgataactgaaacatttctaataggtgccacaggttacttgattagggataattgttccccattttctgataactgccaaagggtttttaatggcttaaatacttccagttgacggctgctggatgattttatcctcactggctgctttccaaatttttttaccg

SEQ ID NO: 52371 - DNA, 1501 bp, Oryza sativa
ttgatcctgtaatcaacaagaaatagaagcaaagaaaccgcagttaaatctataaatgtagccgattggctaggtgccgatgatatatcatttatctttgagccgatgtcatatatgcatcgatcggtagtcattaataaataagaagggactaaatctactcgattggctgtagatattaacaatatataatcattattttgatatatacttaaatcaagtgattgggatagatcgatcgccatgccgagacaatataaatcacttagatcgaaatatatattaataatgagtctatatacgttcatagcataaccgatcagatagatctagcatgtatcggctaatactccgataccactctatattaagatatgaaagcaagtagaatatactaaacaaaagcctaatatactaaaatgcagcaagatcttaacgtaaagggcagatttaacatgtcaatcaagcatataggataaaaagtagttaaatcaggtaagatcggctgaaactccgatactaccctaatcagcaaccaaggagcgggctagagattgagattctaatcacgactcataagatcaaacttaactgatgcagctataagtatgaaaagaagaacaatgtctagacaatcaagccgttggatgtgtcatagagtggtagatatcctatataatctaagtcaacatcagtatttaacctaatcggctgccttctattgacggatgttagccgattgtaggttagatatcgatattgccaaggattatgtaggatatatgataactcgacgaattacataaacaagattagagtgtcataaagatggaagcactaatcctgagaactcaagccgccataacaagttttacctcttgttgaagatcgaaaccgatgcagctcaaccagaaagcaagaactcgtcgaaataaaactaaagcaaaaaggtggcgatgcgccgagattgtattgaacgtgtatgttaaaagttacatagggttcgggtctatttatacccgaaaatcacaagatatgtccataacggatacaactactatctctaacaaactctaagataccataagtctttgcggcagacttttgcccaagcatatctccaaggagattacataaatcatcctaattaatagatacaattgccttctcaggctctatccatgtgcggcaatcaccttaaagcgccttaattcaacccgatatcatacatcagtatgcattgtcggaatcggctgcattggcttacctagctcgactcagacccagccgatctggactccagccgattcctgttctgtttctgaactcgatctccgcctccgactttgtttcgatctaatcttctttcccaatgccgatattaccaaatttggttgttaacacatgccccccaagtccggaatatttgataatttttcggatttgctgtaaatcgactctgagcaagtttcgcactttgccgttttccgaccattactgc

SEQ ID NO: 52372 - DNA, 1501 bp, Oryza sativa
gcaacctgatgtatgatatcgggttgaattaaggcgcttcgaggtgattgccgcacatggatagagtcctgagaaggcaattgtatctattaattaggatgttttatgtaatctccttggagatatgcttgggcaaaagtctgccgtacagacttatggtatcttagagtttcttagagatagtagtcgtgtccgttatggacatatcttgtgatttttgggtataaatagacccgagtcctatgttacttttaacacacacgttcaatacaatcccggcgcaacgctacctttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtatttcgtcgagttatcatatatcctacataatccttggcaatatcgatatctaacctacaatcggccaacatccgtcaatagaaggcagccgattaggttaaataccaatgttgacttagattatataggatatctaccactctatgacacatccaatggcttgattgtctagatattgtccttcttttcatacttatagctgcatcagttaagtttgatcttatgagtcgtgattataatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctacttgctttaatatcttaatatagagtggtatcggagtattagccgatacatgctagatctatctgatcggttatgctatgaacgtatatagtctcattattaatatatatttcgatctaagtgatttattctgtctcggcatggcgaccgatctatcccaatcacttgatttaagtatatatcgatataatgattatatattgttaatatctacagccaatcgagtagatttagtcccttcttatttattaatgactgccgatcgatgcatatatgacatcggctcaaagataaatgatatgtcatcggcacctagccgatcggctatcatttatagatttaactgcggtttctttgcttctatttcttgttgattacaggatcaaatcaactggcacgctcatacattcgaaggcgagctttggaccagcactggatttaagcagatctcccaggcctcgtgttttctgtcaacatgcttttgatatatatgtgcccccctaattttacaatgacaaaaacattgataaaattataaaacaactaagggtgatataacaatatcggctattgtacatcggcaaatgtcacgaccggaaataacccaacgggcgttccttatgtgtgtgcattattccttgtccca

SEQ ID NO: 52373 - DNA, 1501 bp, Oryza sativa; identical to SEQ ID NO: 52311

SEQ ID NO: 52374 - DNA, 1501 bp, Oryza sativa; identical to SEQ ID NO: 52305

SEQ ID NO: 52375 - DNA, 1328 bp, Oryza sativa
caaatttgtctttaatgattgtttctctctcctattcgtccgaaaataataaaataatgtcgcgggtgtccagcagctaattaccagttttttgcgatgccctacagcaaatacgcgtttttacggtgtcccctagctaattacacgttttttagatgtcctgtagcaaattttgccaagaacattagcattggtgatcagcaaaattggctttatttttagtgacttcgatttctatagatcagtgcaggatagaaacaaatctggagcagatatgaatgatatctttttcaatgacattatcagctcccttggcttgcttgagatccctcttaagggtagaaaatacacatggagtaacacgcaacaaaaccctcttcttgaaaggttagattgggtgttcacttcagctccatggaccttggctttcccaaacactacagtggtgcctttaactagaaatatctctgatcatgtgccatgtgtagtgaagattgatacaaaaattccaaaatcccctatttttagatttgagaattattgcgtgcagatggagggattttttgacattgttcagcaggtctggtctttggatccagggtttgaggaccctgctaaatgcatttcttttaagcttaaattgctaagaaagagattacttgcatggagcaaaaatctgtccaaattactgttgcttctgaccaactgtaacaaagtgattgattttttggatttggtggaagaaacaagaattctctcagtctttgaatggaatctaacagaaattgtaaaagtgcaaattctcaagttgcaggaatttagaaagatctattattagaagaagaggtgcactaacaggtggatgatgcttggagaggaaaatactaaatttttccaatctattgcaactgagagatacataatcaatgcagtgtcacaagttttggatcaaaatgggtagattgtgcagctacatgcacaaaaggcatctctttttcttcacagttttaagaatagaatgggagttacagctggtcctcaaatggcctttgatttgagtactctcttctcccgaagcacagatttggaatgtttggtggacatgttttccacacaggaaattgacagtcttatatccattgtcccagcagataaagcgcttggaccagatgggttcaatggtttctttatgaaaaaatgttggcatataatagctcaggactactacagattggcatctcattttcatgctggatgcacaatttggaaatcttgtagttcttatataactttggtttcaaagaagaattcaccagagacggtcaatg

SEQ ID NO: 52376 - DNA, 1501 bp, Oryza sativa
aaagctaaaatttaaaaatttaaacttaattttggagttaattttaagatattttcaacgtagttttgttttcagcattggcttttaagtcgctaaaagaacacatatatcaaatcctacctgtaaacaaacttttattgacttttattcaataataagctattaaacaacttattagaaaatatgggcaaccaataagggcccccatcgaaatattggactagcaaactttatttggaatcatttttccctcatttttttagatttcaaacatatgagctcaaacctctttgtgtttatttccttagaaaagtagaaggcactttatctctcctcttaactttattctaataatattttcccctaaaatttattcaatttcttgtggaatattcaaacatatgtttaatttcaatgcgatttcaatacctacaagattgtgtatatcatgacgtccaatttatgatttttttttctcgttcttattttttttctcaattcatgtgttccaaaggagtctaaaagaggtcttattcgtaagatcttcccgtctattacacagcccaagattaggaaattaagggagatgtgtatgttagaatcaagtttatcgaaataatgactcttcctccattcataagaaatggaccctgaatccctgatgtgtaccgatatatcatcagatatttgtcattttcacggaacgataaagcctctattcacgatcaacgagcatccagtgacgctattttcattggcaacataatggtcccatcggaatcttgggaggcttgtcaggagctggacagcaaaggaataacttctctttcagagatagacagttgggaccagaccagacatcaaagaacgaaccattgatggctccatgccacttcaatcgacaactttcatcagtttaggcatctgctgttctatcaacttatgttgtaccagtagtctcgttgctgtagcaaaaatggtggtagccatcgacagcatagcagaacagataacgaaccagctgaatattgctacaagatgctttcatctcaagcatgtaattggggttcaatcatagagaacacaattttatcaacaggttagtgccttcaaaggccaccaacattgctcccagattcagaacagcctcatgcatatacagcgtcacaaataaacgggtccatcaaatagctgatagacccacataaaaggttacaagtctagcaaacctggcaatttatgttacatatgctctgcaccaagggagatgctatgtcaagacactaggctatattacattgtcgaagttattgtgcacaaatacgactgcagcgcaggcattttcgaagaggttccatgttgatgcaacccatgacaattagaatgatgggggccatgccaataagattagaccccataagtatagctggagctgttagaacttgaaggccaaatatgccgttgataaaatatggttacccttcttcaagctccatcattt

SEQ ID NO: 52377 - DNA, 1501 bp, Oryza sativa
aaccatactattaagaggggttccaagtgtggttctgagataacacaagtgctcttagtggtgtccaagtgttgaaatatttttaggagctgtttttgaaaatggctctactcgggacagagagtcccactcggaggttctgtctggaacttcctggcgccgaggtgaggttgaaaattttcctaagtgctggccggaagttcctggcacttttaccccgaacctcctggtaggtttccagttcaaacttgtgagtaatggctagatgacgtcacctagccgttatatatatggatttcgtccccaggtcaccctttggccattccactttagttcttgtgttccctagcttgttctatcctctcccaatgtgattttgcttcctccacctaaatcttgtgtatttcttgagtgagagagtgattttgagggtggtggtgaggattggagaaggttttgaaggctaggttgacttgagcacttggggtatctcgttgggctgtcatttggagcttgttactcttggagggtgacctcctagacggttaggtgtcgcccgcgagtttctaacaaggttgtggattgacccgggcaagtttgtgagggcgttattccacctccaaaaggaaacggaatactcggtgagtgtaatcctaggtgaggtttaggaggtcgtcttggtagagcaagccttacttgtggtgttcttttggtgttcaagttggggatcttagtggtcacttgaaaccaaagagaagtacctaggggtgttggcttgaagaccggagacctcttcctaggccttttcttggtgaggcaagggattaatcaagacccagctctttagagctcctcaacggagacgtaggattctcggtggagaatccgaacttcgggaaacaaatcgtttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgatttaatttacttgttgtgaggtgcttgaaatagcaattaacaactgcccggaagttcctaggaagaaccccggaagttccgggcagctttctctgcttgtgagaaaaagctgccaggaagttccggaccttttgccaggaagttccgggccctgattttaaccgttgtgttttgaagtaaattttaggaacgcctattcacaccccccccctctaggcgacatcaaggccctttcattgtcgaccactccttgtctctacggtcctcacaccaagatcgaccagtcgagaacgacagcaactccgacatcagaagtcgcgatcggttacatgagttcatttaagctgaagtcgggggctactgtcagggttacggataaggtataccctctacccttggatgtacgctatacggcaata

SEQ ID NO: 52378 - DNA, 1501 bp, Oryza sativa
gaaaaaacataggattctgataggaatataagtgtaaaacagaggattgcaaaacacaggaaaaacataggaataaccgtttgattggaccacaggaaaaacacaggattttgaggtgagataaagactcaaaggattttttccatgaggttttacctcttgttaaatttcctctaaaacttgtatgggaaaaggcattccataggaatttcataggattccataggattcattcctttgattcaaagggctttgtaggaaaaattcctataggaatgaaatgctctaaaatttctatgaatttactttgaatcaaaggggcctaaaccccttatttttagttttctttaaagaattggatttgcaaataactcaaagcctcattggttgccctaataagccaaaaaccaaagctaaaatttaaaaatttaaacttaattttggagttaattttaagatattttcaacgtagttttgttttcagcattggcttttaagtcgctaaaagaacacatatatcaaatcctacctgtaaacaaacttttattgacttttattcaataataagctattaaacaacttattagaaaatatgggcaaccaataagggcccccatcgaaatattggactagcaaactttatttggaatcatttttccctcatttttttagatttcaaacatatgagctcaaacctctttgtgtttatttccttagaaaagtagaaggcactttatctctcctcttaactttattctaataatattttcccctaaaatttattcaatttcttgtggaatattcaaacatatgtttaatttcaatgcgatttcaatacctacaagattgtgtatatcatgacgtccaatttatgatttttttttctcgttcttattttttttctcaattcatgtgttccaaaggagtctaaaagaggtcttattcgtaagatcttcccgtctattacacagcccaagattaggaaattaagggagatgtgtatgttagaatcaagtttatcgaaataatgactcttcctccattcataagaaatggaccctgaatccctgatgtgtaccgatatatcatcagatatttgtcattttcacggaacgataaagcctctattcacgatcaacgagcatccagtgacgctattttcattggcaacataatggtcccatcggaatcttgggaggcttgtcaggagctggacagcaaaggaataacttctctttcagagatagacagttgggaccagaccagacatcaaagaacgaaccattgatggctccatgccacttcaatcgacaactttcatcagtttaggcatctgctgttctatcaacttatgttgtaccagtagtctcgttgctgtagcaaaaatggtggtagccatcgacagcatagcagaacagataacgaaccagctgaatattgctacaagatgctttcatctcaagcatgtaattggggttcaatcatagagaacacaatttta

SEQ ID NO: 52379 - DNA, 367 bp, Oryza sativa
ctccatacaaacttacgcgcatttcactgggatgttttctacttttcaaatagtacaacgaagatagtgatgacgatgaggaggatgctgacaaagttgttgcgcagcctgagtcactagaggtataatactgtactgtttacttgatggaaatgcatgcaatctgcgattctcaatgtagccttgcgaatttcttcttattactggcaatgacaacagatctttcagttcatatacatgcttattggaagctgaatgcctctcttgctgtgcatggaaatagttgatttattgatgagatagttatcgatacttgtcctacttgaaagcttgtcattcctttgtattatactgctttaccaatagg

SEQ ID NO: 52380 - DNA, 1501 bp, Oryza sativa
tcagatagatggagaagtgaaatgatgcaatgatgctgaattaattattacatgggaatgttgaccacacaaaaagttaactttcttcataattaaacagatggatacacactgttatgggcaaggtgtaattgcattaaacaccaccagaaggatagccgggcggcatcggctgctagggatgagaagcggaatgtaggatgagttgatgaactagggggaatattatagattgatctttgttgcttagatccaagagacttgccgaatacccttatataggtcagcatctaacaatccaatcccctaactctggaattccattttgctcccaattttctttcttttctcttcatcttttccaatcttatatgccaagcattgaggattgcttagaataaaaatttactgtttcttcaatgtgctacaacctaataaacctactacaagagagaagagcatcacatactattgtaacaagaattacaatgaaaaatctgttgcttgtctctccactaaatgctagacaccttgctcaagtctcaaggtattggctgaaactctgtcttgctctccatatgcaaatttgagcatttcaagtgtgcatcgatgaatctagctctacgtacaatacaattagaatttaatttccaacaacattcagaaaaaaactttaagtaagcggttccaaaataagtctttctttgactgtgtgagcatgccaagcatagcaacaatggaagttttgtttatgttcatgtgaaacgaaacaatctataagcacgcaatggacctatgaaaattgacatgaaaaatcaaatcaaacaaaaagttggacaaatgctggtccgatttaagagcaacctaaaataatgtacaaactcaagttataatgccctagtacatcgattccacagaagtactgaaacgaaaatggggggaaagggagggataccagacccgccaacaccagcaaaacggacggggaccggtgagagcgccctgagagacgccatgaggcgcgaggcgagcgagtcgcctgagacctcaccggcgaccacgaaaactcggagctcgccgtcccgggcagcggcatccaccaccctcccataggagaaggcgcgtgtgcgcgccccggtcgctgcgccgccgcccagcagccctcgcaggcgcgaggcggccgcgatccttaacgatagcatcggccgccacaactatggtgttggacaggagagagtcgacgccggccgcctgcgcccgtcgggaagtggaacgccccagcggcggaggcggccggctcgacgggagagagattgggccgaaagaagcccaggacaaactacccaggcctgtggtcagatgggcttttatacatttggtaaactgtcgcagtgacacgcccgaataaaacccttggccgcagccgcctccctttctcccggccgcgcgaaatatcacgccaccgccgccgccgccgccgcgaacgccatggccacgggca

SEQ ID NO: 52381 - DNA, 1501 bp, Oryza sativa
attaccgcagagaatgttgctgaggctgttgatagtataattgacaaactaaagaaatcagatgtatcaaatgtggtctattttgatggttgggaaggattgggtgtatctgctgtcctcagagctgttgccgaacggcttacactgggccagatcacggacccagaattgaggtttgaaaagataatccacattgattgctcgaggtggaaaagcataagggaaatgcagaggaaaattgcagagaaactagagatgacccaagcaaaagatcttattgatgagcaggatgaggctgatgatatcaatggaaaagatgaaagctccagagacgtgatcaatgatgttggaatagctgttaatgatgtcctaatgagtggaagatttcttgtggtttttcataatgggagtgataatgaaataaaagatgtaactaattttggtctgcctctatatcagctgtataagggaaacaaaatattgtggaccttcaggggcaggtttcggctgagtaccaaaattcaggacaaggtgcaaaaggcagatgtttttcttgctgccgaattccataacaaaatatatgggatggagttccaggatcaaagccattggtgggatatattgtgtgaggaggcggcagaaattgcttccaacacatgttccggagtagccaagctgcaccctacaacaattgccaaatgttggttgtatatatcgaaacttaattttgttggcagagacatcattgactatgactgggcagttcatgcttcaaactattgggtgtgtgatgggatcattcaggaatgggagattgctgatgctctacaacaagagatgtggcaagaatgggacgaccctggactttaccacatgatgcggaacactgacaactggatttcaacaagtcacctgatttcaagtaattatgggttcctggctgcctcagcagtggctcaaacagtgtcatcatttttcttggcagaacaccaaattgacacagaatcaaaagacacggtggaactagtagaatatttttttaagtcaaagctcaaccctgcacatcttttacaaaattataatgacatgtttcaacatgcagagaaccttagagtgctaaaacttagcctctgtacctttagatttgcttcacctcctttcctctgttgccgcggattgagattccttgggcttgataactgccttgatctgaacattgatgctggagaggaggttcagtcttggaactgttttcatggtttgtgggtgctagacctacagtacacacagtgggttttctccccacagatgattgaggaaatgaacaatgtcagggagctcaatgttaagggagtgaaactgcacaacttgagacatatttggaaacggcagcataacaagatacagaagcttcgtgtaatcaagacgattgatcaagactatacggcaaccaaagatgaaaaggatccattcacattcacattctcaggtatggaaaaga

SEQ ID NO: 52382 - DNA, 1501 bp, Oryza sativa; identical to SEQ ID NO: 40073

SEQ ID NO: 52383 - DNA, 1501 bp, Oryza sativa
aacacttgctgcaaattgaggaactcaccaaatacctagaatgaaagaatgaaactaaggtaccatccatgcaacagataaaaggagatcctaaaacaggtttaagcccagattaacttcacatgacaaagtagtcccaaagtcaaacaaacccagatattttgtcattttcgaaataaaactatttcaataacatgcttatttttattgctttacaattacaatatatcataggccttttggcccttcagacaagcattgtgggacaaagatatggggtcagccaagtaaaacagcctgtgccgatgaacaggtcaccccgataggtatggtgcatattagaaatttaaaatattagatacacccatgagctctcctaagcaaagctatataaaaaactgaaggttacttattgtggtaaaaactagaaacttgaaccaagataaaacaaaaaattgctctaaaacaaatttgaccagagtatctagaactgagtatattggcaaaacatgtagactgagatgtacaaaatgcaggcaaaacaagttcttttcagctgcagatgatgtgatcgttggtcagtagtctggtgtgctagacaaggagaaataatgctaagtacaatacaaatagttatggtcaatcgcatttccaatcacagcatcattattaaggacaaggtcaaagctttctcagctgtcaccaaacaagacttggtatggcttgtttacttaattctctgaaggagaaaaaatatagattccaaggaaatttgagtaaataatgtacccatagaaaatctctacggattttgcaaagaaaattgatatattagctacttagctgaaaattttgactccttgttacaacctgacaaacaggcaaacaacggaatattagcttgagctagcctgactgtcagtaacagacccagtgatctgatagacagatatccagcagagattattgtaagaccatccaactggaattcaagttgtaagcttagaaagaaatagggacattgtatactcactaccataaagataaacagaaactgaacaagagtttgtcttctaccctgtaaagtgccaaagaagaagctctatctaaaattcgtcttgacctgatgtggtgaccaccttggaagactcgaaaagttggaagactttagcaagtcaagcatggaatagtcttactgacagaccagttcaatcttagaaaaagtatgtggctatcatggtctttcttagaatggaggatgcaagggatgttgtatgtatatgcaaatttcagttcacaaaatccaggtggtatatagaaggccagctaagacaatgaccatttacctacagatactattcctcgtgacattttaccttagaaataacttgtaaggtgggcaggatctcgagttgacttgaccttacaagttcaaaaaaaaataacttgtaaggtcaagtcaactcttcggtgtgcaataaaaagtaggaaatggaagcaa

SEQ ID NO: 52384 - DNA, 1501 bp, Oryza sativa
gttcaagtttctagtttttaccacaataagtaaccttcagttttttatatagctttgcttaggagagctcatgggtgtatctaatattttaaatttctaatatgcaccatacctatcggggtgacctgttcatcggcacaggctgttttacttggctgaccccatatctttgtcccacaatgcttgtctgaagggccaaaaggcctatgatatattgtaattgtaaagcaataaaaataagcatgttattgaaatagttttatttcgaaaatgacaaaatatctgggtttgtttgactttgggactactttgtcatgtgaagttaatctgggcttaaacctgttttaggatctccttttatctgttgcatggatggtaccttagtttcattctttcattctaggtatttggtgagttcctcaatttgcagcaagtgttacttgactgcatgggttttttcagaaatcaaggattcttggtgagctttgttggggtatatggcatgagaatataaggtagactaatctgttatgatgaacatgtatctgattctttctgtttacatctaaatttggcacctatggatgaaatagggaaaaattgccaaagtttagaaagtgacgggtttccttcacagggccggtcagaccacaggtgtatgggcggtctgaccggctagtagggccggtctgaccgcaggtatgtggcggttagaccgtcagggtccgagtccgagtctgttttcgtcgggtctcgggtttccttacttgggaaggcatgtttcgtgtttcctttggtttctatccctatttaagggacaaggccggttcactgtaaaacccccgaatacaatctacttgaatagttcttttactatgttttctattttaccctaatttagtccatctttgtcggtttgcgccgtaaaccgtccgtcgccgctgcgagactgcgacacccttttataggtttgtctgaaaaccttccgtttgcccacgagacgggtagttatcctcatatcgatctaaatcggcctagaggctgattttgagctctaaatcggctccgctagtcggtttagctgtttttctacagtacccatgttgatctggccctttggctagattgaggtggttggcgactccatatcaccacaaggcgtttaggtgttgcgatcgtacttgtcgacttgtcataaaaagttgccaacgtgatttttgacgactccgctggggaacgatctaatcggccatatcacggccgaatttcgtttaatctagtaattactgttcatcaaatcaggagtttcggcggcgaagttaattatctagtcgtcactgaatccatctgaatacttgccgttcagcacgccgcgtataccgaggatcatcgtcaggaggcagaggccggctcgatggcctcgtttctttttgtttcataaggcaaacagagaaaatatcaggcttctagagccgatctacctggcagacaagcagcagga

SEQ ID NO: 52385 - DNA, 251 bp, Oryza sativa
tagatcctatatgtgcctattgagttaaatactgtgtattttttacaactttgtttgaataaatgcattatatttttaaggttttagttgtactaatctagaagtgcgtattgtagatatcggtaactacgtagatctgctagtttggaatcagtactttaccgttgcattggcatacacaagaagatattacgttgtaggtgtttattgtatgaaataataatatgatctagttatttcgttgacagata

SEQ ID NO: 52386 - DNA, 654 bp, Oryza sativa
gaggggtcggggcgcctcggccctcggggatgaggcgggtgcggcccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacacagttatatcatattaagccatttataatttatagttatctctttgaacaattcataagttttcaatagatgtagttttccaatttctgcaaagcatatgattttcatgtagaggcggtcaacctatagcttttctcttgtagctgccatattacactctgctttagctttaacatttaagagcaattgatgatttatttgctttccagtactgtgggaatggaaggtgctgagaaaaaggaatatttatttgtttggttcttttctggattcttctctagctgaaagtgctacatccattatatttttgtcatgcatatactacacttataattgtatagtcttctaatcttttactccttgtgcagagatagttgtagttggtacaatattcccgtatagtcaagcatacttacacatagattaattcgtgctcttgaaatacagtaagccaattttgcaggcaaaa

SEQ ID NO: 52387 - DNA, 1501 bp, Oryza sativa
gggaacaggagattgaggcaaagtttgtcctgaagaagacatggtttcgtgtctatggtgttccatatgaaattagggactttcttagccttcatgctgtcggttctgtcattggaaatacaacgatggtggatatggtttatcttcggaaacacggggtcgtaagaatgcaggttgcggtggatgatttagcaactttgccgcccagtgtgtacattgtgttccgtaaccatgggtatgagattttctttgaaccagaaatgcccgaggaggaatcgaaaggaaaggaaaagttagacgaagatgatcagcgtgatgacagtgaacaaaagaggaacgatgatgatgtcattatggaagatcggaatccaaagcgactaaaaaatgaagctgcgtcatcctcaatgtcattaagaggaggctcagttacagactctcagcttaattcacattgtgtttcagcgatcgcagggttgctcactgttgttgatgattctgcagtagagcagcaagctgaggaggttttgccaacaatttgcgtggcttctagcttggaaacggtgatgaacaaggctccagaagagagctcaatgcagatcccaactaccggacagaacgtgaccttggcaaatgaagaggtggctgctttgtctttggctgtaccggatagtgtggctgccatctcagaggaagaatttacaacgacattgacggatgcgggagagatggcaccggcaggttgtgcatctctctcggaggcttcgacgggagcatcaacactagaaggggctgtaactgtgtcattggctgctcctgttgtcatggacgacgcagcccaggagatcgagtcggacaaggtgggcttggtggctgccgatgctccaactttgtcggtcgatgcaactcaggtcttgccgtcctcgtcaactggcacaatggacgctgctccaatggtgaatcaggaggtgacagaggtaaccacatcacaagactcgatgattttggatgtcgggactgcaggtgttaacacggtaattgagttggctgccgatggggcacaacttgatgcagcacgcaccatcatcgctgaagcaaaggtgcaagcagaagcaggtgggaagcgtccctctcaagaagctaaacgtcgctctcgtcgactgattcatcctacaccaacacgtcaaagtgaatgacagaaggcaatggcaaacggggatgcaccggtggcaaaccgagcagagtttctaaaaaagattcataacctcgaagtggtagcaggtaacaaattcaaccctacaagttcaattctatctttgcctaacaaaactctacttgcaaatatttctaagctaggagtttccctgggtagaaatgacatagaagtagatgagtctatttatggtacaaaaatttctgaagttgatagatttgtagctctacatgctagttcttctgtttacaatggttcttctagtaatgtagataatgacaaggatgagct

SEQ ID NO: 52388 - DNA, 1501 bp, Oryza sativa
ctccaggactccagtggagggagtgccgacaactccggcactcctacggaattcccctacattgagagaactctttactttgaggcactcctttgtgagcttctgtgatgacctgcacttttaacactgaagataaatgtgtcagactgtagattactagtcgtcaacctgtgcgttgcacgggatgaatttatatattgctattcgtattataaatgttaaaatatatacgtcaaatttataagtaaaatttgttttagtggaagttatgtgtactaatatttttaatttatatgttccaagaaaacaaaattagtaattatatataaaccattataatatttattttgttgatttatagtttctaagtctaatggtccatgtgatttttacgggcaagttctatgaattacggaaatttgacctactatagaatccatatagcgaatagtaggcacaacacaaattaaatgagttctaaaagtgcctgaagatatcaaatgctgattagtctgctaaattatttttatcaaataaattacatatattgattggctgaaatagaacaaatgtttccagacgaagcaaccgatttattagtggtattgggactactatcatgtaaaattgacatagaaggataaaaatccaatgacatgtccatgaataatacgttatacagactcgacgtaatgcatacaatatatatactatctatatatgttcactgcttaaaattattctacgatacaatttttcagtgaactttatcattcaatagacaaaacatcatcagcatatttattacttcaattgaaaccaaaatccaagaaattcttaaataagtcatgtggcctatgagtttgatggaactacaaggtaccccgcgcgttgcatcgggacattgtgcatgcaaagaaaagagaacgtttgatccatcacaaatagaaatagtgtatatgaaaaacattacttttatgaaaacattttatcatcacattttacacattttattagtcgaatagatccaagtattttccaactgaccttaatcttattattagaccgatcataggaaaatgagttggttgaataggtccaagtatttttctaacaaagcacaatcttatttgatcaactataggaaaatgaattttattgactacaaatgttgaaaataggtaaaatactaaccttctgatgtgatcatgaaagttgagtagtatgtgccgtgtaacggccactgtttactgtgctctgcttcaaactaagtacggatcagttgcacaattatttcaagagtggtaatatattatttgatagaaataaataatattgtagtataagaaataagctaatttgaggggtacagcctggaatttctagaaatcaatgcctctgaagaagaaactgaatctcttccgaatcataccatagctgaaatatgatttaagatagaaattagtgaccaaaatttacattctaattaggtgagaacatg

SEQ ID NO: 52389 - DNA, 1003 bp, Oryza sativa
ccgcccatttgcagccggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattccttcaaattcaggctgccggtctccacgctcctccaaaggcctcgtttagcatgggccaatttatgggctttacctgtgatgggccgggacaggattcggcatatgctaatcaagccctctaagaccagtcacaacccaagacactagacatagtttccatacactccacatcatcaagaaactacactactctcccaatgcaaacactactatttcatacttaaatttaatgctacttatctcacatgatgtcttgaatgttgtgtagaaaccatgttgcatgcaagacattttccttctctttcctcatttattcacttgccatatcatttttcattctaggtggcagtttatttaatgttatagacaccatcttagttattgggttaggaatggcctaaaccggctcgttctggacgaaagtggaacagacgaaatggagtctaggatagggatacactagtaattctcaagtcctaaccgtgatcaggttcactaaaccgatcggtttgcatgaaaaccaatgatattccgtttgtggaagccgacctgtattactcggtttatgtacgacgtttactaaaagtcatcggttttattgattttcattttttattgattttcagtcggtttttcataaactgatgaaatacggttcttacttttaaaacgaaaaggtaaaccctctccgtgatattcgtttgtcaagaaaccgtgatatattcccttgtgtttccagt

SEQ ID NO: 52390 - DNA, 161 bp, Oryza sativa
cctccgctgccggcagctagccacgcctcgctggcctccgtaccgactgcgcctcactggcctcctccgctgtcactgcacctccacacgcacaccgtgccgcgcctccgcacgcgcactgtgctgccctccatcaccgtcgacgccgcgccatcgctagc

SEQ ID NO: 52391 - DNA, 1501 bp, Oryza sativa
cccctcctcagatccggagcggaggagggcgaacgagatgagggagctggccggcaacccttggacgtggagcggcttctcactgcaggtggaccagcccgtcttcgccgccacgtccatgtgcacgacggcctcccccctaggcttggggatcggggattctctggtgacggtgttttgcgtgcttgggcagagtgatttagtgctgatcataagcatcatagtatcatacacgcttgaaaaatcacgatacagtcgaccaaattgctgatcgatagcttagtaaatttggtcagcatggtatgccacccggcaattttctgattgatactattgttggggtacctggctatctgcaccttttttgatggataaccattgatcttgcattgttttatatccgactgcttgcttcctggagccgtttgtagatgtaattggtcttgccactgccgtctcacgtgctgccctagccaagtctcccccgaggccggccgcacgaatcacgctatgccgcgggccgccgccggcaatccatgtgcactgatgtgcagacatagctgcaggaggaggaggggaaagagcggcggggagaagttgtcgtacattacggtggtacgggcggcgctgctcctcctcgtggcgctcagcgcactctcgctgcttgccatggggtctcggaacgaccgccatgccggcctcggtctcgccgcgcttctacccatccacagctgtccccggcaagcctcccccagcagcatcgtcgcggtggctaggcaccatgatggcggcgagctcctagccgtcgggatcggccggaggagcgagagaagggtagaagatgaagtgtggttgacagtgggcccaccgtttttcttttatcctagtcactgacaggtgggtcccacctgctgactcagcaagtcaacagggtcaaagatgccacgtaggacaaaaccacctccaaaaccgcccagggagttgatttgcaatggttttcagagttgggggatgagttatacccggttttgcggttgaaggatgctatatattcatacacggccatgagttgagggagggaatgtggacttattccttaaaaaaaatgtctgtttgggcttcctaggacgttagtgggccgcaagcccgccgcaagccctccgtaggaccatctatgctgctccacctcctaatgcataaatgccataacagagtctatagtaaagtcttcattgcattaaactttcctttttttttaatagaaagccctttttgccgtacactaatcgatatttcaatatataatgcttttaggtatggccaaactaccatggtgacaactttgccagatttcatatatactgggtaagaatttctgtaaacagtcatgcatttgaactgtatatatgttgttgttgttttgagtcgaacagtattgcactgcttaagaattctatttactttttgtttatggcagcaagttaatacggtgaacatgcca

SEQ ID NO: 52392 - DNA, 1501 bp, Oryza sativa
aaaacaattgtgaaaacaacacctattttgcattgaaaatgttaacctaacacaatataataaaataataaatagcatttatccaattaaaatcagagagcatgcgaaaagaacaaatagtactgccttaaataagaaactaacaaatagtcttgtccccatactacattagcatgttaattgaagcttaacattcaaaatatcttatttgtactttatcaattagatgtttcatgaactgcaaagccacactaataattatatgcattggaactatttctatttaattaaggacacattggaatacatagaatggcttgatgacacaaatcctagatgattcattatatatatatgtgataccatatacagtttgactcgtaagatggatcaacgtgctcttaggaagcataaacccattaagttacaaagatatcgaatggacattctaatatccaataaatgcaacctcctctctttaattatcagttgaattttatattgttttctggtgagaattatattgtttgatataacatttagccatgttgataatctagtttagagaaattatgtttagtcccatggtacatcatgtaaagttgatgcatttaaccatctaaagtaatgcttgaacacaaggatttcacaaatcaaagatataggattccagaacaagtaaagacgattttcaataaaagtgaattcattcgagagttgttaagcaaaacatacctttgatattttcagtaaaaaaaaacatacctttgatatagtaacagtaatttcatactgatctccattataggtagaaactggttcaattctcccaccaataccaacactcgtactgacttgtacaaagccaggacacatatgatcaaagcatggcatgttcaccgtattaacttgctgccataaacaaaaagtaaatagaattcttaagcagtgcaatactgttcgactcaaaacaacaacaacatatatacagttcaaatgcatgactgtttacagaaattcttacccagtatatatgaaatctggcaaagttgtcaccatggtagtttggccatacctaaaagcattatatattgaaatatcgattagtgtacggcaaaaagggctttctattaaaaaaaaaggaaagtttaatgcaatgaagactttactatagactctgttatggcatttatgcattaggaggtggagcagcatagatggtcctacggagggcttgcggcgggcttgcggcccactaacgtcctaggaagcccaaacagacattttttttaaggaataagtccacattccctccctcaactcatggccgtgtatgaatatatagcatccttcaaccgcaaaaccgggtataactcatcccccaactctgaaaaccattgcaaatcaactccctgggcggttttggaggtggttttgtcctacgtggcatctttgaccctgttgacttgctgagtcagcaggtgggacccacctgtcagtg

SEQ ID NO: 52393 - DNA, 1501 bp, Oryza sativa
acgcttctcgatgcaggtaattttgatgctgggcagtacgccttcttcgggaaggagccactggagggactcgagctcagttgcttggaggatggcggcggtgatggcaatggcggtggattcagcgggccagaagatgggctgtaccggctctcttctgttggagaagaggtgcggatcccggaaccttcatttgatcatgtccacagctgccatgcttcttgtgaactatcgtcctcttgatattgatttgtgttcttggttcggatgccgtccttttatctccttttccgatagcacgtttagttctaggaggaattaagaataaatccttgtgggcctatatggtcttatcagtggagttgaggttcacatcattagcgttggagggcgggaagttttatgctcaaacataggcagatcctttaccttgatgcatgttgaatggtcattgtttttatcagttgtttgatagctaaaaggttccattgcaagggtggaattccatgagacggggatagaagacgaatcttgctgctaaatgtattaagttgagaattactagaacaaatgatgttttgtttcggataaatgttcaaggtagcctttttggctgttttgtcacaaccctattattggcttgtttcagtccagtcatagttctttttggtagcctttcaggctatagctgtatagcttgtggccacggtatgattttttgatttggttagttttctggcacacttttcctagtgttacttggcccaacgctcacttgctctggagctagaagagaactatctctgcattttgagatcaatagcagaatgggacaaaaaacatataacctattttgatacagaatgctagagttcactgtttctactgttggctgtatgccatttcttgaatgttcaagttgcttttgcattctccaatcttcactgcattattgatagatcgtattgacagggcttactattgagcatgcttgaaatgttatgaggtaatttggatcttctatggatcaaatggtggtttttattatcaatatcatgtaatcctaagcttgtgctggttaacacaactagttttcagcaattgtaatgtataacaactttatacttatgctggttggatgaaacaactttaggggggttgaatttaattagttaatgtgcatttctaaatagccacttggagtttattgtgatgggcaaaaaatcgtctaatatttcattacaattggccaatattacattacaattgccatcaatatttggaactgtatcatgtggaaggtaagactctacaaggagttagggatgtctgcatgtttgaacagccttgcaccccatacatgaattttacttttgtagcgctttccctttcttcttctcatcataaattatggatttactatcgtctttagtgttgtggagttattctgattcaatttactatgttctgcagattgataatctgagtaacttgtcagaaa

SEQ ID NO: 52394 - DNA, 1501 bp, Oryza sativa
gtttgattaatgataaatctagtaacctcaattttacatgattatatttttatttttttctattaatagtcaaagttaaaaatggttgactttacattaggctaaaaatgtttatattttgggacggagggagtagtatttatctaaaaagacacatttgcagtggcacagataaaatagtgtacacgtgttctagcacttaaaatgtgtacacgtgttctagcattcagaagagttagctaatatattgcatctcacctatctcccattcctacaaaaataatcatctatttcactcgttcctacaaaagaaaatctctcgttcctaaaaaaatggcaatcatttatttctctcgttcctaaaaaaaaagaattgcatcttatctgtttctctcattcctaaaaagaaaagaattgcatctaatctatttatatcgttcctgaaaaacatgaaaaaaaaagaagttccagggctcatcaattgagtctagaaacatctttttgcacgtttctttctcaatttcctgggttcacttctccttatccagaagcagttgtgataccgattgagaaacacgctcatctcctacgtgtaggcctgtgcgctcccttccaatcttcatccaatctagtctcgttccccagcactccgtcgttgacgggagccaccaaaacaggcccgagcccctgcagcgccggccaccggtcgcctccacgccggtgcagtcgtgccctagccgccccggtggcctatccctaggaatccaggtccagttccgactcgcgcggcgtggctagcatcctccgcgcgtccccgttacatgtcccttgtgcgtgccacacatcagcaatagcgacctcaccatcacattttcacttggtgttggtggatctgtgcttggtgatcaagacggtcaagaccctaaggcagtcaagtgcatatgacggcaggttagcaaattgttaagcactaagtttttctatgcacaccaagtgtttgtcatttttcttgtacgcagatggcatcttaaaactttaccctgcatcttattgtttcaatttttaatctagctcacagaaactcttatattaaccatataatttaatctgtacaaccaaaaatattggctcatagtgcagtttaattcctcaattatcatgtaaagtccttaattctttattctgattgcttttgtcaatcccatctgcagcaatgtctgatccactcatgtactgctttgctatttttctgatctagccagtagataagatggtcgttttcgtttggttcaattaagcaagcatcagggctgcatcgacgctgtatctactggatcctaatcctaagcttccaggtacagttaacctcacctacacatgttcggtagacaaatttcttttggcttgaaggcataattatagaatcaaaaatatttagtggttgttgtcaaattaggaacactcatgtattaactatatttcttattttaacacagaaaat

SEQ ID NO: 52395 - DNA, 1501 bp, Oryza sativa
gttgacttcaacatattttaaaaatgaacaatcatgcacaaaagacatgcatattgtcaatattgtagtcaacatctttaaaaacaaaacatcattagtcattttccatcagaacataatgctgacttacttcctcttgagatggatcttctgtcaccaataacaccaggattccgtgttccactaatgcttcggttcaactgatgataaaaaaaatgtaaataaatcaatgtgcaacagcagaacaagcgcataaaagaaacaagaacagaagccaaggttaaaacaaaatatcatgcaattacggatccatatgcaagcaatatgtcaggtgtagataaaagttgaggcctcattactcattagtgattatcccaatcctcttgggactaagggatgggatatataacgtatccttagaaaaagagcagcagcctagttgatcactccgaaacaatttcagacattacagacttggtagttggtacctactcctagatcttctatgtgcaaatgggccttagatggggcaaaatacttacagatgcaaaacaggctaacgcaagaagaagctacattcagcctaaagaccactaatatgtatcatttatccagtacatgcttggggtagcaggcagcccaattgtagtggaaataatcagatagccagaactacaaatgaataaaatgggcacttaatgtttagattatttcagcttttggggggaggggtataagttatatgccccacaaagattgcacctttaggatttgcacctgcatgtatcgttgacatgtggcctgggggtgcaattttctggagaaatataattatttatcaatacaagaatgaagtatggaagagtcagagtaaccacttggccaacactggtaaggcataacagggccttaacatatctaatacttaaacggctactgcaaagtgaatccatccaagcgaagtcactttttttttaaataatgaaacatcaatttataacactggagtttgtgaaacaaacctttgcaaaagtgctcgcaagatcatcaatttctgacaagttactcagattatcaatctgcagaacatagtaaattgaatcagaataactccacaacactaaagacgatagtaaatccataatttatgatgagaagaagaaagggaaagcgctacaaaagtaaaattcatgtatggggtgcaaggctgttcaaacatgcagacatccctaactccttgtagagtcttaccttccacatgatacagttccaaatattgatggcaattgtaatgtaatattggccaattgtaatgaaatattagacgattttttgcccatcacaataaactccaagtggctatttagaaatgcacattaactaattaaattcaacccccctaaagttgtttcatccaaccagcataagtataaagttgttatacattacaattgctgaaaactagttgtgttaaccagcacaagcttaggattacatgata

SEQ ID NO: 52396 - DNA, 190 bp, Oryza sativa
tcactatgcgcgcgctcaccctatcaatgcacatatgcacatcacatcctattaataccttcggatgactagactgacatatcccttctttttataaagttaaggccaaaagctcaaacctcatgcttccacattattatcaaattgtgaaccgttggcttttttttatgaatacatcccccattttaga

SEQ ID NO: 52397 - DNA, 152 bp, Oryza sativa
taatcccggccgtatattcccaatccaggcgaatcgttcactgtaaccggaaaaaaacagttctatccgtcagatgccgatcggaaggccagcatcagcgctatacggtataggctcccgataaagaagacggccgcggctacgaggccgca

SEQ ID NO: 52398 - DNA, 1501 bp, Oryza sativa
tggacgatgtacgcgttaattaacattagtacgttcacaaatacgagtacacctggcacacggcacagtggtacatcattcaagtcatttctatactccctctggttctataataagatgttttggaagatcaaacttttataaatttgaccatcaataactttaaaaatatttagtttaaagaaactagaacaacgtatagattgtctttcaaagcaatataataaaagtaaacatgtatttatttattgtgtatattataataggaaaataaggtcaaaaatatattttgtaaaccgtgttattgtctaaaacttcaattaaaatgaaacctgaggagtatatatcacgtcattaataagaaatctcgaaccatctaggcaagttttgaccaactgccattggacaccatcgcctgaatgtaagatcgctatcacatttaggaatccgacccgcaagctcgcatccggcgagctcatcgtgcataattaatcacgtcgatttgtcgtgaaagctagtagcattaacacattccgttggcagttggcggctgtacggtcacgactcatgacacagttctcctagtcaaccctctgtcaccagtccatcggttcgatcggtgatgaaactacggttttgctttaataagataataaaatttatttctcgccgagaaaaatatttccatccttatttcaatgaagttctagagcctattcagatttgtgacattgaaccatatcatttaaaaaaaacacaaacacgtggatgatgaagtttgttaccaaacattaataacgcctaaagaattttgataacaatatatttagcttatcctattaaactttagcaatatagtcaacttgctaattttaacatcggcaaattctaaaaaatatttatattttagcagtaatcggaatatgcccatagtctatcattatagagcatataattcgaacaactaaatattacatattcacaatttgatgcataaaagaaatcaattgggccggtgtttagttacaaatatttttttcaaccttccaacttttcaatcacatcaaaactttcctacacacacaaactttcaacttttctgtcacatcgttctaatttcaaccaaactttcaattttggtgtgaactaaacacagactggatcacgcaatgtatattgtatatctctactctacaacaacaaagagctctatttccggcggagacaagatgccgcttcctcacgggagccctgtttttttttcccctggttgaatcgtcggccctggtcacggacggatgacgcgcgcccagtccccacatgaataccctgcactaccaccaacacaacgctcgtctcatttctggcctatatatcggaacaggtttctcggtctagctaggcggtggacgcgcgcattgcccatgcaaaaccagctcactacactacactttctctagctagcgcgacgcagttaagccgcggcccacacgagatggac

SEQ ID NO: 52399 - DNA, 212 bp, Oryza sativa
aaaaccagtagcaaatttgcaaatgccctctgagacaaaagatactcaacatattccagggaatatacgctgaagctcgaaatcccgttaaggttttgaaccaaacactccatcctacagaaacgaaatttgcatgctcatgcggagcaaacaaataatgcatgattttttgcgtaagcctccaaaactcgtactgcagttctccaaataaa

SEQ ID NO: 52400 - DNA, 179 bp, Oryza sativa
ataacttaagcaccttacatcggagataatttgtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagg

SEQ ID NO: 52401 - DNA, 381 bp, Oryza sativa
tgaaaaaccaaactagcaagatcatattgcgaaaagaaatctccgagaagtaaactttgcagcttaacttatactgtcatacatcaccctttccctttggaatcaaattgcagtataatagttacattaaaatagttgttttaaacattcaggtgaaccttacccaaaaaaactcaaaatatcgtattaacattatcaatctgaaaagatgatataagcactatgtgtattgagttagcgataactcatcaacccaacacttctagacagatcagacaagcaaagaaaacagcttaaaaagtcaaaataatataatgcaataggcaaaagaaaatgtggcgtccgtgcattcaacatagcatcccgcaccgtcacgaaaaa

SEQ ID NO: 52402 - DNA, 231 bp, Oryza sativa
agattaggcctttttacgttcacaacctaaaacttgtccataatgatggtcctttgctgtcgatttgcaatgtactcagctttctaattgcactctcaaaatggacttgccaccctttttccctcccttatttcgtctaacattctctcaggtgtagctatcctgacaacttttggttagtactagcagttgccatgtcaatgatttatgtacaatgatatcatagtggta

SEQ ID NO: 52403 - DNA, 1501 bp, Oryza sativa
ttttataatttttaacctattagttttatattatatcatatttaagtaatattagttatttataatcttcttcatcatttgaaaagaaggtagacttattttcttttgaaaatatttcaacgaaagtaaaagtaagtgtaaagcaaaagaagtgtgtttttattttttttattgcacatatattatcctggtttattagaggatgaatttggtgggacataaagctccactaaattttatatagcctaatataattgatatagtttgagagacaatccatctataaacatttcatgtagagtgggtaagaggttctacgcaatctaacgtgaatacaattgcacaataatatttttgaaatgtgatgtaccatgaatacacgcttgtttttcttatataagatagatctaatgattaaaaataatagtttcactggtttaaaaggcataggagtattctaaaagtgtagcttaaaaatcatggttgttttaatatccaacattattttgaattgaacatagcttaactggttaggttccttgtggtggaaattgcccacttgtcttcaaatcccagacttgataaattctttcagtggtagacaacgtacccatcgacagcgagacaatcatggtgactttgtcatctcaaaatatgtcggcacaatctctcagaggtactcatagggggtagagtgtgcatgtgtgcgttcgtaggggtgagtgtgcgtgcgttgtgagcgcactttgtttctcaagaaataatccaacattattgataagtttattagttattgataagtttattagggacgggtggacgatgcgtagtatgtacatgctcgggagattttttttctcaatccggtggatagtagtacgtattgtacatgtgagaatgagatgcattttaaataaatctaatctaatgatttaaaaatagtgggtctgccgaattaaatgaaaatcgagggttggatttttttttcttttttctcaaaatttgtaaggttttatctaatttattatagtgccacgtggcagcttaggagcattggtaggagtctcacgtggtggcttgagagttttctaggaagtttaatggatttttcatatataatatatagatacacaggacaaatacacatgcagcttttgcttgcttgttccgaagttgaacattaccgttatattatcatgttatacagaaagaaaatttagctttatgtttacttccatataatttctatttccttatcaagtagaatttggtacataataggtcatttctatcttaagctcggaatgtatataggtggacaaacagctaggatctgactgattattttttaagtaaatcttatttagttatgcatgttttgtgatgcatcaaattatggtataatctatattttgtttttctcataattcagaatttttagaactttttgaagttcataaatctgttttagttatgcatgccagtgaagtgatatatgatg

SEQ ID NO: 52404 - DNA, 1501 bp, Oryza sativa
cttataaaattcgagcgcgacactactaccgaaggagaacgatcgagtttgttcaaagcatacgcatcatcgtcttatcatcgattccacctatcaacatctttcgacgcgcaaaagttcaatctccatacacataagccaaaaactcacgtcaatttcggtcgttcttcatccactagatcacctaaatatacgcaccaccacacactgcacaagtacagtactgtactccatacccaatgcaactcacactcactcccgctacgggcgacccgatcgagcctacctctaccaggccaggctagctataaaatcacgtccatgtcgttgatagttgactcggtgtggagctatagcaggtacaataaaagactattaaccagctataaacatattttaataagataaaagataagagaaaatagcagcgggctacagatctgtagctagctgcaacacgaactataagacacaatgtgtgtataacaggtgggatcatatgttaatagtatagtaagcaactattgtatgaattgcctattagataggctataaatgaattagagctagcggtgggctatactattaaacttgctctaaaagcaggtacaatagtaagctataaccacatatcgagaaaaaaagagaagaaagagaagaaagcgggctacaaatttatagccggctgcaatacggacttcaagacattatgtgtatatgagatgtggaaccgagtattaatggtatagtatatttttatatctaactattatataaataggctattagattagctatagatggtttagagccagtagttggctatactatctctaagctcgcgcgcacaatgatgctgatgcatgcacccccgcgcacccgttaacgtattgatcgaccttgccgttcgtctaaaactaaagtcagcggcagccgatcgacctcgtcgcgagcactcgacggtatgggatcgagtcggtggaggaagggtatggtctccgcagggcgcacgtacatacgtacactgtaccgcatcgctacgcacggcatgcacctcgtacctcgccgctgttccgttccgtgctctgtgtcccatactctacggccacgcctagttggatatcttggcaagcgcgcgagcgagtcgtcgctcaaagctcaagccaagccaacagctggcacggagaaactagcctgcattatgcatacacgtcattcacgtatgcatgggcatgagacaacaccggttttttttttctgttggaaagcattcgaagtgaaagtaatcagggctaattaatatatatatattggatatttcacgttttcacgtgaaacactactttcgtaagtggcttccatacgaatttacagtatcaagcgatacaggagctcctcactccatctctctacttaagcctgcaaacctcgccgcgcagacaagcacgcgacgcgagcgagccagagcaacgcaagcaagcaagcaagcagctagctagcg

SEQ ID NO: 52405 - DNA, 272 bp, Oryza sativa
cccccatatacgtctttgctgcagctgcattctaacatttctctgctcccttgtttctttaatgctttaattggataaatatgcacgtaaaactaagaggcctatattttgcttatatactctaattcaagagcactgttcatgaaatgtttattttctgcctacagaatggaattcacatattcctcatgtgaatccatgatgaatttctaacttttttgttttagttatttcattatactgtccttattccttttctatggtcccttgca

SEQ ID NO: 52406 - DNA, 394 bp, Oryza sativa
ggtttaggcagctccacaactccactccagactcaactcctggagcaatatttaggagttagagctgtaccaaacaggcccttagtttacagttgtgccacttatatgtgggctccactttgttatgatccacatctcagtagtacaactacaaactgtacaaagttagaggagtcttttctctagtttgtgtatttgcggttcctcttacaagaaaaacacagccacagagaccatgtggtacattttccattcacaaaaaagaaagagaataaaccataaaaaaagaacgggctttttattacctgaaacaaatatgtgaaagatttccaatcatgtaatctctccgtctcaaaatataacaacttttagctcttatgatttgatgtgacca

SEQ ID NO: 52407 - DNA, 1501 bp, Oryza sativa
cttttgaagatcttcatgtttctatggctgctgttgaaaagcacaggtgttcttccacatgtggaagaacaaaaatctctcaaagttgagctgctaaaaaaaaattaaatcaaaatatatcaaaccggagtctgtacaatactattacatactcgagtccagttgattcttaagctgcgtcagagattggctgtcaacctgctgctgtttaatttgttacattatccaccgctatattttagagataatgcactgctaaacaacccaaataatggttttttatgcacccaactgaacaaaagttaatcaatttcaccacataattgtactactaaatcgggctgaacacttcgcggaggggcaattataattggtcagttgtgtgtggttcagacttaaaatctggccacttgtaaattctacaatttcgtcttgacagtggaagcctccgaaggaaacctttttccgcccatgccgtacgatggattttcctcgttgacattctgcgcccaacgcacagcatggcatgtcgttctccataaacgtacacacaaaaaaaagcaccaaattggcttcaagataaggtcgtggaagcgtgctacgggggatgatttgtctggtggaatctaaggcctccataaatgatctgttaccagaatacctgccgtacataggatgattagagcaggtacaatagtagcctataagtcagctataaacatattttaaagtgataaagaaaaagagagaagagcagcgggctacatatctgtagccagctgcagcacgggctccaagatgtaatgcgtgtataacaggtgggaccaagtattaatagtatagtaagcaactattgtatgaattagctattatattggctatagatgatttagagctattagtgggctgctatattgaccttgctcttattccttcattcaattgatccatccataagaccatgattattatccatctcaagagggaaaatggccagtaagctgtaagcccaatcaagtccaagcccgatcatctgttgggcctaatttgatctcacttttttttttcatctctaatggtcctgtgacaatagccagattctgcaactcatgaaaacctcgaattgcgaggtcctcgatttgcgcacctgttcagttatactaatccatacttataaaggaaatcatttaggacaatgtttaagtcaaaccttagaaatataaatcatgaataactctcaaattgttgagtttgaaaatataaaaattatatatatagatttatcttgaaaaatactttcataaaagtttacatatagcacttttcaataaatatttttatagaaataagaagtcaaagttgtattttgtagaccgtgtcactgtcctaaacgacttccattacgaacatagagagagtactacgtaccagtacgtacctgtactacacgctcgccgccgcatatatctatacttgcacggcgtgtggatgacggatcaaa

SEQ ID NO: 52408 - DNA, 331 bp, Oryza sativa
ttaattacactttaacgtatgacgttggttagttcgaaattaagataaaaaaaaggagagaatactacctctagtccaccaatcctatcctctcgcctttttaagtcctctgtctctcctcacccttgttctctctgtcgccaccgctcctcctcgccagcagcgttgccttctcgcattgtcggcgcttcctcctcacccacatagtcgccttctgtccaccatcaccaatgtgcctcctcctcgctcacagcacacctcatatccttctcctagcccgcaacatatcctccttctcggctctctccttctcttcttcacagtggaagga

SEQ ID NO: 52409 - DNA, 1501 bp, Oryza sativa
ctgctccaggacgtcgacaacatggcgtgcgccgtgcaaagctctaactaggctagagcagccgctagcggtggtacaccatgagagtatttgggaccatttttctttgatgaaaacggccttgttaggattaattttcacactgctatttggacaccattcgacgtgacttttagccggagaaagaaagtgtggacaaacatatagatgcgtgtgggttactgtacacgaattaattaaaacatgtcaaatggtttagagaacattcttttcgtggtatattggatcttacaccgaatcgatttattttttttcaaatcttgttttaggagtgcaattggacatcatcacacacacatttctttacatatatatgcttgcgatattgtcatagacatcaaatatctcctgagcatgagcacacacatacccactaatgcacatgtgtgcgcatatacccttaaaattgataggcactagcactgaatctactcactttgtccaaaaaaaaaatcaattcctttcttcggtttgcagaccgataaattttagcctctcaaaaccctttacttacacactatttcaatactattctgttattaacgagggacatttatatttttttcctctcccttaaatcttttttggatgttagaagtagatgagtagtccattttttcagttgacggagggattagtatttaagcttcagtgagctaagtgcacaaccatatcacccacccatctggtaatatataggccatcctagtgactgtgaatactttaaccttgcccctctccatatttagtgttcaacctccaccaatgtctagttaatgtatctatcgaatctccaatactggctgtcatgcctttaatttttctcacctctcatatttggtggtgctttttatggatgatctgccattgtcccttcctccacacagggaggtggatacaaccctaaattttctgaagatatagttgtttcaatcacggataacacagtcaagctactatgtcagtaataataaaatttgtttacgtatagcagtttctatgcatgttaattatctagtgcatacagtacaacaggaggggcaggtagacgaaactttctctttctaatagtagagatatgctcagtcgctaatagatgataagttcataaaccaaggaatcgatagattatttatctaggggtttaacatctcccattgtaatgtcttcttttgtttctgtaatggtggatctaggaaatgaatggggagggaggcttatctccttcctcctccttcaggcccccctactcttcctcttctccctttctttcctctctcatctcccattttctcaatggtgattcagtggggtagggggacctaagtctccccagtacgtattacgctcaatccgatcttgaatttagatacctttctaaccggaacaaatactaatcggattagccaacggaccctctctcgcatgaaaacaaccctac

SEQ ID NO: 52410 - DNA, 1501 bp, Oryza sativa
atgattccatagaacctaggaatacaggaaatagaagaggcaaaattgccttgtaggattcaaataatatcctacatgcattcaaatatggagggagtggagtttgtcattgagaaaaccagatcaattgaatattgtgggacgttgatcctctgctgtactagaatgcagtggtactgtagcaaacttacctcgacaaaatattattattcctcttctgtgttcgagatcactgtagaatttgttttcggccgtttgatgaagatccgacggcaaaaacaacgcctaatgtcagtgtactgtagatcatctgcaatttcttcttcccaatgcagagtatactcgacgcaatgtatcgccagcatccacttcagctgcacggtgtgcgtgcgtgcaatgcctaagagtacgtggacacaaacacgtatgcatgcagctgtagtaccatctcagccagtactacccactgtagctatagcagctacagcggccaaacctttggagtttggaggtcacgcgacccacgcggccgcgcaccataacttggggagcaaaagctggggctttttcccggccgtgttgcatgcaatgttttagtataagcggcatgcattaatccgtgccgtgtgttaccactcattggctcccacaccggcccccgccttttacgagattggctagcacaatgattcccatgggagagcgtactcacatggctggtcgtactgcctgtttgcttgctgctggagcccaaaaaatcaacgggtaatcaagctgaaaggactaaataaagaggccctgtcgtgattaactgagagatttatggtgcttatattagagcatgtcgcgtatgagaccgtctgcagtagtaggctgtaagccactaattaccctatcgtgtttccccagcttttgtcagtgcgctcggcttctaatttgaccacacatgatgtacgctaacgtgctgtcctgtactcctgtgcctgtccaggctagtcagtttaggctgagtttagttccaaagtttttttttcaaacttccaattttttcatcacatcaaaacttttctacacataaaatttcaactttttcatcacaccatttcaattttaaccaaactttcaattttaacgtaaactaaacacaccctcagacaaatcatgtagaaatcagaaagaccagatcgtccaatactgtccagctttcggcccatgggctttagaccatagcctattagctcatactaatcacaacgttgggcttcttttcttcttttcctggattcctaacgtataactggcatatatccgaaaagaaggcactatgtaagggggatcttaatgggcgatcgatcgtccggagacgggggtagcgatcgatcccctcccccctccacccctccacctggtttcctttgttggcaccgcattactttcctattttagtaaatttatacacctaaagtttatacacctcaagtttacacatctaaagtttaga

SEQ ID NO: 52411 - DNA, 1501 bp, Oryza sativa
taagcagtggcacatggatgatggcagtcaggagcaatggctgatatggtcacacatgtccggacgatatggctctcttcctccacacctcccgttcaggattttatcaactgatcgacctcggttcctttcacttatggcgagacaggtgctatctagcagcttattgcctgcgaggccaggccatcatccggttccttgcaaatcaagccactctacccagctttcggatgccatggtttttagccaacagggtacgagtatgaatgcttcaagtgatcataaaatctatagcttcccttcacaatctactcagttcagacttcagtgtatccttgagtgcgaaatttatggcgctaggggaagccatgatcgagcctgtagcattattcaccctgcgtgtgtagtcactaatcaggcacacatgactggttatccaccagctggtcgcatgtgaatggctactagctcgcgatatgattctgacggtgaaggggggcatcatctcggcaggcgttccatcacggctagcagcttcctgcttgccaataagggcgcgagcacgtatagtagtttcagctttctttgtattttcgaaagaaagtttcagtatatatatatatatatatatatatatagtttgtgcttgtgttgcagagcatcatatggcaatccttgcactacagttccgttcgtgccgggcgcgacgcctacttcgcttctacgtcactgaatcgaaggagtgggctgcagttactctccgcgcgcagacaccgcatttacctttgtctcgtcacgcggtgaaagtgcctgtctgggaagtaactttcccgtctcaggcctggcgaatgaattccctgcgcagtgcaggtttgccgtccgggccctagcagtcaaccatgctcgcatcaccatcaggatcagattgcatgtacatgtaacgtgctacctaacaatcctaacaaaaaaaaacacaatcctaacaatcctaaaaaaaacacaatcctaacaacaaggagatattagagaaaaataaaaataatcaaaataccccctattattgaaaaaaataataatgttgataggtaggtaaaggatatttaagagagaaaacttctcgttttatgtgtcgagattacgtaggatggtagaagttggatttttgttacgataaaattcaaatttcagaagttgatttttttttacggagggagtacgccactgccaagttcattcaaagtgagaattacccaaagatcacatcacactcgttggtagatgtacatctactccaaacagcttctccggcatctcaaaatttaacaagggatcttgggactgaaataatagtcttatccacaaatacaagagatttcagtgcttaaaatttatccacggatataaatggattttagatagaaaaaccattactattttgccttcccatctaacattcactgttcgctgttagttgcatcgctatacgtgaattttcataatc

SEQ ID NO: 52412 - DNA, 1501 bp, Oryza sativa
tggacgatgtacgcgttaattaacattagtacgttcacaaatacgagtacacctggcacacggcacagtggtacatcattcaagtcatttctatactccctctggttctataataagatgttttggaagatcaaacttttataaatttgaccatcaataactttaaaaatatttagtttaaagaaactagaacaacgtatagattgtctttcaaagcaatataataaaagtaaacatgtatttatttattgtgtatattataataggaaaataaggtcaaaaatatattttgtaaaccgtgttattgtctaaaacttcaattaaaatgaaacctgaggagtatatatcacgtcattaataagaaatctcgaaccatctaggcaagttttgaccaactgccattggacaccatcgcctgaatgtaagatcgctatcacatttaggaatccgacccgcaagctcgcatccggcgagctcatcgtgcataattaatcacgtcgatttgtcgtgaaagctagtagcattaacacattccgttggcagttggcggctgtacggtcacgactcatgacacagttctcctagtcaaccctctgtcaccagtccatcggttcgatcggtgatgaaactacggttttgctttaataagataataaaatttatttctcgccgagaaaaatatttccatccttatttcaatgaagttctagagcctattcagatttgtgacattgaaccatatcatttaaaaaaaacacaaacacgtggatgatgaagtttgttaccaaacattaataacgcctaaagaattttgataacaatatatttagcttatcctattaaactttagcaatatagtcaacttgctaattttaacatcggcaaattctaaaaaatatttatattttagcagtaatcggaatatgcccatagtctatcattatagagcatataattcgaacaactaaatattacatattcacaatttgatgcataaaagaaatcaattgggccggtgtttagttacaaatatttttttcaaccttccaacttttcaatcacatcaaaactttcctacacacacaaactttcaacttttctgtcacatcgttctaatttcaactaaactttcaattttggtgtgaactaaacacagactggatcacgcaatgtatattgtatatctctactctacaacaacaaagagctctatttccggcggagacaagatgccgcttcctcacgggagccctgtttttttttcccctggttgaatcgtcggccctggtcacggacggatgacgcgcgcccagtccccacatgaataccctgcactaccaccaacacaacgctcgtctcatttctggcctatatatcggaacaggtttctcggtctagctaggcggtggacgcgcgcattgcccatgcaaaaccagctcactacactacactttctctagctagcgcgacgcagttaagccgcggcccacacgagatggac

SEQ ID NO: 52413 - DNA, 1501 bp, Oryza sativa
aattaactaaaattagaatattaaataattaataaatatcatgtatataaaatacaatatgaatattacacatctgttaaggtgtgttcggatgtctcctttcccaacccctcttcctcgttttccacgcgcacgcttttcaaactgctaaaaggtgtgtgttttgcaaaaagtttctatacgaaagttgtttaaaaaaatcaaattaattcattttaaaaaaatagctaatacttaattaatcacgtgctaatggactgttccgttttccgtgtgttactattccggttgggatctggaggtagcgaacacagccttagtttggtcaagttggtacaaaattaaaagttatgctataattttaatatattttaataataaaatataaaaatatatatgatattgtataaaagaatgtaacgatactagccgcgcaatctgcgcgggccactataccaatttttaataaagtttaggaaataaaagtctatttgcactccgaagatgcactagcaattaattaaggaaacacaataagcctcacgcctgcggagctacatggcatgaactgtgtacatattaaatcatgtaggtgattggtagcagtataagatcagtctgagagactcgagcatttatggatgatgtacgcgttaattaacattagtacgttcatggcacacggcacagtggtacatcattcaagtcatctctatatcacgtcattaataagaaatcttgaaccacgcaagctttaccaactgccaagcctgtactcctctccgttttttaaaggaaatcgtttagagcaagtactataatatctcatatgttgcccctaaaaatgccacattagattgggtgatgaggtagaggagagaagtggagagagagaagatgagccacccctaaatcaagagataacctccacacaaatttcaagaagtgtgtgagagtattagagatattggtatttgtgtgttagaggtgatacattgtatgtgttgcctcttaattcatgagtgaataaaatagataaatttagaggtgatagtcacatctaccatagcacttgcccttagaacagcgacacggtcttcaaaatataactttgacttcttgattctataaaaaaatatttattaaaaagatataacttttgacttcttgcttctataaaaaaacatttattaaaaagtaatatatgtatatttttatgaaagtatttttcaagacaaatctatttactcaacaacttaagagttatttataatttatatttttcaaggtttgacttgaaaattgtgctataggactttctttgagtagtggagtacgtaagatcgctatcacatttaggaatccgacccgcaagctctcatacggcgagctcatcgtgcataattaatcacgtcgatttgttgtgaaagctagtagcattaacacattctgttggcagttggcggctgtacggtcacgactcatgacacagtactcctag

SEQ ID NO: 52414 - DNA, 1501 bp, Oryza sativa
gtttacaattccgagatgacattccgttccgggctctggtagtatgacgtttttcgcgaaatccggtgaaaagccggtagatttcgaacaaatttcataaaccaaaatttgaatacaaattccctgagtttatcgatatgctcacgaaaaccggttggcttgggcgaaattccgagcgaaatcaggtgcaagaccacatcctctctctattatacatcattatctgggctatgtactaagtaggcctaatacatggaattcggtccaagaaagtgtattcatttttttaaaaatattgttattattctcttttctacagtaaagttcaagaatacacggaatacactaatttttttggaaaatttatacccatataggttctatgaatatcatatcatttataggaattgatttgatttttttccttttttatcaatttaaattttaatttggatgaaacccatcgaaattccaaatggcttctacttttgagccacgtcaaaacctcggttttccgcaaattcgtcggttttcatcggaattgtgaaccctggacggaggtagtagtaggtcacacttatacctaagcttcttttaatctcattttttttaacggttttgctataattttttgacatatttttcagctgattgctataattggagacacatttgataaaaaaaaatagcatcgcataattggcatttgatttccacatggttatgatctttttttttttatcaagaatggttataattttattgctacaaagtataaatataataaaaaattaaaaaatgaattttagataccgttctaagttatagataccgcatcttctattatggtactctaggacgaaggaagtaattaacgtgcatttatggcaatacaatgtatgtgacccaactaagatcatgtttggagaactagtcacgagttattttgagagctattttttagcacaagaaaatagccatccaaaaaaaatagccctaagttgttcggatcaaagggttattttgagagctatttggcttttaatataccttcccatgaaaagagatagagataaaaggcatttttttagtgggccccacccaaaatagtttaaattagcactccttgggtgggatatttttttagatgggttattttcaaatagttctcaaatagctcaccttttagattttttttttggctatttggctatttgagagagggataaaaaataggacctaaatcgataatctgactttttttcccaattaatgtggcacacattgctcattaagtatagagatagatagagagatacagttatacgggtagatcgacgctggtgtagctattgctaacattattgaccagagcattagctagcgagcccaataaatttggtagctaataccgcctattccgccacgtaccgacgcccgttcccgcagatggcaccaccctcgcactgccacaccatcaatggcggtgccccacggaatg

SEQ ID NO: 52415 - DNA, 178 bp, Oryza sativa
aggagcacaggatggtatccgcactctctgcccccaaagccccaaatcggcccatcaaccaatggacttgtgggcatctggccttatagccttctggtcttctggagaaccgggcccccaaggccacaagcctccatctaccgctctcacttctctcgcagagatggcgcacgccttc

SEQ ID NO: 52416 - DNA, 1501 bp, Oryza sativa
ggtttcaaaactgttagacattttgagatttacttggtcaccaaagacttattagcccttgcatgtatacatacattcccagggatggcaatgcttcgatccccacatgcacaaaattcaatggtggactcaatccactagactacattagagcaaggctaataggaacaagtttaagtttaatagtatagccaactactagctccaattcatttatagtcaatctaatagctcattcgagttcgtgctacagctgactataaatctgtagtccgctgctcttctctctccttatttatctccttaaaatatgtttatagctggcttatagcctgctattgtacctgctctaatacagccgaccttttggctataaggttttttgtggtcttctctcacccacccatataatagttagctctttacaattaatatagggctcacttgattctctcatagagtttcttggttcttatgtccaagtcggttgtaagtttacagcccacttcttctctcctcaacatcagcatttagtcggcttatagcctactattatacttgctcttagaatttcaagtataatatgcaaactaccgtatttaatatgggcataatagagaataggcacccaaataaatccctccttgtatatgagatcatgtctaaaacgttaagattatttttgaaactggagggagtacttctcactccaactactgtcaatttaaatttctccccatcttacttctcaaccaccctctctcttccaaagactgctttgtttaacgaggacgtatagatcatttaccttccttcccaatttgtcttataaatgctagaattgtttaacgagtctgtttctttgggttcataactgcaaagtaatgtagattacatacaagcttctccatacaaacttatgcgcatttcactgtgatgttctctacttttcaaataatacaacgaagatagtgatgatgaggatgctgacaaagttgttgcgcagcctgagtcactagaggtataatactgtactgtttacttgatggaaatgcatgcaatctgcggttctcaaattagccttgcaaatttcttcttattactggcagtgacaacagatctttcagttcatatacacatgcttattggaggctgaatgcctctcttgcagtacacatggaaatagttgatttattgatgagacagggaacttagccccgcaaacccaatctgaaattttcgctccataggagatttgaactcaagggtatttttttacccggcctctacatccaatggatatatacggccattgaaatagagaacttagccccgcaaacaacctaatctgaaattcgctccataggagatttgaactcaggactttggggtactactcaggtcactgtaaccactaggctatatgccctttcgtagttatcgatacttgtcctacttgaaagcttgtcattcctttgtattatactgctttaccaatagg

SEQ ID NO: 52417 - DNA, 1501 bp, Oryza sativa
ctcgcgacgtccaccacggtgtgccacgccagcgcgacgaacgaccagagccacgcagcgaacgccagcgcgcccgccgacgccggcggcctgggccgcgcgtagatcgcgccggtgcgcgtcggctgcggcggcatggcgggcagcctcgccgggtcggcggcgctgcgggtgcatgccatgaggagcgtgagcagcgacatgccgtccccgagggagtggtgcacgcggatcgccgtggtggccgccgcctccgacgtcgggaagtccagcacgtggaactcccacagcggccgcgactcgtccatgggcttggtggacagcgacgccacgtagtcctccaccgccttgtccgggtcggccgccaccgcgtccatgtccagctccgggtagatgatgtggtcgtccacgttcagcgtcgtccgcacccaccgcgggttgccgccgtcctcatccgtcacctgcacacgcgcgcacacacacactcgtgccgttcgtcagctcaagcaccagcggcgagctcatgggcgcgccgcgcgcggcaaggcaggtgcacggaccgacctggatgctgcggaagcgtgggtagcgcgcgaactgggcggcgatgccggcgcgggcgacggggtcgttcaccggcgtggcaatgccgatcaccacgacgatgaaaaagtcctccaggagccgcgcggaggggctgacgggctccggcggcgtcgccgccgccgcccccttgccgccgccgacccggaacccattgccgccgttgctgctcgtcgtgcggacggtgagttgccgcttccgcaggacggtgtcggtgtctgcacccgccgcgttcatctcgtgtgggccgcggcttaactgcgtcgcccgtcgcgcgctagctagctagagaaagtgtagtgtagtgagctgagctggttttgcatgggcatgcgcgcgtccaccgcctagctagaccgaaacacatgttccgatatataggccagaaatgagacgagtggtgtgttggtggtagtgcagggtattcatgtgggggactgggcgttatcggtccgtctcatttctggtggtagtgcagggtattcatgtgggtactgggtgttgaaaatactggacctggccgacggttcaaccagggggaaaaaaacagggctcccatgaggaagcggcatcttgtctccgccggaaatagagctctttgttattgtagagtagaaatatacaatataccttgcgtgctccaattgatttcttttatgcatcaaattgtgaatatgtaatatttagttgtttgaattataggctttataatgatagactatgggcatattcagattactgctaaaatataaatattttttagaatttgccaatgttaaaattagcaagtcgactatacactgctaaagtttgataggataagctaaatatgttgtaccaaaattcgttaggtattattaatatttggtaacaaacatcatgcatccacgtgtttgtg

SEQ ID NO: 52418 - DNA, 401 bp, Oryza sativa
cagagtaccacgtctcgagaaaagtttccagtccacaagacgacaggaagcgggctgttgatctatcaatcgcactacgacgtcttttacttgcctcgtctatcaatccaggactacccgaaattataacagctccacttatctgtcttaacgggactgcgttagaatcataaaaataaagaaattgacacacaaggtgcaatgtcgagagattgaccttggggctatgatctaacgccatgtgtagggcaatgcttgcacccattgagtagccaacaacaaccaccgctccatgggttatatttcttatcaacttcagtaacaaatctgcaactgattgaactgcaaaggagatttggttggagctttcaacatcatgctgtagaatttcagactcgcca

SEQ ID NO: 52419 - DNA, 393 bp, Oryza sativa
attcctgcgccccggttcacgtcctctgtaacaatgatattacacatgtgtgtaaaataataagaaaaagtgatttcatcccttgaagggataacccctcatttagtgcatgtcacctaaatggtcataaaaaatataaaaaaatagcagcatagattaatataaaatatatcacttcacaaacatgcaagtttaaattcaactgttataagttgtaacaaagataaaaaaaatatagttgcgaatgtgcaataactatttttagtctaacttgttatttttgttgcaacatgtataggttaaatttgattttatatgtttgtggagtgatatatttcgtattaatatatttactattttttttaaaaaaatttgataactatttagatgaca

SEQ ID NO: 52420 - DNA, 1501 bp, Oryza sativa
ggtttcacaactgttgacattttgagatttacttggtcaccacagaattacttacccttgtatgtatacattccaaggatggcaatgcttcgaacccaacatgcacaaaattcaatggtggactcaatccactagactacattagaattaagtataatgtgcaaactaccgtatttaatatggcataatagagaataggcacccaaataaatcaatccttgtaaatgagatcatatctaaaacgctaagggcttattcggatcggagggtaaactcaggaaaaacataggatctgcattcctatggattcgggtactgtagcagcattcggatcaaaggaatcccctgtaggaaaatcagaggaaattcgaaggaaaatttccttggccatccattccacaggaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagatttttgaaactggagagtacttctcactccaactactgccaatttaaatctcttctccttactacttctcaaccaccctctctcttccaaacactgcttgtttaacgaggacgtacttccttcccaatttgtcttatacttttttttagataagggtatttttacccggcctctacatctaaccggatatatacggccattgaaatagggaacttagccccgcaaacaacccaatctaaaatttactccataggagatttgaactcaggaccttggggtactactcaggtcactataaccactaggctacatgccctttcgtatttgtcttataaatgttagaattgtttttataacagaggcagagcaagtatcaaccaaagatacttcagggtgagatatcagtttgagtatattttaagggcattaattgggatgaaacaagggcgcatttaggttgtgtttagttcacaccagaattggaagtttgattgaaattggaacgatgtgacggaaaagttgaaagtttatgtgtgtaggaaagttttgatgtgatggaaaagttggaagtttgaaaaaaagtttggaactaaacacggtgtcaaatgacagaatttttctgtgcatgtgagagattagactattatcgcacgtcgttaaaaacatggcaggaccgcacaagaaccatacaagtacccttttttttttaagataaagagagttttattgatcttaaacaattacatcaagatgatacaatttctctaagaccactctcggcctctgcatagttaggatgtacacagcctat

SEQ ID NO: 52421 - DNA, 378 bp, Oryza sativa
tattttatgtgaccggtctgaccgggctgtgtatgccggtcagaccatcggtgatcgagcggtcagaccggccggcccccggtctgaccggccgacgctgtgtcggtttcggtttcgggttgtttctttggatatccgtgattgtttcatggatatggcttctagatggatactatacgtatgtaatactgttgtttgctaacaatgagtcaagttggtgataacttggtctcagaatatggtttctttatttgtttcatgtgtaggtgactcgatgcctcgggagaatatttgcggtgatggaccgggagtcggcttggtggtaagacgatgtccgtggtggtcagatatcatgcgggatactaaagctagagttga

SEQ ID NO: 52422 - DNA, 704 bp, Oryza sativa
aattcctgatgtatcaaaatccatttagcacttgcttgtccataaagtacttacgttgccacttaaccttcgttctaatagagctggtaatgttgcagttgagcttgaaggtagtggatcagatgttacgtcttggttgggaaggtgacgggcttcttcagtcatgagcaaaaagcatttattttggtaaatcattactagcttaaagatcattttctgttcgtgttagcataatgaatcgatggctcgagatgtactatctgtacaaagtggataagtaataggacctgcgagttaggctgagcaaaggctaggtcgtacaccatatccagcagatcatattattcagcgaactgctgagtaaacgaactttatcgagtagccctgtaaaaatcccgatggtttttctttttgtagaatgggtgaatagtcattttacattgtttgcagcgttgtatccatttttggttgctcggttcagacagttttctgtcttacaattctctgtagggtgaaccagtgtgagcaaccccatttttgtacatgtaaattttggcatttggctatgttttgagtatacggatgcaaccatcacatagaggttatgctgagactattcgccgttaattggtcaaagattttatgtaaaatccacttgcgtgtacgctgccttgatagcggactgatgggaacattgggaagtt

SEQ ID NO: 52423 - DNA, 669 bp, Oryza sativa
actgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctca

SEQ ID NO: 52424 - DNA, 664 bp, Oryza sativa
ctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggatggggattaatacactagcgttcgggaaaaggcaattttcccggtcgcgacaagctggtatcagagccaggttgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctg

SEQ ID NO: 52425 - DNA, 881 bp, Oryza sativa
ttgtaagggtggcgtagaaattgcatttgcattaagtcagagacacaaagatgtaattctgggtaatcagtatacttaaccacgtcagttacttattcaaggcttctacaaagttgtggagatgtagtcgatggtcgtgttcattttcacatctcacatcattgagctactgtgaacagatcgttcttttcatgtcagaacaaagttacaagcatccctatgaaagatttgcacttcaattctaagttagcttgaaatactgattcaactttgggcatatagcttgaaatactgattcaactttgggcatactttttcagaggtaacctaagaattgctcatatcggtgatctaaaagcataaaaaactgtagcagacagtggggtagcagctactgcagttctttgtacaattgcagcagcataacagtctcgtgctggctttcagtatattctagtttgcatacatttcaggttcaccattagcatggtcaaacatttaagcctattattggtttaaaattataaactaacatgttctactatcaatgttatattacgttatcaaaagtggaaaaatgatcaaactcgtaaaaacttctatttaggagtggagatagtatataagaagttaatccaagtatgctaaccatttagaaggacaattacaacacaaattcagcagttaaccactgaaatcaacaaaaaaacgcatcgccggatcataaaaggcaacacaagggaagctccctcgttactggacctttagacacaacacatctgtaatgcttgaaatcaaaacgatgactagttttttgccagaatgaccgaaggaggtcattcaatgtaattaagattggaaaaacgatgactagttgaagt

SEQ ID NO: 52426 - DNA, 569 bp, Oryza sativa
ttacacccctaaattattgcatcggtccgatttacacccgcgaactacaaaccagacattttgtgtacgggattcttcaaaccggacaaatactaaaaactattttgagttgttttctgcacaaactagtacacacgtggcattccaactgaaaaaataaagaaagcaacagtgggcccacatgtcatatctctccctctatctctctctcgacctcagatgtagcgatgaaggaagggaagtaactcgacgacaacttttcgatctaaacctcaccagcgccgcttccatgcgttgagtccaagcgccgctgcggcaaaatcgcccaattcactatcttttgcaatgtactagcatgtcaacaaagagcaagaagcagtagcaatgtactagcatgtcaaccaatcttttggtttccgcggagccaattcctcttcttcgtatctgaaaacggcaaggaggacaccgcctggtgtcctgaaacagaagcagcaagagcaaggcaacaaagccaacaaggcaggagtagaaggccttggcaacaagtatataagcagcgggtgcaacca

SEQ ID NO: 52427 - DNA, 1187 bp, Oryza sativa
acgatgtttcgccgaagttattgatcgagccgactaacgactgcacgcacgagtggacaatgtctttgatcattcatcactgggtcagtttgctcctttttttataaaaaaaaaatcactgggtcagttagttagtcagaccttctttgtttaggcttagacttattggcctagattttttaagtcaacttattgacttatatgatttataagccagtggatttaatgtcctaagtttagtggtggagttatacatctatctcatataagaaaaaaaagcttctctaacctaacttttggcttaatagtattagagtggcttatggctttaaaaaagtcaaataaaaaactgcttgtttgttttggcttagacttttcgacttataaattggcttataagcctaagcaaaagagggcctcaaaacaatcgccgtcgaccaaccaaacaggaaacaagatttgagaaatagtacgagttagtagttcatatgctacggcgcctacaccaggttgtgcacaatgcaccgctaggctaattctgaatgtagacgtgcctgctgagcttggacgacctacacgaaacgcgatccgaagaaacatccattgttcatgggacgcgcgttaatgcattatacctggggctaaaaccaaatggcgatgggaacacctatatatttatcgataaattttctcctaaaaatttgacagatgtaattatagtataatcgtagtgtaattacactgtaatttgtatgtaattacactgtaatttgcatataactacagtgtaacttgtatataagtttcacgtaattttgaatcgttagatctattacaagatttgttttggtgaggaagaaaaaacaatcacagcacacatatatgtgaaagaatttgttcccacaacctccattttaccgaaataacatgttacggagagatttttgaaagttacatacaagttacattatagttacagtgtaattacactacgattgtgtaattacatgcaagttacagtgtaattacactacgattgtactgtaattacatctgtcaaatttttcggggaaatttgtcaacaaatatatagcaaaattgaatggggattcaccccctccatccggccatcccatgagatcggtgcacacacgcgtcggtgacaggcgccgcgcgcaatggggaaa

SEQ ID NO: 52428 - DNA, 204 bp, Oryza sativa
aggagtcaacagcgccagtgaggtcccctaggaaggctcctctgcctctccgctcatccttcccacctctctttcttctcaaggtggtgatggggagatgtccatgccacgccatcttccccgtctccggaggctccctgccatcggatccgccaccaccggccgcagcctcataatcgcacgcttgctttgccccgccgcaga

SEQ ID NO: 52429 - DNA, 270 bp, Oryza sativa
aattcgagctcggtacccggggatactatagaatactcaagcttctgtagccgatgcctcaccacattgatccaagaatcggctgacatgttcataagttgaaatattatcctgccctgagaattttgagaagtctggtactttgtatcagctaggcaatggaaccctctcaaaccactcagaataaggatgccgatacaaatttccagtatcttttggcttgagcccaaactgttccctcattacatctgcaatcatatcagtccatga

SEQ ID NO: 52430 - DNA, 1501 bp, Oryza sativa; identical to SEQ ID NO: 32730

SEQ ID NO: 52431 - DNA, 1501 bp, Oryza sativa
atactctctccgctcttatttttttgaaaatgtatctattgactaataagtacactaataatatctacgccaagtattatataggttatatcattagatttgtgttttaaaatactttcatgtgatactgattttgtagttgttgatgatataatatacatgaaatagtttgatactacgccggaccaggtcatctctgacgggcccaaaccctcacctttgatgggtttggccttggtcagtgattagtggtcactgatgacaaaatcacctgtgacgggtgaaacacccgtcacagataactcatctctgaccggtatataagtcatctctgacgggttaaaacttgtcacccgtcacagataagtcatcagtgacgtgtcataactacctgaccatcactgacgactaatctctgacgggttgaaacttacgacccgtcactgatgacaaagcaagaaatacaatttttaaattttaaacgcaacaaaaaaaacctcaaaaaaatattttgaattttactagccatcctatacatagttacacatcactacctacaaattcacaatttttcacgcaatataacttgcatgctaaacgtgagattcaaacttaagacctcaaccaccatagagagcttccttaccaactcacctactcagcacatattgattactcacccaatgttattattttgtctatgtttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatagatctcactttataacatgtattttgaacatgtaaactttgtcaaatgaaaatattttcaattattaatgttgtagatctggttgagttctatgactttgatatggggcatgtatccatccatgtcatttgaaaaaaaactcaaaattttgtttttaaaagtagatctcatcacttgtaatgcatcttcggggatgtaaacgatctctaatagaaatgttattagttataaagttgtggatatcatcgagagctacaactttacttttatataggacatgtctcaatccgaggttttttgcaaaatttaaaaatttgaattttcactcatcactgacgggtcataactaccacccgtcagacataacgttacctgtgacgtgtgttagttaatgacccatcagagatgagtggtctctttttagttaaagagccatctgtgacgggttacaagtgcaagtcgtcacagatgacctcacatctgtgacgggtcctccctagtagccatatattgaagaggatattttttcggcccgtcagagatgactcatctttgacgagttgcgttggcccgtcacagatgacccgtcactgaagcctggatctgtagtagtaagttaaaatatgttattaaagc

SEQ ID NO: 52432 - DNA, 1501 bp, Oryza sativa
acataacgttacctgtgacgtgtgttagttaatgacccatcagagatgagtggtctctttttagttaaagagccatctgtgacgggttacaagtgcaagtcgtcacagatgacctcacatctgtgacgggtcctccctagtagccatatattgaagaggatattttttcggcccgtcagagatgactcatctttgacgagttgcgttggcccgtcacagatgacccgtcactgaagcctggatctgtagtagtaagttaaaatatgttattaaagcttggatcttagagtttgttagagataagagtcgtgtccgacaaggacatattttgtaatctcgggtataaatagaccccgaaccccatgtaattagataacacgtgttcaaatacaatctcggcgcatcgccacccttttactttcgttttgtttcgacgaattcttgctttcgggttgagttgcatcggtctcgatcttcaactagaggtatgacttgttatggcggcttgcgttctcgggattagtgcttccatcattatgatactctaatcttgtctacgtaagttgtcgagctatcatatatcttatataatctctgataatattgctatctaacctccaatcggctaatatctatcactagggagtagtcgattaggttagatatcgatgttggcatagattatataggatatctacccctctatgaagctttcaatagcttgattgtctagatattgtctttcttttcatacttatggctgcattagttgagtttgatctcataagtcgtgcttagaactataatctctagcctgcttcttggttgtcgattagagtagtatcggggtttcagccgatcttacctgatttagctttatattccatgtgcttagttgatatgctagatctgccctttatgttaagatcttattgcttttaggtgtattagactttacgtttgatatattttacttgctttaatatcttaatgtagagtagtatcggagtattagccgatacacactagatctatctgattgactatgctatgaatggttatagtttccttgttaacatatatttcgatctaagtgatttatactgtctcggcatggcgaccgatctatcccaatcacttgatttaagtatatgtcgacatgaaaattatatatcattgatatctacagccgatcgaatagatctagtttctttattattgcctcgcacagccgatcgatacagagatgacatcagctcgagtataaatgatacgtcatcggcggctggccgatcggctataatttatggattaactacggtttatttgtctttgtttcttgttgattgcaggatcaaatcaactggcatgctcatgaacctaaaaggcaagattttggacctgcactggagttaagcagatctctcaggcctcgtgtttttacatcaacacgcttttggcatgcccggtgggacccgagttttcgacgacctcatcccga

SEQ ID NO: 52433 - DNA, 1501 bp, Oryza sativa
atgtttctctttatagtttctatggcattaatttaaactttcttctttttgctcacagaacacagtgacattacgtcttgaaggtactgaggaagagttcttggaaaatttcaacagatgccaggctcattttcaatattggcttctcatgaattcacccttccgcatacgttttggggaccaagttatatacactacccctttggatgggacattttactatgtcctgcaacatgaaggtcgctatgtcatactcgtagtattagccaggatggcatggctaattggtttttgtactacaaatggatttttccaaatggaatttgaagatttgatgggcctttatatggatagtgtccacagccaccttctcagattcaaaggaaatcaccataccatatcgcccaatgggacaggaaacactactgttaatttgcaattcattagaaaatgcttccacggattgtgtacatttgttccaagcaagtgtcaggacccaaaggacttgccagtgtggattggtctttttgttgtgctgattatggaatccaaatctcgtgaaatccataggcgtcattgccatgcaatccttgaggtgatcacaccggagttgggtagagactatgtcaatagttttatcaagaactggagttcaattagtgctcaagtgatggggtccttgacgaatttaacacaccatccacatgactgtggcattgatgtattggttacattggatgatctgattcaggtattttattaccttcatgttgatgcttggaatggaggattgtttgagcatgagagtctcgcaccccctccgagagagatgaaatggtctccagttgaccccggggtgggtgatgcaaacataagattacctcaggagccagcattacatggacgtggacacaagcgtacttctgctgcaactgcagagatgtgttcaaagcgagcacggggtctcttaggaggtgggcttggaggacccccaacagcaccagatttttttgttcgatatgtgcaagggggagatcaagtaagatctccgttttctctcatcattcgaacggcatgcatgcatcatggatggtgtattgaaattataggtgtttttctatcgctcattttgcagatgcagaaacaagaatgtgatcacttggtttctcatctagtctcatttggcatcactgtaaagaacgccatacgaacacctgcaccaacttccctagtaaagtttggccagcttgaagacattcgacgtgagaacaatgaacaagcgaacagggaagaggcagaggattaagggaaaagagaaaaaaagggagagggggggggggggggtcaggaaggagcagtaggagggttgttgatccttctgctcagaagcttctcaccgaattggcagcatcaggcactaattctcaagggtttactttggtggatgggctcatcaaacataaggtcaaagtatgcgttgttgaaaattctgcattgcaga

SEQ ID NO: 52434 - DNA, 1501 bp, Oryza sativa
taacagaccaaagaggcaaagaacacttgggactacatgatccaaagaactctcctatacagtaaatcataaaaaaccaattcttgataaaacttactcaaatgaacatactaattgaaagtttagaggctcccaaaagctcacactgccggaccacaaacactggcaacagcggcatcctatcttacccccagtggcagacatcgcacaccccatgaccgctcctagtaccaatactgcacactgcctacaaggggtcgatgagacaagtccccttcccgttgttatgacccaagctcgtgagagatcaaatcacatgaactggtgacagtgttatgggtagaatttgggagaatttgggggagaaaacaaagtaggtcaaggggaacaggggaacacaggagagaagagaacacaggaattgtactcctgaactcctcactggaatcaaaaactttcacatcaccataatatccttgtaattatcaaagccaagagtatgcaattattcaagccattaaatctcatcaagtgttcctctgcatctagtttatgtgcattgccatccacaagcacacacgatatttcttaaaacacttgatctgctgcctctgcaaacaatgaaactccaccgacatgagtgagcacgatgtcctttctcctcagcatggaggatgcaactgatcttcaactacacttattggacttgaggtatagctaataagtgaagtgtctgtaggactgtagctgcagagcctgtcgaggtggcaagtccaatgtccaggattcaacatcaaacacatgggggaatcgctagcttctggttgctggagcacgggctgcacatacttgacatctaacaagcaacaccatctaaccctggagttcatgttgagctcatgctgcgtcttggcatggcgtacttgagtgagacgacagcctccacataagtaaccgcctcaattgcactcatcacccgctctgacaatacggaacaaatacttcgtgaagcacctctgtggtcactggacagagcacatggctcacggtgacgcgaacaacacttgctgtggttagctccttgtttcttggcatttcatcaaacatcttctgggcatcaacactggaggtcacctctggatttgaaacttgaacacgaggaatccgcgcgaggtagaaggccccgcgagaaaggtggtagatcacccagagccatggtcccaagcttggcccccaaactcatcaagcttcgcccagaatcaaaatgccaccacacatggcttccttcctctgttcccctgctgctccagtgagtccaatggcgatggtctccgtcaaccgccgccttcccggcttcccgctggttgcgctcgcgccgccgccgccgccctcagcgccaccgtgtggtgctctctctcgctcgccgcccgcgcgccactgccatgcccctgcggccatgcgcaaccttagattcctcgtcagctgggctgggctgggccgg

SEQ ID NO: 52435 - DNA, 204 bp, Oryza sativa
tgcatttatgtgtcccccaagccaaatcatgagacaatcgacagaaagatcttgaagggggagcatggaggactaaaacatccacctcctcaaccttcaataaaatgtggtgtaaggaactccactacacgtaatatcacgtacatatttctatatatatttaagttcatctgaatctaggtgaattttcgcatccacaggtct

SEQ ID NO: 52436 - DNA, 217 bp, Oryza sativa
gggcctgttcaacgtggtgtagcattgatcagtggagatttaatgtcaccttaattactcaacagttttactgttttgctaataaaatgttttacaaccgcctttatgcaaatagccgcaagccatccttgtatccccttgcacgtctgtatcattggtgtggcttgttgagtacggtggttgtactcagccttactattattccccctttttcaga

SEQ ID NO: 52437 - DNA, 450 bp, Oryza sativa
atgatatagctaaatgagaggagagaaataatattaactaagtgaggatgaactatataggtgtatgggatgatgatttaacattcgttcattttaagctctaaagttcaataattataaaataaaattatagataatatagcatgcttgtacgatgtttatatgtaataattattagtgaaagatgatgtgtcatcattgcatgtagagttttagaatttagtgggttatagctttatagtaagataagaattatgcgggatgatgatttaacattcttgcattttaaagaactaaaattcaataattataaaattatagataatatagcatgcttgcatgatgtttaaatgtaataattattagtgaaggatgatgtggcatatataagatcttgctacgccatcaaaacttttgctgaatcaatacattacttcttctatcaacaga

SEQ ID NO: 52438 - DNA, 291 bp, Oryza sativa
tccacctccacctccaccgtgtccgcctgcacctctcaagacaaggtctcgccaagctccacctcctgccagcacaagggcagcgaagaaggccaaagttgacaccaccaaaaacaaggagccgccgtacgattgcagtcaagaggagcttgatgcttatgtggcaggagaagtgaagaggcaactcaagcctcggagtcctgaaaagaagatacctattgacccgagcatgaagaatttcttcaagggaatatccaccacaaacaaggaggccttaaagctatcggacta

SEQ ID NO: 52439 - DNA, 1501 bp, Oryza sativa
gtcccgtcgatcgcccggctcgtcatctggctgcgctgccaccgtcgtgggcatcgctgcggcgtgtcccacgccgtcctcacctccgtgcagctactgccggctgccctcgtcgcctccccgtcggtcgtcgtcttcctccttcctcctcgtcgtggcgttcgtccctccgtcaagccgatcgcgttcgccgcccgcgtttcgtcaagtgtgcagcagccccgtcgtcgtcttcgtcctcggctccgcgtcatcaagccttgtgccagccgcgtctcgccttcgtccaaggatcgccgccgaagtcgttccctcgccgttcgcctccgtcgtccccgagctgtctccaccgcgcccgttcgttgttgtcgttcccacgcctcatcgcgtggtggtaaggatctctctcctttcgctgccccgtcctcgtcctttcggtgtcgcccgtgcccgttgtgcggttgtcgaccccggtgcccgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttggcacacggggtccgcttccgtcgacccgtgggccgtctctgtgtactcggtctactggggtcccttaggttgacatgtggggtccgcatgtcaacagcgcagccttcctgtcttttccaagctagcgcttgcacatgttttatagttgcaaaacctaattataataatccgcaaatctccatataacagcattaaacttcggatgaccatgtcttggtcatacgagctccgaatcgatccgttcaagtctcctaatgtttgttataatctaaagaaccgtgtgctttctttttatgtattgttatttcttctttataggcttgtagctttgcttgtgtgcttcgcgtagcttctgtcgttccggaggttccagaagcgtggttcgcggtcgtccccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagatattattattgctattgttattattatcttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctttcttcctctttcaaaacccctaaaacctgttgtccggtggggtttgggtgcatgccagttgtgggaagtagcaccccggccaatataaggattaa

SEQ ID NO: 52440 - DNA, 880 bp, Oryza sativa
cattaaaatatggagatagtattatctagtagcaatatggagtagggtagaggcaggaaaatataaatttgcataaatattcttcctagctgattgagtgaagttagaacaagaaatccaaagcaaagagaagaacaaaaaaggtaggtatatcacatcatcaacttactggtgccctggaaggagtcgtaatcactgctaaaagtgcttgttgtggttgatatcccaatctccgtgcaaattcaacagccacaaaatcaattgaaagaaaaaaaaatattttttgctcatatggcaaggtttgcccaacaattgacatacacatgaagccttggttggttctggttcatatggcaatatatatggcacaaatcctaataaaaaacttgcattgctcttagctatttacaggtaggtgattttttgcctgaaaataaatagaatgtaacaaagtagaaggctcaaaagccttcttgtagcgaagtgggtaagattgaccaaaagatctccacacctatagtggctaaatccgcaaacttggcgcaatgagacatacttccatgtggtacaaccctggactcaaatctccgactgattgagccatgctgatgtgttagcttgaactctgtaatcatcaaagtgttcagtgttgcaacaaccacaaacctattttggtcacgtagcttatcaatgggaccttgaaagagcttaatttgtggggtcatatgactaacacgacaagttatagtcaagtttaggctgccacagccatcctttagttcatatattcgaacttgcaacgttgcctcaattgcaaggatgaagtgtgctagcgttatgtccaccgccatgccgcaatccccatggatgcgataaatgt

SEQ ID NO: 52441 - DNA, 775 bp, Oryza sativa
tatatatatatatatatatatatatatatatatatatatatatatatatatatatgtatatatatatatatatgtatatatatgtatatatatgtatatatgtatatatatgtatatatatatatatatatatatatatatatatatatatatatatatatatatatatatgtatatatatatatatatatatatatatatatatatatatatatatgtgtgtgtgtgtgtgtatatatatgtatatatatatatatatatgtattctatatatatgcataatatatatatgtgtatatatatatatatatatgtgtatatatatatatatatgtatatatatacatatatatatatatatatataatcaaccatgcagcaaacagggccatgcaaataaaaaaaatggtacacagatctttagtcccggattcgtagtcccggttggacaaccgggactaaaggggggttacgaagtaggactacaaacggtttctccaccagtgtagggagttttggtgatataaatagacgaggggttgaggctagaaggataactacttttgagagagaaaagttaggatttacttcgatgtttcaattctagttcgtgagttgagagaggagtgctttaagtgcactttgtaaacacatattgatgcaataaagttgatatactttcaagtgtttcgtcgatacgtgtttttctggatcctgacggtttgaccggaggcaagtctacggtctaaccgcgggcggtcacacccgcggcagg

SEQ ID NO: 52442 - DNA, 269 bp, Oryza sativa
aatttttcttaaaaaacacatcatttaacagtttaaaaagcgtgctaacagaaaacgaggaagttgaagttttaagttggagaaaagaactggcccttagaggcataaggtttttgttagattttttgactgaaggtttttttgtcatattttttttttcacatgagcgctttcaggtgcatagaccatataatacaaaccactggatttaagcgcttgtggcatgtcctgggaccctgaagcatccaccactccacaagcggccgcca

SEQ ID NO: 52443 - DNA, 313 bp, Oryza sativa
gcaaattgttcattgagtgcttgcaaatgtgcgtctgacttgttctcaccgtaaatggatatatagtaggggacatcaatattgactgacaccaattgcagtcaggttttcctattgcactacaatcgatgtttacacaacaccaaccctttaaccacatgcatgcatatattaatatcgaactacctcaattgcaacaaactcaagtcattgtagtgaagaaagaatagagcttgtgaaaataccttcaccatgtcgtccttctccaagagagtagctcatcatctcacatcactgctaactgtgatgcaca

SEQ ID NO: 52444 - DNA, 1501 bp, Oryza sativa
taaggcttatgttaggtgtgggaaacgatgcaaatgctatggaccaaagtaaacgcttgcggactggtggagattatactcattctccttatgctgctcccccatatcatccacccccaccagctgtttccatgtggggaactccagggtaaatttcttaatttgttgctctttctttcaactaattatgcacagctatggagctctataatcctttttttcttttgtgtatcattcagttatatcgcggcacctccaccttacaatcattatgctgcctattcagtgcctcctgtggcaatgacttcaccttctcccgtaccaggtccaactgcctatgctcctgttcaggtacttcggagttatgttatatatctcaccttggttttgagcttaatcttaggaaagttaaatattatttcctgattaaatttgacacaggtcattggatagctccgttgtgtgcacatcatctctatttctttgtattaactgttatgtaagatataatatgatgaattcatatttgcttatatagagaagtctaaatctatggcccctgcactttacaacctgtgacgaaaccacttgaataacatcattcaaagacaacctcttcctttttttcatccacttgaatataattgaactatgaacattgataaaaataaactagactctgttgcctttacctatcctctataacttctcaagttcctccctaaaaaataaccaggtaatatgtgcacaaatgtgtgagtacataaagtcttgtttgcaaagatgcttgtggtgtttttcattgaacataatgcttgtcatgattttggttaataaattgtaatgctattaaaaataagaggtggttgctgcattgctgatgcagaatacattgtttggggtcaatattttgactgctttatactgttcagttttctgaaatctagtattaatggtatattttgatttctctttttcagaatacaaaggataaccctccctgtaatacccttttcattggtaatcttggagaaactgttattgaagaggaattgcggagcctcttcagcgtgtaagaatcgacgccaatatcgttgtctattgtgtgcagtggtgttgcatggtatggttctagaaagtagatacaacagttctaactgattattattcattttcctttcaggcaacctggttataaacaaatgaaggtgttgcgccaagacaggaacactgtttgtttcattgagtttgaggtaggtacttacaatattgtaattttatcttaaccttatcctacattcttatgcatctcactgtttgttaaattttaggatgtgaatgctgcatcagctgtacaccataatctacagggtgctgttattcctagctctggtcgtggtggaatgcgaattcaatatcctttatttgctcaatgaaataaaataatcacttacattaacattagatatttatgtttcctttgctaattttatatggtttg

SEQ ID NO: 52445 - DNA, 1501 bp, Oryza sativa
catataactcaataaagcaaactcaaatggacccaactttactaagaaaacactgcgcgaccatacggctcacacgacgtgacgagagaacaaccccggcaatacggacgctgagtggtgtcccacggcttgctgccctactcgcgtcatggatcacgtgactttgagcccgactctcggcatggactcgaatttttttaacgtgtcattttgggacaacgatgccggtgtgtccccattgtccttactctccccttcgcccacaccatctccatcgccgggcggtcctcagccatgctcgagaccatcgctgccccctggcttgaagtgtagccatgaaggagaggaggggcgctaggcagggaaagaggataggagggagaggacccgggtagggggataggagcgatggtgggaataggagctacatagttgtcactcgatctcaaggactggacgaagaagtgccgatccagtcggcggtgtggagagcggaggaaggaacgacaattctgtcaatggcgcactagcatggagggagagacaaatggggaaaatgatgtgtgggtacaaggggatgagggtgaggggtaatatgtaattttttttatggattggaatagataactttaaatacgtttgcaaattaaaattgaacatattcgaattctaggggccgatatgcaaattatttatggatcctaacaagtgtagcttgcattatggacacatagtatctttagagatggttttatcttaggtgatgtttggagactcttataggaacaatgcttgacacaccaacgagttttcctagctgctatataagcccaagcatcacatattactcaattaagcaaaactaaatggacccaactttactaagaagacactgcgcgaccatacggctcacacgacgtgactagagaacaacccctgcaacacggacgctgagtggtgtccacgacttgctgccctactcgcgtgatggatcacgtgactttgagcctgactcttggcatggactccaatttttttaacgtgtcattttgggacaatactccacgtactcgcactgaatgtctaaaaaatacatacaaagtgaaaaaaatattatgatggttacttcacaagttagaaaattttgcatgttctttattcgatccaaaagggcctgaaatcagctgaaagctgctttgctaggctgggccggaggacgcacctcacctcacctcacctcgtcatctcatctgcgtgcgctgctgcctctctctctctctctctctctctctctccccgaaacccccaaaacccaatctctctctagggttagggtttgtgcccgcgcgccacctcctcccctcccctccgccgccgccgccccgatggccggaacgatccacccgttccaccagcaacggccgccggcggcgggcgcgcccgccccggtcgccgacgttcctgcgtcaccccccgtgccgggcgtcccatgcgcgcccga

SEQ ID NO: 52446 - DNA, 1501 bp, Oryza sativa
attaattcaagtgcgtaccaagaacatggacggcgacaaccgaatcgttgggcctcgcgacgacgcggatcgcccacgagagcagctcggagcatccccgggagttgttgggcacgccgaccagtatcctcgaccccagcagcatcagccggcgtccatcgtccacactgcactcctcaatggtgtccatcttcttcttctacctctagctcagctcagctgatcaactagctcctcctcttcagctaccactgctactagctagctagctagctacttagctagtggcctagtgccagcactgttctttctttcgctccgactccggcgatgtcgacggccacgacaaggacagggattgtatttgtaggggaggcatggccggatgaatattttgcacactcatggtgatagccttgatagatatgggactgatgaagttgctgtgcagtggagagaaaaggtggttagttagttggaggtagtgatggccattagctgatcgagcttgtgagctctatgccatgtgggcgaccaccatggaaggagaggagcagtagcagcagaatggtaatggccatggcatgcattaccaaaaagaagaagaaaaaaaagagaggaaaaattggggttgcttgggactgaagatgcgtgaaggtacagagataggtagagtttgcatgggagttgtagagtagtgccaacctaggaaatgtggctgcttctgattggatcttgcagagtattgttacccttcaggtgtacttgactgttgcccggtttgatcttgcagagtttttttttaaagaacttttgagggatctacatgttaacaaattcaatgaaatttaaccataaaaatgttagtgttgtggcaaaagattgatgatatatggattttcacttttttttcccaacttctaaatctggaatttacaaagaaatttggcctagatgctgaattttgctgccctttggtctttagttttcaatacatgtttgtgtttccagtgctgcacctacctacatgacaatgggaaaaaacaggtagaattgatgctttagccaaatcatggaccattagaagtagtgcaacctgtgatgtagtacacacaaaattagagttgcttttaattcatggtccttaattttatctcgagtgattagtacagaaacatgtacattctattatgtcaattttgagttggtagtttggtagtaaagcatatgatgctgtccactgaaaagaatcttgactggtttgatgcaatcaacatgttctagaaaagcaaccgtttttcggttatgaaccgttaaatctagttgttagacgagttacatcaacagcttttaatcaaccttaatagtgaatcaggtcatgcattaccaatgtaggaattggatgatttccatggtaataaaattgtttcctactgaattcatctggagtttcctgttgaattcctcaatcattcgtaagaatcaattgaataagattttc

SEQ ID NO: 52447 - DNA, 1501 bp, Oryza sativa
aaaaaaactcaacaccaatagtgataaccggtacagtttctgtttattcttggctatcatactctagctatttaggccctgttcactttaatgtctttttcaaccttaccaaattttagtaaagttgtcaaaaaagtggctatatttagtttgctgccaagttttggtaactatgggcttatttggtttgataccaatttactaccctaccaaaattttggcaacttcaatagtagcaagtggatgtttggtttgctaccaaattttacccaccatagttcaaattgaatactaccaaatttggtagtgccaaaatttgccaatgttttggtactatcaagattttggtagggcaaaaattggctccaaaccaaacaagccctatataaaaaatcttgccaaatttttggtaagttgccaaaattttagcaataccaaattttagtaattttttttttcatcaaagtgaacatgcccttaatcaaatatagttgatttttatccatatatacaattttccgcgcgggtgtcatctacttcatgtacaaattaattatgccaaattcatacgttctagagggttcatgagcttcaatacgtctttaatttgcagtagtacttatctaaattattcttagaagaaaatccattttcccctaaccacaaaaccaatttctttttcccttgggaaggaaaagagttattactacaccatcaccaccaccacttgtacggcaggattaaacagtgcagatagaaaccagatttcaagtttttctagcttgtacggcaggattaaacagtgcagatagaaagagatagccaaatttttttgagaattatgacgcagacactcacaacgcacgcgcactcacccctgtgaacacatgtacgcacgcagacactcacaatgcacgtgcactcacccctgtgaacacatgcacgcaaaccctacccctataagagcatctttgaaaactgggccgacaaatcctggagagattgatgaagtcactacaggcgcttcgctgtcgacgggtacgtcgcctaccactaaaagcacaacgccgttaaatcctggaaaattcgctcccaaggggagtcgaacccaggacctcaggtgctactgaggctcttgtaatcaccaggctataggccctttcgcaaagagatagccaaattaaacaaaattgaaaatcaaaccgagttttccccaccgtcaacagctgattgatcaagacgaccaagccaagccaagcatgctgcaaccaatcggagcgcagtattatatatgcgcgttgaaattccggtgggccccaccacaatataacatcctggatgattgcacacgccacgtcatctgccagggatcatttcctgcgctctctggtgtggtgtgggccctacgtcggcacagaccaaagtgtgacagctctctctaccctcatctctccacctttgatcacttaagcttaatcacccggttttgattagtggaaaa

SEQ ID NO: 52448 - DNA, 594 bp, Oryza sativa
tttagtcaaatatgtattgcaaaagtttgggctgcacatacacggttactaatttttactaatcagtaaaatctaataatattgatatgaattccatatttaacatccatcctaatgcagcaaatcatttaaagtataattttcaaggcaatcagacaaatatcctagtctaggtttgaattgtttgatcatgtcaaggtttttctactatcatactatatacatgggatacatggcccaaaacttcataaacatgaatactatgattgcggtcattatccaactgttttttattggctatcctttctgatgtgtcaagcagtccaaaatatataattagaatactaaatagaatacaaatttaaccataactgaattcaaaagcacatatttaacccatgatgtttgtgctacaaataaaccttcttcgtacctcccacggacaacaggtgtttccaaccaattattcacatcttataatcatggccatatcacacttatctcaatacacaagaacccacagccagtttactggagtaaatagccacaaccctgcaagttactcggtctagtacgatccataatagggaggca

SEQ ID NO: 52449 - DNA, 1501 bp, Oryza sativa
gcacaccctacccctatgagcaccttcggaagactgggctggcatatcttgagattgacgaagtcaccacaggcgcctcgctgtcgacgggtacgttgcctaccactgaaagaataattagccgtaaatgcgagcacccgtatcaaatctaggatttaaacccgggtgggctggtccaccacaaggaacctaaccagttgagctatgctcactttgctaacgctgccgactttaaacaatggccggtctagtcaccacccaactgactacttcgtccaattctctatcatgtattcctagataaaaacgatgcccaagcacacatacttgtagaaataccactagaattagttgcaacagtgaacagaggaagcaagataaataaagtataaagactttatctaaaatagattaggagccaacaggctcttatagtggtaaataaaataatgaaataaataaaaaagtagagttgacatattaaccgaacaagaagattgaaatgactcttccgggtcacttcattttattttacgataagagtggtcacttcttatatagtggaaattggaacacacttaaattcttcctctcatgttttcttcgattgtcgcatttcctacttgccatccaatagactcttcacaaaattcatgcgactctaacacctatagaaatttacaatatgtaaaaaaaattgcattcttcttattcatgttttcaaaatcccgcatttccaaggaggtctaatgtgactgatattgatccctagctacattgcactcactttgtccaaaataaatcaactcataggttcacatgttttcattgcatagagaaaagatcaaagtatccttcattaaaacaaaaaagcactattgatggttggtggtaagtggttttcaaaagatttaacttctttagtcctaacgcttataagaaaagagaaatcaacttattttaggacaaaatttaaattctacaaatcaacttagtcactgtttggcatattccacgttagatttaaaacttgttagttaaactgtagtagtgaattttagatttcatttaaaatatgaacaaaacaattcatctaaattttataacataatcatagatccaatccaaatccatgggttcatggagatagaaatacccaactaaaaaaatcttatatctaaagctactcacaaatattacgcacatacatgtaagctttcaacagaatattagtgaaatcaaatatatgccctagttttcgtctattaaagtatgtgttagatgacatatttacagggtatgactgtgctggatatgactgtgctgttacatgtgcaggaatgtgttcgcgtctatcatgcaatgtaaaaaaaaaacatagccatatttggggatggtgaaaagtgtgcctacaactatcttcaaaacaacgatggttacattcactcgattcgcatgtgtgctcatctctgatgtacgtccagctgtcctgctccaaatt

SEQ ID NO: 52450 - DNA, 1501 bp, Oryza sativa
acaatcgcaatatccaatcgattggattgtctgaaatgtcaaagaactttgttctatatttgattgtatgtttttgatcgaaaacttgtaatgttcaatcaaaatgctcgacattctggaaactccaatgttgcaaggaactcaactctctggttggttcaacttttaccatcagaatatccgatgtaccagaatgcccaatatttcattgaactcaagtctctctcttaattaaaatcttgcattggaaagtccaatagtgacatcggaatatccgatccgatattctttatagacatctaggatttggacttagctagcagacatataatacatatcagaatattagaccttgaagtcgggatatccaagatgggaagaaaatacatcccccctcccctcccctcccctccccaacaaccagattttgggatcacctatttaaacactggccctatccttttcttggattagttattcaattcactcaaacctgcttttggttagagcttggttctaatgttctttggatcttgagcatgggcgtgctctcactcactctctcaaatctctcttggctttcgtgcttcgattatttgtgtgtggatttgggattgaagacctagttttgtgctattctcttagatcttcagcactaggtttgattccaaggatttgttactcttgaagattgaggactctggatggttaggcatcactccctacccaccgattcatgtttggctataaggagaagtctgtgaaggcaaaatctcaccctcgcaagaaaacagataccccgagtagagatggagtgcatttgtgcaaccttgcaatggaagggttggaaaagacccggctcattgtgagctcctcaatggagagtagaatcccctcaaggatttgaactttgggaaataatcgttgtggagaaatattatatgtctcccataaaactttgttaaatggaatattgtcttgaatttaatgggcaacaaaaatcatctcttgaaatgctattgttagaaatagttttggatggatgttgagatggattaggcatggtaatcatgtttgatctactcccaaaccatctcaactagctccgccacgatgagtttatttgaaataatgcaatatcagaaaaccacctattaacaaacaaccattattccctcttttattctctccttggtttcacaccttaaatcatgcatgtctagattactagtttattccatccatttgcttagtgagtaccacacattcgatgtatgtgttatgttcaatttctactattattaatatgacatctaaagttttaatgttttgacttcaaattctatttgttatgttgttagtgctatgcaaccatctcgttagttatcatcctattagaactgaaattatccaagaagtgggccttttgagtcttttttttttgcacttttttcgattcaattgtgcatgtcataatttggaaacaaatccctaaagttaa

SEQ ID NO: 52451 - DNA, 1501 bp, Oryza sativa
tgctggcactaggccactagctaagtagctagctagctagctagtagcagtggtagctgaagaggaggagctagttgatcagctgagctgagctagaggtagaagaagaagatggacaccattgaggagtgcagtgtggacgatggacgccggctgatgctgctggggtcgaggatactggtcggcgtgcccaacaactcccggggatgctccgagctgctctcgtgggcgatccgcgtcgtcgcgaggcccaacgattcggttgtcgccgtccatgttcttggtacgcacttgaattaatctttctttcctgtgtttgactgtgtgtttgtgatttgagttgttcttctcctttctttttgtttgcattgattgattgtttgattgttaattgcttgattggtttgttggttatggttgtggtgattgatgttgtgggttgtggcaggagggagggggaggaagaacaggctgcagaaggcgaacgcgtttgtgatctacagctcggggagtttgtggagacttgtgaggctaaacaggtgagatttgattgaaatcaaagcgaatgcagtttggtttggatttattgagttgtatgcactgaccagttcaacccaaaagcctacactgataaggaaagacagacaattcactttatattctaacaggattgtgttctcttttttatttgttcatgcataggcggtcagtttctggtgaattattttttggtgcattggctatgcaaagatggtactagtgttctgttctttcttttctcggtttatattaatcttgaatacttttctttctgttggcatttcaaaaagaaaatcttttcttcttcttttatgttgatcttggattccttttctttttggcgaacacattgcagtgggaacttgaaagcaaagtctgtgatcattagtgttagtttggtgcccctctctgtcaggtttgtcatgtctcttgtcagctgttagtgttaggtgaagttgtgactacagtctagtacaggtcatgattagcactgtgctctgagtctatctcttctctctctctctgattttgttttttgaaaaacaatctagtttcaattttctctgtctctgatttttcttcatgtagttgtcaagtcttatcagttggaattttgggaagatgtactatcatttgaacttgtaggattacttttgagtgaagctgaaactaagggttacagttatactgaatactgaatttttggtcgtactaattatctgaatccctatcattttggtttaccttttatttatgctgtcaggtaaatttggaggccaaggtggtttgcagcccaagcatttggagagcacttacccaggaagctacattgactgatgcaaacttcctcattgttgggagatcaggaaatgcatatcgtaggtaatctcaggaagctgcttctttgttcagaaaatgaacttggattttcttttagttgatactctcattaacgtaatca

SEQ ID NO: 52452 - DNA, 1501 bp, Oryza sativa
tttagggagaagattttgaagatatggttcgaatttatctttttatggatgaacataaaaagatcacattttcctgtaaattattcatgagaaaatttggtgctgttgagccaagcatatatcatgtgcactaataaacagctcatttgtaagtatgtctccaaacaggcgctgacaagtagatccacttttcgccaaaatattcatgcacattttaggaggaatgaataattttgtatgtagtaaaatcgtacagcaaaaaataaataaatggtgacaatcttcagaaccatacacacgtaggactgaaatagtttcatcgtaaaggatgtaatgtgagaccattataaccaggtcagaaacaacatgaatgtgtacaaattatggaataaatggtaaatgtgtcacattatgcccagggttgtctctgggcatagctaaaaacagaatgaacattctgtaaattggagaatgggatttatgcaggcaaagttgtgcaagaactgcaaatacacaggtttgaagttgcatccgaaaagagtgctgctccacatcagagatatacatatttcacttcagcaataccgacttatctataaatcctccaaaaaacatttttgaattggaaatataaataaatcaggaaaaatcctataaatgttataaccatggttctacgtcctctactatgtggcatcaaaccataaataaacaagggtcaaatttatatgaattctggcacttcaaaacaatcagataactaaaaagagagagaaaattattcttttatattttattgcaattggaacgaagtggagcattccaccagagaaccgaataactgaatattcccaacaaggattcctgataaggaaaacattccaccggcccaaaacagataactcctgcatgcgtcatgccatcaccacccaaaaacctaaacaaaccaccatgatcaggcaccaccctcaatgctcaaaacccattgattaaaagaaagctgcagtcatcatgctattattaataagaaatgacataggatttgttatcttagcaatgataattgcaccatgaaaactacaggtgaacaactatatacaagctacctttgcaatacattaatccgctataattcgatgaaggagatgaggatctaccattggaaagtagaacgggatcgccgaattctgccatgaatgttgactgcaactatgacactttttttttttagataatgggaatttataaaaccacaataactatgacgcataacataattctgcaactacgacttgtaagatagcatcaataattcatcatttcattagcaaacagtataaaatgaccgcagaaactaaattgacctctaattcattcatggaaatggaattttacccaatgaaaacctacatcatcagttaaaaacgactacggatcatcaccgtcgaatttggattgcgagttatgtgatgacacacaattgtttgtgctagtacaactc

SEQ ID NO: 52453 - DNA, 1501 bp, Oryza sativa
  unsure (1)..(1501): unsure at all n locations
actgaaccatagaaattaactacatgagttatcttacaaaagtcacaatgcattaataataatccccctaattttaaccgatggaatttggaattccacccaccgaaaacccgcatcagcagttaaaaatagtgatgcgggtttccaccacggaatcagaaagcgacggcgaagaagacgacgacatgaacaccatgcgccaccattagcatgacggcgagattatgacatgttgcccttttcttaatgtttgtcttaagacgggcaaacgccattgccgttgccgcgttggcgcccattgggagaggggtttctggaactttctagaaggttggcacgacgccgtaggccgcggtggcagcggtggtgctgtccatgtagaaccctacgccgtcggcgcggccgtcgtcggagaaggagagccagaacttggcctccttcgtggcggcggcgccggcgccgccggcgccgctgactccggcggcggccgtgctgtcgtcgtccgatgacgaggaggcggcggcggtggtggcgcgcttgacgaagcggcccttgatcctcggccgcgcctcggcgtaggccttgcgtgaggcgtagcggatggtcttctggaacttgcggttcttgcgcttctcccggtagcgcctcaccctctcctccctcgccgccgccgccgcggcgaccgcgccggccgccgaggtcgggacgacgacggagtcggccggtgaccacggcgtcaacgcggcgagctggcctgggtgcaagccccagcgncggcgcggcggcgccgtcgaacgacgacgcgaggccgccgccgccgcaggacatgatgtcgacgtcggagagcaggtcaaagaggctcctttcggcgccgccgcngccgccgccgccggcgctgtcgttggtgaagctcgacgagctgtcgttggggctcccctgcccctgcccctgcaccgccgcccccgccgccgcggcggcagcccatgacgaggcggcgtcgtcgtcgggcgcgaacaggtggtcgtacaccccggagctcgccgccgccatggcgaccgcgagcggcacgcggtcgtggcgcgacgccagcgggttggccgcgtgcaccgcggcgtcgcacggcacgcagagcgccgccgcgtccgccgcgcagtacaccgtcgccgcgccgccgcacaccccgcacgccgcgccgccgcagctggccgggctcgcgctgccgtcgcttgccatcatctcctcaacaagatcttgcttgcttagttagcttggctaattaatggcttaatcttaagctaattttaagcttgagcttgagatcaagtggcttaagctaagctaaattgtgtgtgtttgtgagtgggagtgagggtgctgagctgtataaatagggggaagaagagacgccaagagaggttaaggggaaggtggagttggtgaagtgcctaagaggacacgtggagcgctaatggccaagagaaacttggcatgagagagagga

SEQ ID NO: 52454 - DNA, 323 bp, Oryza sativa
agtgctatattttctacctaatgagtgtaaatatagtgtgatttatgtataaacaaattttagtttatttgttgaaattacaatgatgttcgatatggcacgttagtccgccatagctaaattttaacgctgggtccgccactgactgccaatacacgtagccaaaatgtttcgcatatttgatatgtccatatgttaaatgtctttacataatataaattacatcaaatagattgtgcttatatttccaacggttataataatcactacaagccaccctcttaaaactcatttttattattggtttccactgcatttaaagg

SEQ ID NO: 52455 - DNA, 1501 bp, Oryza sativa
ataaaaatggccttgatcagggtaattgtaacaaagcagatggacagagcataaaagcaaatgaggggattgtggtgtcaccttgtgaccggtgccagcaggcttcgcgctgttcaccagcactctagcaacccatctgtaaatgagttcagagacttcagaacaaaccaacagaacacccactgcaagacctttccatcatagaattagacaacgtcacatcacattcgtgtcaaacactaagctgttatcaagcaaaatcaacactgatctagtaggcatttttttattgattttgcagggattcgaacctggcacaaggcacagctcgaacaccattttattcaatcagatattgcttagcaacagaatttatttatttttataatcaaatactgcattcggtgaataacaatacttttctcttttcttcagtatggaaaaagacaaactagtgctgacccaacaatacccataattgaaatcaatgaaacgctcttgattgagatacataccttggtcaagaatttattcttcatacaactaatttagagaaggccaatgatgtctgcataactgtaggcattttcaaacagccctggatttcacaaaggagtggtacttctcagggagacccttcatatgttgattgtacttcccacttgaaaccagcaaaatcagtaactcagcagtggaagcttcaagggagaagtcatttttatcaattttggacagataaacaccagccctgcctatctcccctttctgaagtaactttctgacgatgcaattaagcatacgggagttaggaacacagccattcttctccattgaaagaaatagattatcagactcttcgagcaagccatcttctatgagattttcaatcattaaggtataggtcacaacatccggtgctaaaccatttgccgagagagcagcaaacaaatcctttgattcatcctttctgccacttctaagcaaggaaccaatcattatattgaaagttctagtctcaagctttacatccatcaaacatagattctgaaacatctgaagtgcctcaccagtgagattatttttgcaaagtccttgaaggactatgttgcatgtgctaatttcaagctgtattccccttttgataatcctgacatagatttctttagcagcacgagtttgtccagtctgaaataaaccttgaagaactatgttatacgtgataatattaggactaacaccattgcacaccatctgcctgaaaagagataatgcattctccatcctactaattttacagtagccattaatcaaagtgctataagtaacagtatcaggtttcaacccaactgagaccatgtcagaaagtaacttcattgcttcatccatcttacctgccaagcaatatccatcgatgagtgtactgtatgtaatgacatcaaccttcacatcaatgttagaatttcaatggttactctcattgagaagaggatggcactcgaga

SEQ ID NO: 52456 - DNA, 1501 bp, Oryza sativa
tcaagggagaagtcatttttatcaattttggacagataaacaccagccctgcctatctcccctttctgaagtaactttctgacgatgcaattaagcatacgggagttaggaacacagccattcttctccattgaaagaaatagattatcagactcttcgagcaagccatcttctatgagattttcaatcattaaggtataggtcacaacatccggtgctaaaccatttgccgagagagcagcaaacaaatcctttgattcatcctttctgccacttctaagcaaggaaccaatcattatattgaaagttctagtctcaagctttacatccatcaaacatagattctgaaacatctgaagtgcctcaccagtgagattatttttgcaaagtccttgaaggactatgttgcatgtgctaatttcaagctgtattccccttttgataatcctgacatagatttctttagcagcacgagtttgtccagtctgaaataaaccttgaagaactatgttatacgtgataatattaggactaacaccattgcacaccatctgcctgaaaagagataatgcattctccatcctactaattttacagtagccattaatcaaagtgctataagtaacagtatcaggtttcaacccaactgagaccatgtcagaaagtaacttcattgcttcatccatcttacctgccaagcaatatccatcgatgagtgtactgtatgtaatgacatcaaccttcacatcaatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggtttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctg

SEQ ID NO: 52457 - DNA, 1501 bp, Oryza sativa
cgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcatgcgcagcttgcggccgca

SEQ ID NO: 52458 - DNA, 1501 bp, Oryza sativa
gtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacgatcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgaga

SEQ ID NO: 52459 - DNA, 1501 bp, Oryza sativa
aggtgttaggtcaaatgtcatatctgatattggaccatcttttggacagttagaaaagaggttttgcaagacaaaataatagcatggtgcaatcacaaagttcacatgttggtcatgttgtgccgacattggaaaattgcctccaaatctacaactgaattggatattcccattttcagtatttttgaaatcggtgaatagaaaggctgctgattcttttgttcagatgttagtgaaagtaaacttgttaactaggggtgggcaatcggtctggaccaatagttcggtctggtccttatggtctaaagaaagttcggtcttctcaaacagaagaccgaaattgtaaatgatcaaagcatcaacatatattttgaacaaatcagatgaaactgtaaacttcaaaattgactatctcaatattaaatacccattgttttgcaaaatcatgtgggcaaactattttacatagaactatcaaaatgtgtcactttctgattgagttgattgtgccaggtgaacagtgaattcaacacaacttatctctttacgactaatttttttacactgttagttttcatgtacgagatttcagcatcacttgaacagttcgaggtttggtcttgcatgctatagtctttgtcacaaatactaattcctgatagagaccatacttctcaaagtaaaatgttatctacttatttcaaaacatcatttgcagggtcaattctgcttaattagccatcacaaagatttgaaatatatacggattgataattttaaaaaaacaacccctaagcatcatgaaaatgtaagcctctacagtaagttcattttgaattgttaacttcaaatattttacagtttgaaaaatacaaacatttctgtattatttgttgaattaacgtaaaggagatatattaaggctgcatttggcagccactatacgtttcctttgcataagaatgaaagagagatattaaggctccatttcacagccactatattaaggatccatttcacagccagtaaaagtggtggtagtgtgtgttggtgtcataaatactaaataagaaaacatgtaagttgcatcactaattttgcagaaaaaacagaaccttccaaatatagtggctctcaggagtgctgaaatatttctggcttgccaatgcaacaagagggaatcacgtagtttatatctccattgacaaccattgcatgaattgatcaacaagacaaaagttacaaaacatgtgaaattaaacaatatcaccacaaaagtcgtttcacaagggatattgtggtcgtgcgccggccaggtgagatgtgtgagtgggttttggtgtgaaggggtcaccttttggagttttggtcccttctctgtaattgtttatttcttctaaatgtaatgaagtgcagtcatcctacgttcttctacaccttatatgctgacatactcttgttaacaagtgttatcaccatattgcaacctctcaacctcctt

SEQ ID NO: 52460 - DNA, 1501 bp, Oryza sativa
ggagtaacactaaaattagaaatgtaccgaggtgcctacctaaagttcacttgggaaaaaccaggagcatattttttggagaagcgatgatgacaaattagaaaccatcgtgcacaaattaaatatacatatcattacacaatactattgcattttttaatttttgctagtacatttcacactcttcctacggtgcttgggtccaaccataaacaacaaccgcgtgagagccgcaccatgatttgcatgatgataacatgtcagctgtcgttttccccttttaatcgaggttatgtctagtgaaggcttttctgtaatcaatgattgaatcgcctgtagtattaccaataagttcaatcaagtacgtactgaatgtactaagtactccctccatccaaaaaaaagacaacatagtactaggatgtcgaatctagatatagagtatgtcctaattcgttgtactagaatgtgtcgcatcgtaatacgaggttgagttttttctaggacggagggagtatatgtcatgtcttacgattctcccctctctcactctcctgagttacagtacagatggcatgcatatcaaaggtcaaaggatatcaaagatcaagcagtcaacaagtctaccaaattactaacaagcaagtcaatgttcaatgcgtcaactcagcaacatctctagtttgaacccaaagataaacgttgatcgttgttggcgaatatgcttgagaggcaattgggaaggactccatgctgttttatccatctttttcagttttttttttctgatgaacgtattagatacatagccacaatactgatgttacagtaacctaagtatttctatagtaccatagagcatgtgagcccttggatttggatctgacagccgttggagttgtgccttgccatgaacagatttgcagtaggagcaccaagaatctgacaatggactggaaacggaaaaacaaagcacatatcaagaaggataaattggacaaatcgaacacggttgtgcagccaaaaccacacactttcttgattttttttacctctaatttagaatagcaaacagaagttgcacacgaactgctataaacacgctgcgccgacggcgaaaagtgctgaaatcaagggaaaatgaaaactcctaaaatgaagtgttttggggtttatccaacaacaacaaacaggtggcagcttaaaagttgtagatacactgcaaactgcagcagaaccaggttcagttgagaggatgaggatgctgagtgggtctggttgatatcttgtcagcatctttctcaacttcaacactcctcgtggatcaatgtaaagaacattgttaggcctcaataattgatcatttcgttacatcaagtatcatattccaatggccggcacagcactaacttgtagggccctaatatcacctgaaagttatgcggtctaacctttggattccctggggaaatgacaaatgacaaatgttacaacacgaatt

SEQ ID NO: 52461 - DNA, 1501 bp, Oryza sativa
ccaagatccaagaatctaatggaagaaatattgaagatcggtagaggaacatggccttccaactgattatctttgacattaaagtaaataagattagccattttaccaaaagattcagggatgttaccagtgaaacggttcccttcaagaacgaagtgtgtcaatgatgtgaggttacccatccagctcaaatctttgccatcaatgaagttcgtctctatgataaacttcacaagtgttgtgaggttggagaatgacttgggaacattaccagtaagattgttgtggccgacatcgaaaatggcaagctttgatgactgaccaagatcatcagggattgaacctgacaggtggttcgtgctcaagttcaatgtacgaagctttcgacaaccaccaaggctagctgggatatcaccatcgaggctgttggctgacagatcaaggacacggaggtgggtcaggttgccgagctgaggggagatggtgccgactaggccagcgccactcagacggagagtggttacgcgacctggatgccggcgattgttgcaggaaacaccagtccattggcagatgacaggtgctggcatgtttgtaccattgccagcggtgtcccaagatgacatcacctctcttgggtcatcccttatgagggatttgaatgacaagagtgctgagagatcatcaccattgatggtctgagaggtgactgtttgcaagaggagggcatgtgtgagaagagagagcatggtttccatggcagaggaaggaggttgagaggttgcaatatggtgataacacttgttaacaagagtatgtcagcatataaggtgtagaagaacgtaggatgactgcacttcattacatttagaagaaataaacaattacagagaagggaccaaaactccaaaaggtgaccccttcacaccaaaacccactcacacatctcacctggccggcgcacgaccacaatatcccttgtgaaacgacttttgtggtgatattgtttaatttcacatgttttgtaacttttgtcttgttgatcaattcatgcaatggttgtcaatggagatataaactacgtgattccctcttgttgcattggcaagccagaaatatttcagcactcctgagagccactatatttggaaggttctgttttttctgcaaaattagtgatgcaacttacatgttttcttatttagtatttatgacaccaacacacactaccaccacttttactggctgtgaaatggatccttaatatagtggctgtgaaatggagccttaatatctctctttcattcttatgcaaaggaaacgtatagtggctgccaaatgcagccttaatatatctcctttacgttaattcaacaaataatacagaaatgtttgtatttttcaaactgtaaaatatttgaagttaacaattcaaaatgaacttactgtagaggcttacattttcatgatgcttaggggttgtttttttaaaattatcaat

SEQ ID NO: 52462 - DNA, 1501 bp, Oryza sativa
tggagacagccctgtgcctcagcataggtgttaggtcaaatgtcatatctgaaattgaaccatactttggacagttagaaaagaggttttgaaagacaagataatagaatggtgcaatcacaaaattcacatgttaaactgccttcaaatctagacaactgaattggatattccctttttcagtattttgaattcggtgaatagaagggccgattcttttgttcagaggttagtgaaactaaaattgattcttttgttcggtccggtccttttggtccaaagaaagttcggtcttctcaaacaggagaccaaaactgtaaatgatcgaagcatcaatgtatattttgaactaatcagagaaaactgtaaacttcaaaattgactacgtcaattttaaataatcattgttttgcaaaaccatgcgaacaaacaatgattatttaaaatttgttcgcatggtttgttgttgaatatgtctcaatttctgattgagctgattgtgccaggtgaacagtaaattctacacaacttatatctttatgactaaattttttacagtgtcagttttcatgtacgagatttcagcatcactctccaagtaaaatgttcttgcatgctatagtctttgtcgcacatattgattcctaatagagaaagtacttctcaaagtaaaatgctatcaacttatttcaaaacatcatttgcaaggacgtcaattctacttaattagccatattaaagatttgaaatatttatggattgataagtttaaaaaacgacctctgcgcatcatgataatataagcctcatacagtaagtttattttgaactgttaacttcaaatagtttacactttgaaaaatacaaacatttctgttttatgtatttgttgttgaattaacctaaaggagagatattaaggctgcatttcactgcctctatatgtttcctttgcataagaatgaaggagagatattaaggctccatttcacagccagtaaaagtggtggtagcgtgcgttggagttcatgttcgtgtcatagctccatttcacatgtacgttgcatcactagtttccagaaataacaggccctttcaaatatattgccgctccaacaagagggagtcgcctagtttatatatctccattgacaatcattgaatgaatcaacaataaactaaagttacaaaacatgtgaaactaaaaaccaccaccacaaaaatcgtttcataagtaagggatattgttgtggtgtgccggccggctcaccttttggtcccttcttggtaattttttatgtcttcttgatgcaatgaattgcagtcatcctgcgtttccaaggaagcccacaattaccactacttgctatcaccggtacaactctattctactggtgccgatttctacaccttatatgctgacttactcttgcttacaagtgctatcaccatactacaacctctcaacctccttcctctatcatggcgatcaagtggcagc

SEQ ID NO: 52463 - DNA, 1501 bp, Oryza sativa
cctcatacggtaagttaattttgaattggtaacctcaaatattttacaatttgaaaaatacaaacatttctgttttttctgtatttggtggtgaaataatctaaaggagagatattaaggctccatcacagccactatatgtttcctttgcataataattttgaaattgcattctcaagagcttgtgaatgtttgccggtaaaaaagcaaaaaggatacgtcaatgttgaaaatgttcattgtacattaggatgcgatgtgagttactcagattaataactcttactatgtatgagataatctactgttgtttctttttttttataatagttacaagctatacacccttcattcagaaagaaatttcatgttgaaattcttgcgtcatagtttaaagatctcttgggaatagattaagggggtgtttgggaaggaactcacaaaaattttagtccctcaggaactgaagtttagtccctccttccaaaacaccacctaagataataagattttcatgtaaaagtgggacaagtggatttggcatgaaaaatttccatatcattatagttttatgagttttcacgaacttatgactagtaaaatggtgtgtgttggagctcatgtcggtgtcataaataacatataagaaaacacatgtaagtttcatcaaagtttgccgaaaaaacagctagcccctttcaaatatattgtactaagaagtctttctagcttgccactgcaacaagaggaaattgcttaaggggtgtttagatgcagaggtgtaaagttttggcgtgtcacatcggacatacggatacacatttgaagtattaaacgtagtctaataacaaaatcaaattacataatccgcctataaactgcgagacaaatttattaagcctaattaattcgctattagaaaatgtttattgtagcaccacattgtcaaatcatgacgcaattaggcttaaaagattcatctcgcaatttacacgcaaattgtgtaattggtttttttttgtccatatttaatactccatgcatgtgtccaaacgttcgatgtgacaaggtgaaaaattttagggtgtgatttaaacagggccttagtttatatatctccattgacaaccattaaatgaattaacaataatgatattacaaaacatgtgaaattaaaaaatatcaccactaaagtcgttttataagatattgtgttgtacgtcagccaggtgacatgtttgagtgggttttggtgtgaaggggtcaccttttggtccctgatttgtacgagtaattctttacttcttaatgcaatgatgcacagtcatcatgcgttttcaagaagcctcacaattacaaccacttgttatcactggtacaactctattctactggtgccgatttctacaccttatatactgacatattcatgcttacaagtgctatcactacagtacaacctctcaacctccttctactaccatggcaatcaagtggcagc

SEQ ID NO: 52464 - DNA, 1501 bp, Oryza sativa
cctaccctcacatttgtgaattaagaatacttatccattcctaaaaacagaacccatgtaaacgctgaagatggaaatggttgtcaagtaaaatggaacaaatgaaaaagagagcatgctcacttcttgtgaatgatatggaaaatgcgccggatcggtcgactggcgcccggcgcccagatcagtcgctccccaaatacgcgcacgtgtctcccccattgggccccaccacatgtctccaccacatactccattgcaacaaatcacccacatattttgaaaaccctctattaagggaactcgtttcattttttgttctacaaaaaatgtttcacctaatgtactcacaatgtttcactatgcctgccgaatgcccccttagctcgcacgcgtagctcgccgccgctgccgcacgcacgactgagagaggtgagactgtgagagtcatgcacgagtaagagagagagagagagagagagtcaaaatagggtttggaaggtattttcgccattaggaactcttgaaacattttctattttttttaaatcgaaccctaacagagtcattgaaatggggtcagatagaggcttcgtactctaaaaggagggtcaaataagcaaagttcaaaacgtagaggccaaatcagcggttaccgttcaaaacggggtcaaataagcaattgtcccataattgttcattctgtcacatcaagcatcaagtttctatataatgcccggcactaacttgtagggccctaatgtgacctgaaagttgagcggtctagccttttgaatttccagggaaaatgacaaacgacaaatgttcaagacgaattttgaagagcatgaatacattgtgacttcatctcactagacaatagcatatgacactgttgctctcagacaacagtttgtttttgttcctgttccaaataggccctacatacagggtcaatagtttatttttttctacaaaaggtacaaatgaagttacttcccctaaagtttcataaaattgtcatattcccgttaattacaatacaggattttccaaaaaaaaaaaccagggacataacacctttgactagttttatagatggttttccacccatgaacatgacatggtggatatactagtttgaaatgatgcaagctgcaatagagaccgccctgtgcctcagcattggtgattaggtgttaggtcaaatgtcataactgatattggaccatactttggacagttagaaaaaagaggttttgaaagacaaagataataccatggtgcaatcacaaagttcacatgttggtctcatgttgtacgttggaaaattgccttccaatctagacaactgaattggattttccctttttcagtatgttgatactggagaatagaagggatgattcttgttcaggggttactgaaactaaacttgttaattatgggtaggcaatcggtccagacggaaagtttggtccggtccatttggtctaaagaaagt

SEQ ID NO: 52465 - DNA, 1501 bp, Oryza sativa
cagtaggaaactatccggaatttttctccggttattctcatgtagcaattaatttttagaaggaaaacacgtatatatacacctaactttgtcatacgaaaacagatgaagacaaactttatatcaaattgtagagctcgacaagatatacgactttgttgctgacagtttattgtttgaatcatatatgggggtccaaatattcattagaaaataccatatctatttttacaaaatctcagatctacaattgaaatgacatcagatggagacgtactctggatatcaaagttatatagttcagtgaatctactactgtgtagtttatgacacttgtatttgaaaatattttaagtgtaaaacaaatattacaagtttcgaagaggtgaaatacaatgaattcaatctataaaacgagaacttgacatgtgatatagacaagtgatatagtaagtaagctatgcatgaagtaagaggtattggaactaggaagtggataatcatattaaaacgtgggtcttttaggggaatgtccatgaaaatcgattttcacatacggttgtgagacctcctaaaaaaattgatgatacaattttggagatgttgatatcttattttagaaaaataacaagcgatacctcttgcttcattaaggaatctcaattcgaggtattttttatattcagcaaatattcgttattgtactcattccgttttgtattcgttccgtatttgtattcgataatatttgattccatttccgtatccgtgtttttgatttcgattccgatttcatccctatggcacagtatacttgtgtgctggactagttactactagtcaccaattgagcctaaaagcctgggtaattaattaatccgatcatagttgattctctctctcttttctcttctgctttttttcaatgtgactgttcttttacataaatgtggctgtttatatgtccattatcatccattctaatcctttcttgtaagttgtaaggcatattttactgtactatggtgtatataacaacgaatggatcttatgattatatccatgcatagtttgaaaatgcacatcgtcgtcttcaggcctgggtgaagcctaggccagcttagctatcttcttctctgctttggtttgtcttcattgcacccaaacattttttttcttgggtaataaaatatggttgtattttttttgcccaatgattacagtcgtaaaagatttacagctgaaacattattactaatcttccaagtagcccctacataacattttttatatggattattttttgagaaacccatttttatatggattaaacggtaagatttgtaatgttatttattgtcctattattatcctaataatgatgtgatttttcatcgtaaacaactgaagattgcaaagctgcaaaccaggacaggttcaggggactgagaaagtaaaatgcaagttccggggcctacgttaaacagtggctcaaattcat

SEQ ID NO: 52466 - DNA, 1501 bp, Oryza sativa
caacaacgatagccatagctcaaagtagagatagtagcgaccaagacctcaaggtgaaggcggccacaacatggataccaatatcatgattgggatctagaggtatgccatggaggagcttaagatgacagtggtgacaacgatagtagagctcaagcagggcgaggaagcggaataaggttgattaagaagtgtcaactttttttataaaaaaatattgtcgggaaagaaataataaaaaatagagagagataaatacttattttgtctcacacatgctgaaagaaaggtgagacttaagtctttgtgaatgagttcacaaccatatgtgctcactactatatctaacaagagtttaatgaaaacatcataatcttcacaaatgaccttttttttagaagcctattggagaaaccagcccttcaagaaatttgccttcgaggcttccctaagtatttcagcttgcttggttcttgcatgtctttggagattggccaaggccaaggcccaagggactttcactgattactgatcccggctaaggcttagcctaagttctcaactcacttctcttgtttttcgcgtgttcatttttcaaactgttaaacagtgtgttttttaaaaaaagtttctataggaaagttgctttaaaaaaacatagtaatctattttcaatattttatagctaatacttacttaattatgcgttaatccatcgctccgtttacgtgcgaagggagggttcccaacaaaaaaagcacaacctaagtgagagttactccctccattcaaaaaaatgaatctaggactgaatgtgacatattctagtacaatgaatctggacagagatgtgtccatatttgtattactagaatgtgtcacatccagtactagggccctgtttagattccaacttttttcttcaaacttctaactattccgtcacatcgaactttcctacacacacaaacttccaacttttccgtcatatcattccaatttcttcaaactttcaattttgacgtggaactaaacacagtctagattagttttttatgggacggagggagtagaacattacaagggtcttcttgggatgctttgttcgttgtattctgtttgttttttgtgtgtttgctttttgacctttgttttctctgttatttgtaattgcgtcttgaacacccctcctcagcagctcccatgcatatttgagaaaaaaaaaagagagatttgcattctttctcgttcttcttccaaaagctagccagaagctgcgctgataagggccatagtaacattaatttgtcactactccctccatctaaaaaaaaaactcaaacctataagagaaggtgcaatagcgggctataagccagctataaatatattttaaagagataaaggaagagagagaagagcagcgggctacaaatctgtagccagctgtagcacgaactccaagacgtaatatgtatatgatagataggaccatgtatta

SEQ ID NO: 52467 - DNA, 1501 bp, Oryza sativa
ctgctatttatttatctcgttccactcccttggcctgcttatgagctcctagtcatcgtatctctacattgagctatagccacaatcaacattgccaccttaagctcgttgatggcaccatagcatccacctaagctttggtcactatcatcgttcctatctttagcttcttgacaacaccacctctaggtatcaatattgtcacggcctcaatctctgttgtagctacctccactttgagcttataagcgctaccgtccaattccagatcctaatcattatccatgccttgagtagccacatctctagatcaaactcctccattgctcctctagagtctagatcctagttgagttctcgttatccacttctcgaagttcgttgcaacatggtcagttggtcatcaaaatgcctccaagtgctttccattgcttcctctgccacaatgccacctccctatgtggattccattgcctaaagatttgatcacattgattgttgatttgggcgttaattgatattgatattatatgtagctattgatattgtttcacgtttcgatggctagtgtactaataaataatcagattctaagaaaaatatcttatccataataccattcaaattgcactatataaaactaatttagagctttacaatacaaaagttacgtaaaactaccgttccgaaccgataaattttcctgcgttctaaataggtcttaaaaaaaggagtttaaagaaaaaaatataacaataaaccaacacgaaatttggctacgatttacggtcaattactagttaccattccttgcaattttcaccagctagcggtactcccaaattcccccccatttcgcgctcggctccgttgcgcccgcgctccaaaaatcccgaaccggtggcgcgtactacccaacgacccgcaccacacctatcacaccgacacgcgggccccatccgtcaccaaccgacaccgacccgagccgcacccgcgcgcgggggacggacggaagcgttttgaaaaacatcgccgccgcccgcgcgccgccaccaaaaaaaggaaaaaaaaatcgcgcataaatcatttccccccccccccctccacaaccaaatctctcctcccgctcgccgaaaccctcgccgtcgccgcgccatggccgccgccgccgatgctcccccgcctcctccggaggtcgccccgcccgcgcccgcgcccgcccccgcgccggcgccatatcagccgccgcggctggcggtggccgacggagcgggaggtggcggcggcggcggcgggaagccgtgcaggcaccacgcgtacagccgcaagcagaagtcgctcggcctcctctgcaccaagtaaacagctaacaaccctccccctcccctccgcgcagcttcgcgcaaccgctatagctttctcgaggttgatttggctggccctccctggtgtgtttggtttgctagcttcgtggcgctgtacgaccgggaggacgtggagt

SEQ ID NO: 52468 - DNA, 1501 bp, Oryza sativa
tgcaaccaatcggcatcagcagtgcaaaggcagttcattccccttgttcctgactataccatcatgtaggtacagtaatttcacatgatatagacaatgagtatagagaatcaagcagggtaatgtaacactcatcaatcatcagacaaatagtattagaacatttgactagtcattgaccacaaacacatatggtaacttccaacaagaggcatttgatgtcctccgatttatggatgagacaacatatgtaatgcttgaaatgggtaaaatccattaaatcaatccgcaatagtaactaatagcagagcaatcaacaaccaactaaattccttcatcattttgttggctcagtgaagaacttgttgatagctggcatgatctcaggggtcttgtcgcgcacatagtttcttagcccatgctctgcgtagcgccttccctcctcatggttctcgagcactccagctgccctccctaccttgttaaccctgaataaaagcattttattatttcaggcttacacttcattgttgacaaaataagcatcagccgccgagggttcgaattatcaccataatcaatgttacccttgaaacccaagggtttaattatccatcaaaattcactatataagacaatggttaatacactacgacttcctgtctatgacacaataagatttaagcactaataaatcctgcttggtttaaactggaattgaattatgcttggagccggtttggagcagcgaaagattaacaccaacatgtcatgagttgaacatactaataacacataagctcatagtgaagacagattccacacacacgccgacacgaaatacattgtgtctagccatgttagcaactctttggtctatgctatcatgcccaagacgcatagaaatttacaatatacttatcatcataatcaccacgctttctgtaaaagacattcttaacgtcatgacaccgtaccaactactccacctctataaaacaaacaagaaaaaaaatatgtaaagagtacattttcccaagcaaattgacacatggcaagctcatccttatgtttctctaccagctcaggtacaggtttcttaaattgtctaataacaaaccctaattaaacaaaaaaaaaaggacacatcacacatgatatacccactccttggctccttgccccgtaaaatactaaaattcaccatcacaaaatttcacctgagaaatactagcatgtcaatcaatcaagcaaggtaagtcaacgctcagcgccaggtaataggctcaaatcgtaaagaaatcgatgacggtaagctacagtaagtccaccactagaacaggcttatcaagcacagtagatctctcctccaacgagcaaagcaaaaaataaaaataaataaaaataaaaaatcaagcaagcaagcaagcaaagagggcaggaacacgcagtggcggagatccggacctgacttcggggttgccggtgatgttgcggaaga

SEQ ID NO: 52469 - DNA, 1501 bp, Oryza sativa; identical to SEQ ID NO: 37198

SEQ ID NO: 52470 - DNA, 1501 bp, Oryza sativa
aggattagagtggtggcggttgatggaatatctaaaaactataaacaaaacccccaaatagaatcccaatgatgattaaaaggagggacgatggacgggtcattaagcagcatggtcacaacggttggcgggacttctaaaaagtaaaaaaaaaaaaccctaatgataatcatgttcgaattttaaaatctcaaagacaataaagagggggcagcgggtgagctgtacatgagtacagtggtaaagtcgctgacagtttggtggaacttctagaaagtaaaaaaagaacctaaatgataattacgtttgatttttaaaatcccaataaaaataaagagaagaggcagtggattgaccgtagagtagtatggtggcaacatttgacgagacttctgaaaattataaaaacaaaacccaaacgagacaataaactctaaaaactataaggtctaatttttagaggttttagtgagaacaaatagaagtagtggtagatcgaggaagcaaataaacgaggggtgacaaaatatttaggagtagcaactgacataacttttaaaaaatataaaattagaaacacaaggatgataaggtttggtttttcaaagtcttaagacaacgagatatctatttaacaaaattctaagtaaaactatattaaaaaatagataattttatatcggtgctagccgcgcaattgcgcgggccacccagctagttaatatgaaaaaggctccatatgacacggtcaaagagtacaatatttatctctatgtctatctttaatattacaaaaattgaaaatattttcttcggcgctttgatacgtcgtctgtgtttgatgagttagttatatgtcacacgtatccaatttgacgtgagtctagaataattattatgcacccatatcccagttcattctctctccctcctagcccaacccaaatggcccacaccatcccgcacgcctccactagacggcgctgcgtacacccttcctcgattggcttcttttttttttctctcttttttcattttctttttctccttttcttttccctcaataatcatgattctctccatctccttcttttctcttttttctcttccaaatttctctcctcacaattattttcctattgaatttatcattgttaaggtgtatgcattaagtttggtactttgcaaatgccttccatctacagtaaaaaaattttacgggaaaaaacttttactaattgaatactcaaaattttaatctttggaccatgaggtataataaaatccacatgtgtcaacttatggaataaccatccgatcaatttgtgaggctattggaaatgtgtatataagctattcttcgtgtgatgatgcatgaagagcggaaccggattcaatgttatatatgatttctaaatttgttttgctattgtttgacaaaaaaatttatcaatcgtgaaaattatcttcacctgttttaacacataaacatttttgctag

SEQ ID NO: 52471 - DNA, 198 bp, Oryza sativa
aggcgaacgcgaagccgagccccacaccgcgccacgcggcccgctccgccgcgcgacaccgcgacgccaccaccccatcatccgctccaccgcggcgagcaccgcgcgctgctgctgctgcgtccaaagtccaagctcccaaaccaaacctgcgcgtgcccaatcgatcggcgccatggccgcggccgtcgtcctcct

SEQ ID NO: 52472 - DNA, 1501 bp, Oryza sativa
catttcgatgcattattggaagtaaaataagacatgaaagttgcagataaccactgaactaaaaatttagaaccgtttttgttgacccgatgctttggtttctttcatgatttaacatagatatgtgaaatgggtgatgcttttgattgagagaacttacctgcaaacgtttggttttattcgatcttctcttgattgaactctaatttagtctgacgtttgattttattcgatcttcttttgattgaactctaatttagtctgaccagtttgttattatgcactcttccttttcattgctgatgtatgttttcttataaaaaaaaatctaaatcgcctttgtgtcttcggcagcacacgtgtcggagaaacgaagacgctggatgttgagtgggcttaggggaggcctagaatgaaaacgactgagcgtagtctcgttttcgaaaagtctctccccgttatttatacggaactgctagatgactgtcaaaaaaaaattttggccgtcaattccgctctaagatttgtgctgagatattttactattggatctaaaccctttttttacaagctagtcccatcatcgcatgtttatggtagatttgttcaagttacatctaagttatattccaattacatgctagttacatcgtagttacactataattacattataattacattgtaactacagtgtaactacattataactacattgttatctctatataaattagatataaagttatatatattattttaatacatatatataagttattattattatagtatagttctagtgaaattatatactatagttagatttgaaagttttcccctcaaaaaacactcgacattttttttagctagtctatgtcatctaattggttatggaaaaaataaagaaaaataacaagatagattaatatatgatatatcactggacgcatatgcaagttaaaaatcaactctacgagttgcaaaaacagacaaattaaactatgtctacgtttaaatttgtatttttcgttgcaacttgtagaagttaaatttgaacctgcatgtgttgtgaaaaatgatttattccatattaatctatctagttgttcataaccatttggatgatatataaataatgaaggtccaaagagatcgttttgctttactctagtgcaggtccaaagagatcgttttgttcgttgacaagttgtcctagaaaaatagctaatattttattaatcatacgctaatgagtcactatgttttgcatgcggaaggtatctattagttcccaactcagtttgccaacacaatctaaaatatgtttgcgttttccaaaaagaattgtactattttaagtttgtaatctagttattatagaaatcatttgcacgcaacacatggatagctaaaaaataggtatacatacagaaataaaagatagcatgattcctcttatggaccctacgaaacaatattacccactgtagcacgtttc

SEQ ID NO: 52473 - DNA, 1501 bp, Oryza sativa
catatagttgaatttacatcccctagttacgccttcttaattcgtataatctaaatcgcgatagggctatcgcgcgacgcgcacatctggtgattctgcgctcgctaaaccagggcccccgcgcgcgccatcgctaaaaaaggaaagagcgcgcttgcgcgcgcaagcaccgtgcaacgcctcgctagctggcgtgggccccacctaaaacagcgcaatgcgcctctctccctcactccaacccatccggtgacatcaatccacacacagccgccacggcggtaaaaatcagaaaaaaatcgccatcttggaagaggggaaggaggagaagaaaatccaagaaaaaatatctaggtaaagtacacatgaagttcaaattccgtcttctttgagatccatccacaaaaaaaaaagaactaacctagaaacttttagatcttctctgtattcttcgagaaacaaattgatatgaatctgtgctgtaattttgtgagtaatgagctgtactcttgttttctgtcttccttcttgatttctgtcttcctttataccccaaattcactttctagtgctactgagaaaaaaaagttatagagaaggcatgagtcctggtgtttcaaaaaactcagagcaatttctagtaacatgcaacttacttccatataaacttgaattcacaaaccctagtttacagtttacacagcatgaaaacatcccatctagttacctctcagtgcaatatgaacagaaaagttactttacttcccaaaataaatttgaatttgtattccctaattacataggcatgagtgctggtgttggaaatctcatagcaattttaacagaagtctcagtgcatttttaacagaaaagttacttctaacacttcaatgagttacttccaagaaacattaagttacttctcactgcgcattaagttacttctcactgtgcattaggttctcatagcaattttaacagtctcagtgcagttttaacagaaagttacttgtaacaattcaattagttacttcctagaaacatggaagttacttccctataaacttgaatctacatttcctagttacaaattttgtaccttgtttctatatacagcatgatgcatcacctagttgcgtctcaatttcatcttgtactgcatcaaaacaaattgtgaaaaaaaaaatcattagtatagccactggtcttaatttgagaaaattgcttcctataaaacatctaaaaaagacatgctgcaaaaactaaaagttacttcttccccccccccaaattactgaattacctcaatgaatgctctgtataaactaactttgttactaatagcctgaaacacatgcagcaaaaatggactttgacctcaacagtatcccagaattagtttctggtgaaaatgaacctccagtacaccatttactagttgatgataaagacaaaagtgaaacatacttccctataaatccgactgacactagcatggaga

SEQ ID NO: 52474 - DNA, 1501 bp, Oryza sativa; identical to SEQ ID NO: 37201

SEQ ID NO: 52475 - DNA, 729 bp, Oryza sativa
atcagattatgagaacaagaagcaattcgtggtttctcgagtataaacgaggtatatgatgacatttgcaagaatggagggagaaccaagtcaagaaggaataggtacaatcacatattttttactatacacagtacttttttactttttagtaaaatgatctttgtagaactaacttcacttctcagagaagtaaaattatataagtaacttcaccatccattgaagcaactgcattttggttcataccttccattttttgttgtgtgcatattggttctacacacgactgagcaattttttccagacaaactttctacacacccctgtgcagtaactttacatgtcatagaaagtaacttaacatgtcactgaaagtaacttaacatgtcattgaaattaatttaacatgctacagtagttgtacaaggtatactaatttgcttatttatttttttttctttttgcttttgttaaatgtagccaaaagatcattgatacaggagaatattatatttatcttagcgatcttgcgaactctgtcaaacctatgggctcactggacaataacacatgtgaattggcattaattgttctgtctgctgatatcaaggacaattcgaagagaatttttcctgccagaataggagtgagtatataaaatttacaaaaatctctttttaatgtattattactatcattgcaacaccttatgtttttttttccaca

SEQ ID NO: 52476 - DNA, 1501 bp, Oryza sativa
cgccgttaactttttctcacatgtttgaccattcgtcttttttaaaaattttatacaaatgtataagatataaatcatacttaaaatactatgagtaataaaacaactcataacaaaataaattataattacgtaaattttttgaataagatgaatggtcaaacatgtgaaaaaaagtcaacggcgttatctattaaaaaacaaaacggaggtagtacattcttacgggttatttagatcagggtgtaaagtttttatgtgtcacatcaggtattatataggtgtcgtatagggtattctgcactaacgaaaaaactaattatagtatccatcactaaaccgcgagacttaagcctaattaatccgtcattagcagatgtttaatgtagcaccatattgtcaaatcatggagcaattatgtttaaaagtcatcttgcaaagtagtagcaatatgtgcaattagttatttttttagcatatatttaatacttcatacatgtgttcaaacgttcgatgtgatggggtgtaaaattggatctaacacacccttattagtattttatcatgccaaaacttgaacctttcgggtgcctagaaactggcagcttccattcattcctatatacctttcgatatttttttctaacatttttttcctgctctacttaatggaattggcgcgaaccgattcgttaatgaaaaatctagcatgtctgtgttggaatataaatttacgatctcaatgatttagcttatacataatcacctatgcttcaatacccacataatatgccatcgatgttaattattctcctttagtttcttccttctcttattcttctgtttcttttcttcttatgcgccaatgtaaaatttcaccgagatcgcctcacaaaccttttctagttggtcgggcaatttagggttttgaagtttagatagagaatttggcgtcccttctcctttgtgttcaacttctattttatagacgctggaggggctctagggtttatctcgaatacagttttagagattagttttaccgatcacaaaattaactctatcacatattcaattttattagaaacagataaaggggatttatcccttctttagttaaccggcatttagccgataaaaccaaccaactgtcttatcatccaaagagtgatggttctaccttgctgtttgtactttcaataaaaaaatcggcacaagttgcacggacagtttctggcggctcgttggcgacgactcgacaagtgatactagaaaacgaaataattaactttttgccacttttacgagtggttcaaaagaatttggctctgaatccatatgttataggcacataaggaaccacatgttataaaagtagcaaattattaattggcatattttaaaaatggcaaataattaaatgtaccctgtaaaaccggtgcatcggcatcggcctctcccgtctccaatttggccaagtggcgagcgtccagctaatcac

SEQ ID NO: 52477 - DNA, 1501 bp, Oryza sativa
gatttgattaagcgggatgatttgtgtcggattcgcgacacgagcgcttagaagggagcgaaacgctttgtgcgcttgcgcaaaatgtgcagtgtttttctcgatccggagtagacatattaagggaagtgctatgatagatgtgactactatctttaaatttatctattttattcactcatgaaccaagaggcaacctatacaatgtatcacctctagttcacaaataccaaaatatctaatattctcacatctttcttgaaatttgtgtggagattgtatcttgatttaggggtggctcatcatctctcttttcacttctcttctccacctcatcacttaatccaatgtatgtgacacttttaggagcaacatatagagcattatagtacttgcccttataatcctacgaaacagtttttatccagatgcatagtaaaggatatgtttcttccgattatacgttgctatattatggaatgatggagtagcagactataagctagatatatagagaaaaaatgagagagaaaaacattagttacaaatttgtaacgagcatataaactttaaaacgatatatgtgtacgagaggtaagaccagtattgagaggtgatgctctgaatttctagcgggcatgcacgaagaatgggttacgacataccccctatgtgaaaaaaggaataaacttttaccatacataaaagataaaagttgccttttttttaagagtagtacatgccctgagatctacaagattagcgcatattttcgaagtttgaaaccaataagttaaaattttagtctaagttaagattatagtatttatatggtaaaacaagtcaaaaaaaatataacatttatatatactttttgtaaataagatgaagagtatatttcactttgtttcactttttattactggtgttttattttgaaccaaactttaaatagaccgggtaattttactttcgtggtactttactattttagactactctcgattttttttatccatttgaattcaatttaccatatgtcaaagaaacagtctacgtaaaactgcgggagtttattgacaaatagaagatggcgtacccaaaatcgttcatatgcttaagaaaagagtttgggtgattcaaaataaaacaaagataaaattatcgagtctaaactgaaaacattggtaaaatggtggtttaaattaaaacacggcaataaaaaattatctaagattaaatttatcctaagacgaatgatcaaacgtcatgtcaaactttttttagggcattgtgtactaaaacaggaagtaccaagacaactgtgtttagttcacactgaaattagaagtttggttgaaattgaaatgatgtaatggtaaagttagaagtttgtgtgtgtagaaaagttttgatgtgatggaaaagttggaagtttgaagaaaaactttggaactaagggcccctttgaatcgcaggatagaaaaaacggaggaatagg

SEQ ID NO: 52478 - DNA, 898 bp, Oryza sativa
aaacggagggagtatatcccagaatatatcagcaatcctaactaatcttgtattccatgatgcagtcatttggtgtggacaggaaggtggtgagaactgtacttccctagggtagccgacggccaccagaatcttggctgccttgtgctgtagttacatatacaagaggagaaataattaataatacaggtcaaggcatccttagtgttaatcttcctttttctgtcactaaataaattatgtataggtgaatcaactgccggaattaatcctgtcatttcatcgtcttgtgtgattcacaactgcgagtgcgaccttcggcaatatgcagacgtaatattcccttgggggggtcatgaaaattgtcaatgctcaggtgaatgttggcgttgtgcacttgtgcttatatgttgacccgctgttttgatgcatctccatgaagttctcaagctaggatgcgtttccctggtactgtatactcgagctatacgtggactaagggatctaaagtaaactcattcctcatctagcattgcagcgttgggaatgggcctcccaaccatatgagctaaatagcaggccgagaattcacggcccacgtcgtgcgcagcccatcaatctcgcgctgcagcggcaacggccttcttgtgcttggtgcagcgacacgacaaacgtcgtggaatcgcatcgcaaatcgcaagacgacgaacgaggagcttagctaacgggcggcaggatcagcgatgtagtagccgttggtgagcgacagctaatagccctagctagccagccaccgtcgtctgccattccgccgttcaaatcagtacagtactatacttctcctaaccgaagaagaagaagaagaagaaggcgtcgtacggcgagagagatcgagagg

SEQ ID NO: 52479 - DNA, 1501 bp, Oryza sativa
gtctatactgctttctatgagttctcttcgctgatagaatcgaaggtaaggaccatgatctttgctaccatgaatgtagggtggctgtcgctcatttcttccatatagataataagacactcaaatatttcattttttacaatagattgctatccatcaattgtattgcacaaaaatcttcactcagtataattattttttgttaatatgtaaacatttcttttgaacttgttctttgagccacttttgcattaaatgttgtgttgatttaaggatcatgaaattattttagtcttcagcagaatgttctaaacagcaaatataggatgtgcactgttatttctggccttcaaaggctaccttagttgtcctgctcaagagtgtatgatgttttacccacatgtccagattgataataatgatccaaatgcttccctaacgcggaaacgtgttgatgcgataaagagaacctgcaagtcatcttgctcactaaagagaaggtttgttggttgattctgatttagtgttccatttatttctgttggcatttctcatccctaccgatcatcttaattatgcaggggatacgatttggagaagtcaaagtacaactccatgctggtgagaataatatataaaccttaaatccttttagtgattctgtttctatttatctttctcaaactgtttctgtgacttgctcagataatggttgtacttctgttggtggctattgttttgggcatgatatatgccaagtgattcgtcctaggtggtccattgccctcaactagacaatctatgcgcatcaggtatgtcaaatggtttcaacaattttacctgttctatttcgttttaaaatttgaaacagggaagggcctgctgcatttgatcatgaagtgaatttgatatccagatttattatcagcgccaactccaaagcacatgcagcaattataagtactgactgactgcaagaatagactgtacttctatgaagttggatctcttcacctatctgttcaccctaaaccttttcatggtttataagaatgcgggttgtttcttgcaaaattttgggtagaatggggcaaaaaagaatttgttcgataatgaagatagctgtggttttgttagcttgtgttatattgatgtaatttaagatcatgcgagtgtttattttcccggcgacattcttttgtttattcattatatgcagtatccatttatcttggctctcacctgcctgatgaaaaacatgtatgtttatccataccatatgtaacaccgtcgaatgttaatcacttctgcgtaacaatgcaaatgtgccaaaactagtatagaagtattccggtcaaaaatgaaagaacattaataaacaaaagaaaaaaaacatctggccagtaatgcctcgtccgaaactagtaaactacgcgaaacaatcaactgaaaaggacaggtgaatcagccaaccaagactattgccagtaaacgagaaagc

SEQ ID NO: 52480 - DNA, 1501 bp, Oryza sativa
ggcaacacagtacgctggggctaatttactagtgtgcttgagagaagtataaaggataagattggaaagatacagaaaatgaagtggggtattagtacgcaattaattaagtattaattattttaaaactaaaatgaattactattatatttacagcaatttttctaactttttaagaaaatatttttaataaatttaggaagcgtgcgtgtagaaaataagagacttttcttccagatgtgcttgtctcaaacgcagtgtataaggaagattatgttttgcgttgttctgtactgatggtggtacaatactagataaatgcattcctctcaacatctattgaagataatagtttttgtaacttagagggtgtttagattgagagatgtaaaattttatcgtgtcacatcaggtattatataggatgtcgcagaggtgttcgggtactgataaaaaaactaaatacataatccgtcagtaaaccgcgatagcaagcctaattaatctatcattagcaaatgtttactgtaacaccacattatcaaatcatggagtaattaggcttaaaagattcgtctcgtaaattagtcgcaatctgtgtaattagttattttttagtctatatttaatatttcatgcaatgttcaaacgttcgacgccatagggtgtaaaatttttgggtgtgatctaaacacccccttagaccattcccaacccaaaacactagatatagtttccataaactccacatcatcaagaaactagtactagacactaatcttccaatgcaaacaccactagtccatacttaaatttaatgttgcttatctcacatgatgtcttagatgttgtgtagaaactgtctcatgcaagatatggtttttttctctttgctcatttattcacttgccacattattttttaggcaaaatttaccacaggacatgcaaaaaacgtgtaattggctaaaagacaccgtgaaaacatgacatggccgatggacctaaaaaaacatgtaattggttgcaggacaccggtcacatttttttattatttccagatcaaaagaggtgagatatttttctacatgcctgacttgccccttctctttccttctttaaacaccggtgggtcccatgtgtcatggacagtgtatgtttaatctaatttttaataggtttttaaccaccaggccccacgcgtcatggactaatttgttcctaattagtagggtgattactatttactaaccataagtggggcccacatctctctcctatcctccttcttcctcacgcacgtggcggagcagaggaacagcgcgcggccggccgacggcctgagctgggacggctcggcatgcggcgaaaaaagcggcggcgctccgccggggtatcactgccggcgacggcgaggaccaacgccgggatctcctcattcagcgaggaccaacgccatggtgacgagcagcgccgggatctcctcgttcagtgaggaccaa

SEQ ID NO: 52481 - DNA, 399 bp, Oryza sativa
ctacctccgtcccaaaatacttgtcgttctacgttatttggcatgtactaaggtttgaagacaaagactataataccccttaattaataatgcatagttggatgtggaatgatggttgggggtataatggggagaaatttgaattggaagtggttgatatgacaagtagtattttaaagtgacaactattttgggacaagtattcgggacggaggaagtagctttaaatttattcgaaatgattaaattgtcaccacaattgacaagagatgccatttgaagtgttaaatccaactgtcaataaccaaataatataaattcatttattatgctggaaagtccactacagttttatctattttctgtgtgtaataatacacatttttttataaaatcagg

SEQ ID NO: 52482 - DNA, 1501 bp, Oryza sativa; identical to SEQ ID NO: 37207

SEQ ID NO: 52483 - DNA, 1501 bp, Oryza sativa
ccgccacggccgcaaccgacgtcgacaacagccgcctcgccacggcgcggctccacggcagccgaggcggcgggacgcgggcggcggcggcggcggcggcggcgtcgcggaggtggagcgcggggcgcgcggggcgcgcggcggggaggaggaggagggagagggcatccatggctactcgcgtggtgggggaggggggcgcgagcggcccgcaacgaacttgtggcgcgcgcgcgcgcggttacgttgggtggggcccggcacaaacttatcggcgccgcaggtgattagctggacgctcgccacttggccaaattggagacgggagaggccgatgccgatgcaccggttttacagggtacatttaattatttgccatttttaaaatatgccaattaataatttgctacttttataacatgtggttccttatgtgcctataacatatggattcagagccaaattcttttgaaccactcgtaaaagtggcaaaaagttaattatttcgttttctagtatcacttgtcgagtcgtcgccaacgagccgccagaaactgtccgtgcaacttgtgccgatttttttattgaaagtacaaacagcaaggtagaaccatcactctttggatgataagacagttggttggttttatcggctaaatgccggttaactaaagaagggataaatcccctttatctgtttctaataaaattgaatatgtgatagagttaattttgtgatcggtaaaactaatctctaaaactgtattcgagataaaccctagagcccctccagcgtctataaaatagaagttgaacacaaaggagaagggacgccaaattctctatctaaacttcaaaaccctaaattgcccgaccaactagaaaaggtttgtgaggcgatctcggtgaaattttacattggcgcataagaagaaaagaaacagaagaataagagaaggaagaaactaaaggagaataattaacatcgatggcatattatgtgggtattgaagcataggtgattatgtataagctaaatcattgagatcgtaaatttatattccaacacagacatgctagatttttcattaacgaatcggttcgcgccaattccattaagtagagcaggaaaaaaatgttagaaaaaaatatcgaaaggtatataggaatgaatggaagctgccagtttctaggcacccgaaaggttcaagttttggcatgataaaatactaataagggtgtgttagatccaattttacaccccatcacatcgaacgtttgaacacatgtatgaagtattaaatatatgctaaaaaaataactaattgcacatattgctactactttgcaagatgacttttaaacataattgctccatgatttgacaatatggtgctacattaaacatctgctaatgacggattaattaggcttaagtctcgcggtttagtgatggatactataattagttttttcgttagtgcagaataccctatacgac

SEQ ID NO: 52484 - DNA, 295 bp, Oryza sativa
tttaaccactcactattactgtcagtttacatgctatgtgagtataacggtagaaggaataactttttttacggggaggtaacatgaatatcttgtatgatccgtgacattcatatatctgaaaaatggtagcatctaggaaacttcacaatgtgcagttacttcatagattgaattttcccttgaagcgttcatactcatctactatagagagaacaccacatgcattcttctttgatgttttcatgctttccaattttatgctgcagaattctgactgttttctgaattcaga

SEQ ID NO: 52485 - DNA, 1501 bp, Oryza sativa
aaaagctgtttttgtaaaggaatacattaaaatcaagaactattaattttagaagtatttgtaagttaaatgtgcccaccaaaacaaaatgataatcagccatgttgatgcttaaactactcttaccgtgacagtttcaacagaataataaccacgatccacgtaatctcccataaacaagtagtttgtatctgggcactggtaaagtgaagagaaagcataaatatatttgaagtttgatggactcaagatatgcaaaggggacaacgaacaggaaaatacaactgatacctttccaccgattcggaacagttctgcaaggtcatgaaactgcccatgaatatcaccacatattgtaacaggactctttacaggctgcagaagcatggcaaagaaaatgttaaattatcaacaaaagaattcataatttattatatgggaggcacataaccatctcaaggaatcactgtaagttaaaagtatacaaaataaagctgctttaactttcgtttgcacggcagtttcaaaacaaaacaaaacctgtaaggctataccatgcaacacataatacagaacaaaaccaaatataagtacttctgtcaatattatggatttacataaattcagaacaagaaactagaataaaattttccgaggagacatgcatatacatgatctgaagactaaatccttgtgtggttcaacctgggtttcgtctcaagactaccccaacttcctctagattacccgcaacttattttgctattgttgttctattctttaattattatattttgtaaccaagtttgatgtacaatttaatttttttttcgtttctggttgacttacaaaagaatttgatcctagatgaatatttctagtgatctgagcaaagatccatgacaaatttaagagattaatgaagtgtgattgttgcactgccaacatgaaatattcatccttgtcaaagacaaaccatgctcataggttcccattacttcaaagactatagaagctaattcgtcagtcaaatagtaccatcatttcatgcaagtgatccaagaaaacaagctggagtattgcacatttagacaaactaaattttggaagttttccatgcaaggtattgtaacagatgacaccatcacagcatagaagactagtctggtagagatgaccttagtctcaaaagccataagaatataagatattgttggctttttcattgagttttcatgagaaatagatctgatgttttcccttaactattaccacctaaattatactgcgatgaacaaaagcaggcccaaaaatgagatcctggctaatcctagcgaatcaagaaagacatcatagagctgtaaaatatcatacttgaacgttgctctcctccatcaatatctcttttgccttctcgcaaagtgctctgacctgtacgaaaaatactcaagaatgagagcaaatctatggtggctcactaattaaccagaaagaatttaat

SEQ ID NO: 52486 - DNA, 1501 bp, Oryza sativa
tagtttagcgtggtttaggtggtggcccatagtatacaacgtcatacaaaaagcttccgtacccgggccgcttccggatccggcccataccgggcccatcaacggggccaccgtcatagagcgcgcaagaggcgtgacgtgtcccgtcgcgtcgcgggccaagtcagatatttccggtgcgcggtgcgcccacctcgctcgtataaagccctcccctagttgcccctcttcgaactttcggcatccgctgctgttttctcttccgctttttcctctctctctcgcctcgcctctgcttcctcctcccgttcgtctcccctacctacctagggtttctcgccgcctcgcatcccctcctcctcctcggctggttcgcctcctactctacgcttgctgctgcaggtgagcatccccccgatcccgtctattcgtcttcgcgcgcgcgcttccgctgccgatttgctcgatccagttcgttttgacgggcgattgctcttgtttttgggaggaattccggttgtttttttgtttcgagggcgtttgcttggagttggcggtgtcggcggtgctgcttgcttgttgaatctattggtgaggtgttttgagatttggagctgcttccgctaggttgcatgcgggctatgtagatttggtcgattcgtagggtttccgcggggggattggccgcggattggaaaggaatcacggtttagggtagggttctcccgcttaatcgtgtgggagacgtacctcgtttcgtggcttcgattcacgagtttatatggggtttccccgcttgcatgctgctcttatcgtcgtatctgagatgattgcgttagtttggtgtgattgctgcccgttggtactgtttttgtgttgaatacgttttctaaccgatgagatctactggttaatgttaatgcaagtgtagtcaatttactttgtgctgtaagtagattatgattccctgtccacattactagttggagattggttttggtgctgtttactgagtaatttgcttagcatagttgtagctaccagagctcttagcaaaaatctgccaatgctacgaaatatgataattcccactcggctctttgcctctgttagctttagtgcttctttattgtggattttaagcttcattttaatttctggatgatgtttatagagacataatttggattgtttcatatatgttttcatacaatctccagtaatttgactgcagttacatgttgtgttagccttatttgtttgccacttaccaaaggcttaccaaaggattgacaagaaaaaaaattgatagttgttcatttagttgatattctgtattgttgccgctgaagcacctttcttttttgttcccagatgtcacattatgtttgtattgacttgctttatgtatctgttatctccaggtacaagcgataagcagtagcttcttcatcaaaggttttgtgcaaaattatgcgatcttcatgggctgattcagttg

SEQ ID NO: 52487 - DNA, 783 bp, Oryza sativa
gaaaacctagctgcatccccgctcatcatcgttgccatcgtcaccaccacaactcgtcgtcgtcgttgcctctctccgtggtctccactgcccctccaccgccggatccggacgggggaggggcaccgctgctaggggagcgtgtggccgcgctgccgccgcccgccaccgctcccggccaccgcgctgtcgcttgctatcgctcccggccgccgtgctggcgttgcccgtcgccgccgtggcgtgctgcgcctgctcccatccgccgagctgctcgcgccaccccgcgcctgaagtggcacccaccgagcccaccgcccccgtgcgccaccaccatcgtgcaccgggccaccatcgggcgttgtgcatgagcgaatgagagagagaagaggagtggataaggttgaaataacaaggagagagagaggataaggatgaaaaatgttaaagtgttgagaagggaaaagaggaggggacttagactttaggcggattcttaaggggcctcacacgaaaatgggaggacgatttttgccgacgcgaccagttacggtccatctgcaatctaaagagatctttgtatagaaaaatcgcttttgtagtagtgaagttcactttagatctcaatcaccaagtttaaaattcttccctaaaccaaaatatccggtatagcctatcccccaactcaaaataccgtgtcaactttgatcccttgacaatatagtggtcagttttggcttacgcggcgagcgagacccacatgggccccacatgccagcgtca

SEQ ID NO: 52488 - DNA, 1501 bp, Oryza sativa
aagtgatatatcactatttttttattttttatgattttttaagtgacatgaaaaaagaataggatatccccttaagggatgagtagagttttcatgctatacaagaggtgatgaaaggattttttttttcgagaatgaaagaaaaatatttgaagggttaaaaaaaaaaagtctctgactcactgttaacgcagtattaatcactagtgactactcatggttaccgtaaaaaaacgactacgcagagtgagagattgacaggccctttcggtggtaattccgtgtataatcattatcccgttgcatcaattacttatcttttagatagttgttgagaactctaactctccaaatcgtgattggtgaaacgtgtgagaaactattttgtaagaggcaaagttctcaactatggccatttcaccgatctggaaagtggcagtacgcgttggatgatcctagtaatcggattatgattcataaggtcgtagttagaaattgaaggtcttggcacgaaacatatagcgggagtctaaaattttaaaatatagtatatcgtagagattattgaatattgttgcgatgacttataatcttattatgccctggtggcatgcgatgtgtcaatttatggtcttggtgatttggtgattgtatggggactactatttaacgcacttgcgttcccaacaaatcccttttttccccctaaaaactttcatccaaaaattttttgtccgcaaaagtttcacccggaaaaacatttatctatatatttcatagaaatactttaattgaagaagttctataaaaaactttcatatgaaagtgtgcactagaacgtatgtacgacaaataacatttttagactacgcgcggctccatgatgagtgaagataggtaaagtaaccagggcctcgttgagcaatgcgccaatgccggagagaggcgtcggcgtagaggtctatgacaacagctcattctcgaccgaaactgacgtcgccgcagtggtgcagccgtgcagcgcgttatggtggaggaagaagggcaagttgtgggctcaggagcagtacatggatcagcttgtggaactcactcgatgagcaaatcaccatagttgaaaactttgcctctcaatatagttcctctcatatttcaccaaccacaatttgaagagttagttcttaacacagctctctaaaagatagcaactaatgcagcgaaatgatggttaattatagacggaattaccacccaaagatttgtcaatctctcaagctgagtagtcattttttgcacggtaagtcagagtactcatctcatcatctgtaatcagtagtactgcactaacagagaggacttttaaagtttaaaccctttacccttcaaagattcagacagttcaaagtcctccaaatatttatccttcctcacgtcctatataacattgcatttgcaccacaccactcgccaccaatggagcacaccggagccatgtcgagga

SEQ ID NO: 52489 - DNA, 1501 bp, Oryza sativa
ttctttttttctaattaagggtacctgtttggtttgatatgaaaaacacatgaatcatatatctgtgtttttttagtttaatagtgtagacaaatttggttttttttaatacctacatatagaaaacaaattatgtaacaaacttaggaggacaaagtaaataaataatgtatgcaataaccccttagaaatcaagtgttatattccaattaattatgtacctattaagggcctgtttggcacaactcgaacttcaacttccacctctcgtgtagttggagctcagccaaacaatttcagcttcaccgaaaataggagcggaactaaatggagctctctcacaaaaaaatgaactagagatgtggagctgggtttaggcagctccacaactccactccaaacccaactcttgaagctaaacttaggagttggagctttaccaaacaagctctaactgtgcactacgttcctgattcctccttattttctaatgaaatctacaagactggggttgcaaaataaactctactcccatgtgtcaaatgctcacaaagtttcaggttacttgtccatttgagctcctttggaacgctaaaatctaaggctgatttcgttcacaggagataggagagactgcgactcgttttctgcgcatacacttttcaaactactaaacggtgcgtttttttgcaaaaaatttctatagaaaagttgctttaaaaaatcatattaatccatttttgaagattaaaatagttaatatactcaattaatcatgcgctaatggctcacctcgttttgcgtatcttcccaatcttctcaatcccctctccctcaaacacagcctaagaatacgggaatatgaaaaacacagaattgaaaatgttgcgttgaatcctactggtaacaaaagcatatgaattactcaaaacacaagtttggattgatacgcgggaaaaaatataggaattttgagattatatgtttacttaaacggagcgagagtggaaaggaaagagagattgcgttcgaattctcaaagtaaacaacaaaaacatgaggtttggacctcatgttcaggtctaggagtgtattccaaaggaattttgtaactccaaatcctaaaaacgaaacaacctcaaacggaaaagatcctaaggatttgaattctctatttttcctttggaaatcttccaatccaaagaagatcctgacattgcttttggcctactttgtgtgatggtgacagtttggatgtcgctttaaaaactactctagcttaattaatcatcattaacgaccgtgtctggctgcatggtacagtcgctacaactcagcgcggatgcgaaatactttgattgtgcggagtattgtgctgcagtcgtatgattgtttccaaaataaaaatactcccggcaccataaaaacaatttcgtaaaaaataaaggaaaaagtacgaattaccccccgaactatcgcggttgtccgaattaccccctga

SEQ ID NO: 52490 - DNA, 1501 bp, Oryza sativa
gtgcggaacgaaaagttcgtcgctcgttggctcgcttggctcgactacgtcgactcgtagtattttcttaacaagctgagctgtggtttaacacgccaactcgagctagggatatagcacaatgataagtaggccagtagaacaggcgcaccacccaatctacaggtatctggataaggcccaaaagaaaacaattcaaagtccaaaccggcaaaccctagccgaatcagtcactcacaacatgaagtgagatcttgacaaacatggtataagtgtagacgctcacaacgcgcacgcactcatctctacgaacacacacctcctttatctactgagcccctccgaacaattaggccaatatattgtaagattgacaaagtagccacaaaagaaaagcgtaaaaaaaccttaggaattaagctattgtcggtaagaatcctataaaacttttgcattcataaaaaggtctcatttccatgttttgtttaaaataccatgtatatctatcactgatatgaggtttattgttatatcacaaagataccgaggtcaaatctatttttcaagtgatcgcgagaagtgcaactagcaacagtagggaccaaacaatgatatacatgacactagttgtcccaaaatgcaaaagatccgttacgcaaatatgtaatctgtcatggatgtacatgcataatactccgaactccatagggtgttttgttttgtgtgccctggtctcttgcaacctcggctggccgcggtattccggaccgggcgtcgcagccgttcctctgctggtggtttctgcatctgccattttcctgcgtgccgtggtggtagctcgcggctgatgttaaccccgccctagtgcgagcatatgatagagcaacgtacagtagctatcaccagcgtttgacaggggattatttttgggcagcttcgatgacgtttgatagcttaagagttgtccgtttgctccgaccgttcatttatttatctcaaagtggagttgataatttgtttcttttcgatgatttttttttctcgctcctcgtgttgagccccatcagctatgatggtctttgctggctagaagtacctgcgagtgagtacttagatgagttcttgtagcaactaaaatataactttctcatttttcattagcccgttttctaaacggttaaatgatacgttttgtgaaaaaaaattaaaaataaactcatttttaaatctataataattaatacttgattaattgttatagctaaggctaataacttttctcattttacatgccattgaaaattcataacatccaaacgctgaactgaaaacacagttagttagccaatatatgcatgcttgaatttattgaaacaaactctagctgatctgccatggcaacagccaacaggtctaagtttgacccttttatttatttttggaaaaagtacgaattaccccccgaactatcacggtcatccgaattacccccgaactataa

SEQ ID NO: 52491 - DNA, 1501 bp, Oryza sativa
ctatattttgttttctcttaatgcaatggaccaaggccttatgcacaaactaggacacgggcctagtcgcccggcccaccacgtccaagtatgcctcacgctctgcctcgcgccacaggaaagaggaaaggaaaaagtccatttggactcccttaattatacgccgaatcttaagtcgtacccctcaggcctcaaccagaaaaccggataggacgactctatgaactattgaaaccagtgcaatttgactccctcggcggttttgctaatgtggtgctgacgtgacggtgttgacccgatcttcgtcccacgtggcgtctatgtggcattagaattaaaaaaaaatctgtggaacctatttgtcattaaaaaaaactgggtgatactgcaccagctggcgaaccgcaccagccggaacgcctgcccccgccatgccgcacgcggcgaccgccgagccgcagtagtggaacagcgccgccaaatcatcagcgcaacaacggtgacgtcgacgagccgggtgatgagctcctccaaatcatcaccgcgccccggcgccgccatctccatgcccaccgccgcgtgtggcgccgtggcggcagcgtccagcagcagctagttgttgccgtgcacagcgacggcatcgttgaagcgggctgtgagctgctccatctccatgctcgccgaggccaccaccgtcgacgtcgatggatcagaaagctcgaccgctggtgccgagaattgacagtcttggactctggttggcatgctcgatgatcggataaagaagggtttggcttcgtgaatcgtgatgtccgaggagatgacgtcttgcttgctccttttatggcaagaaagcgcgcgtgcgtgcgtcgctgacctgagtccgtctctgtcgtcgggggaggcagcgccgacatcccgagatggagaggccgactcctccctctcgagtgacggagacggaggggtggcccggcggcacgaagaggagctggtccgcggtagcccagaccggcggacggggacagggtcggcctagaggagagatctaggaggcgctctttctcctgctgagtcgagattgataggggtggacaggcagtggaggtcgcggaagccggcgggggtggcggcgttgcaaccggccctcgcccgcccgctgccgccgctctcgtctccggcctcctcggccgcggcggccgccaccagccatgggacgcaccgccgcagttctggccctcgcccgccgccgccgtcgctccagctctccccgcagacggcgaagggggagagaaaggggagagaaagagagataggagatccggtcgcgcggagacgcgtcgctgcatgacctgcggctcgaaggaagagagagaagggagggagaaggaggaggaagaagggttggagagggaggtgggccccacatgtcagtgggttccacaatatatttttgtatgtgaatgatagatgtgtctcacatatattttttaaattctaa

SEQ ID NO: 52492 - DNA, 1501 bp, Oryza sativa
atgtttagtttgtagttctcttggaccttagagtaattatatattaattgttcagtgacatcattgactggcgcagcgcagcgcgccactatttctagtactgtacaatgcaacaaaggattggttgaataagaagtgaactcacggccactgaagttgggaactaaagagggggcagaaaagattgttgcaatgttgctgcatgtgtatggaatctaaagagagaccgagatccaagaaaaagcagactccaaagcggcaagcacacgaacgtgtcagccttttatcctgcatttctgtcgtcatccttagcacagcatttgggaacccctttggcatatggatgaactcggctccctttccaaatgtttgtcgatatggacaatttttgtttcaattttgacttctatttaatggttagcctagtttaaaaaaatagttagcctacgaggctaggctaaaaaaaaggtttcacttgtctttatgcagcatactttcaaccaattattacgacttctatattaaagtcttagatttatttcttttatcatcgaaactaaggagaaaccaactctcatcctaagaccaaagagtgtataaatgtatgaaaccaataaatattaagggtatatttaagaaagtttttggtagctgcaatttctttcagaataaaaactccttcaaacaatccaaattttcatctatattataaaaatgtgtagttacaaaatccacaaaatgagttaaaagccaactagccgctcctcaggatcttaaactccatcaaacaagacctaagatggctacttgggttcatttaatctatctttgtatttaagtcttaaatgcacagagactacaaatatgaatatattatttgagaaaaatcagaaaataaaatatgtttaatacttttggacatatggggtatattaagataggcaaattttgctaaaaaaaacatatttgcggttttagttgtaaggcatggcacgaagtgacttttcagggaagacactcccgaaatatgaaaaaattactgctacacagcatacccaatataatatttatttccgattcaataggagagaaaccacatgaaagttctgaaagacccctagacccacatgtcaagtctacatctccttctgtgagctagagaagaaggctcaagacagccactgaggaatggaggagagaagagaggcggtggccgcagaggtggcctacgccagacctggagctccccgcctagatccacgctcacgccatgcaaactctccaactggatccgcggccgcttgctgcgaagcttgccgcttaggttggcactagctcgtgccattgcgcaacctgatccatctgggggacctgccactaacaataccgtcctatctagcgtcatcgtcgttgacgtgttcgcctccctggaacagttgccgccaaggaattaaatcttcggctaaggcctttagctgtttgggctttcaacagctatgat

SEQ ID NO: 52493 - DNA, 1501 bp, Oryza sativa
aactgaataatgtcaagatcagacttgagatggtttttcaagtcattatttaagctctcactcaactgtgtgcttctcatccctaatgtgtaaacattcctcatgtagcattccgcccatttctcttttaccttatatatactgtttagccaagtctgcttgtgcaccttgcttctgatggtactgaaagtttcctcaaaagttgcttcatcttcatattcatacatacaagcactgaaatcagacaaaatgtttgtcttctttcttggtacgaggtaagtgtttgatagcattttgcattatatgaaaagtgcacaatccatgccatgcttctgtaaataccacctcaattgcctttcccattgcaatatcttgatctgtgtagattgttgtaggctgtttttgattatgtacagctaaaaaggtctcaaacaaccatttgaaagaatcaaatgtttcatcatacaaaagagcggctccaaaaatgacggtctctctaaaatggttgaatccaacaaagacaccaaagggcatgtattctttgtttgtcccaaatgttgtgtcaaaagtaacaacatctccaaactgagcatagtcgattatcatcttagcatcagcccaaaaaatatttgttatttgttcttcacaatccaactgaagggcataatgaaatgaagtgttctctgcaactttgtcctaaaagtacttcaacatacttccggcttcgccatacatcaactccctttgacgcttggttcgtaaatggttcttgagaacacgacgtgtataaccaaggtttactgaaccaccaacttgccgactagcaagctcatgtgcagcttttggtccaatgcccgaatcatccattgtttcaatttcaaatgcttgcaatgatgatatctttctctgtgatggcatcaaatggcatgttgaaggcaattgaagttcatggttatgttcaagaactaaatcatatactgaataatcgcccacttctctatctactgtgattctgatccgagctttgcaacctgttcttgtttcagcacgaggacgcttggtgttgtgatctcttttgtctattgcccggtatccctcattggaacaaacatatcttgcagaagtaattactccatcaactttactcttattttcataatttatcctaacatcaaaaccagtacgacctccataataagtccaaaattcccatgcctcttttgtagatttaaatttcatgccaaattgaggaatccaactaggaattatatttgtgttgtaaaaagaaacagggatcaactcttttttttttacaacaaagaaatacagtgttaaatatggattgctatgtggtcattattaagatccttttcagtaatgagatcaacaacatagtcagagaaaagaaaaatgtagatgataaaactatgttgacctgaatgaaattgatctcacctatttgaattatgatggttggagtttgagtcgttcgccataaggc

SEQ ID NO: 52494 - DNA, 1501 bp, Oryza sativa
cagccagctactacatatatactacctcttgcatctatcaaactaatcaaactggctcgaagctgcgaaacaacgttgtaaatggaagccgatcaaccccagtgaatcactttcttgaatgttataattagtttaatacacatgaaagtcctttcttcgtcctaatggatttatactaaccattcaactgttcagcatgattagtgccttaggggtaattgggtggtcggttgccactctgcgccaaatcacacgggcgttgaagtcgctagattaggaccattctaatgtagtagaggtacatagatacatacactagatacttgtattgctgaatgatatgttaactttgtttagaaacagttgatgttttgctaatgaccgtggaggacaagtgttcttagtaaaagatccccaaggtagagtagaggccaactgcagcccaagctctctggccaatgacaaaacattgttttattgcagcgtttattattattattattgaagtgattcatgcattcagcttgataccctagtactcctaatccatccgtctcaaaatataaaatataagtacttttagaatctgacacggtctctgatatactactttgaccaacaatatctatgaaataaaagcaagatgttttaaataaagagaattatatattgtgatagtttgtttaatgataaatctagtaacattaattttacatgagtgatattttttattttttttgctattaatagtcaaagttaaaaatgtttgacttgtcattatactaaaaatacttatattttgggacgaagagagtactcatagaaaaggtaagggactaaaggtaaaatgctatacctaccaagtatatctaggcatagccaccatagaaaagccgctagaatttttcatcgtgcaagataacctttagtccctcttataaaaatataagtccctttgtgagagctactaaatttagtacctaattaccaaacaccccctaaatctaagcgacgagattatattcggaagactcgctgaaatatctttagcggtcaaccaaaagtcttgaccagatatattcgttgttaaccctacgttacgacaaaaaaaaagttgctacgaaaagacaaactaagatagtcttgaaagatgtcaccatagccaagagatgtgaatcaaaatagtaaaaatgacataagcatacatatgatagtcagacgaatatttttaatgtataacacgaatcaaaccacagctcagatatataatattatgatactcgagtcacccatggtccgctctagaaattcacccaccatctacatgtgtcggctagaataaatacaacccaaattacaacggcacaaatattctttagaacatgcaaatgcgcaacagctatcaagacaatcaagccttggaaatcccaaaaaaagaaagaagaaagatgcacacaactggagcacaacacatggctgaaccagcacgttaatagtccaa

SEQ ID NO: 52495 - DNA, 698 bp, Oryza sativa
aatatccttttctctctttaccctcactctaatctactcctttcgtctaaaaaaaataaatttatagagcttaaactttgttcaaaataaatctaactcatacgtagtaccttattacttaatattggttcacgaatcaagaaaatttatccttcaataccccgttatctaccaactcaccaaactaattttctattaattagaggcattagagtaatttactctcgttacaaaatgtgcatttggattctaggaactaagtattttagagacagatggggtaactaacctatatcacaaaatttctatattttttctagagtaaaatacatgaccggttcttaaacttaaacaaagatatcacttagatctataaacttgaaaaattacacattaagatccataatcttgttttaataaatcatagccggtccatagcgcgtttgaccagagttggctgcctacatggcgctccacgtaggcagcattttgcatccagcctcctccgcatctgacgaggctataattttgtacttaccccctactgctaatgtagtcatcgaaatccccccgaatcccttcgtctctttgcattcccctgacgactagggttgcaatgatgaggatgctgttcggaggcggcaggaaacgatgaggtaacgacggtagggacaccgattaatcttctcccttaaagt

SEQ ID NO: 52496 - DNA, 317 bp, Oryza sativa
tccactactagctcgccatgcatgcagctcatctgtctcggcctagaaaccgggccggggcgcgcgccggtgaacctactacttgctggctgccgcagcgcccccgcccgcgcgcgcgcatatgcgtccgttcgcgtggcaccaaagcgcattgattccatcccttgtctcgcacaggccggagggggggccatccgcgccatgcgatgcatgcatgggcgcgcgcgtctgcctccccgcccgcccgctgcgacgtccctccaaaaaaaacggccggccgggcggcacggtgcgcaactgcacatgcccacgctgca

SEQ ID NO: 52497 - DNA, 294 bp, Oryza sativa
attcctgcagcccccgggactaaagatcccagggatctttactcccggttgagaatatcaaccgggaataaagcgtacggaccagcccacgcacaagcgcatgcgtagcccctctctctctctatctcccatccttatctctttttcttctccttccttatctccatcctctccccttcctctctctcaccccctctcctcctcccctccccctcttcctcttgcagaggcagccgacggcggcgggatgggggacgggcgcgggctggcggcggccggccggcggtggcggga

SEQ ID NO: 52498 - DNA, 1501 bp, Oryza sativa
gaacaactgcatagccgcagatttgtgtgtcaagccaattttgctctcgactacaccgctactcttgaccaaatcaaagaggtactaacaattagaggtggacataaaactcatggctcgttagctcgctcgactcggctcatttaaatttcgtaacaggccgagctgacttttaagctcgttagagataacgagctagctagctcgcgagctgcttgcgagccttaacgagctaggactcctagagactagagtaaagacccagcccaacagacaacagccaaggcccaagcccaactcctccggcggctgaggagagaaaaccctaaactcctcaccgcatccacaccgcatctctctctgctgctctcgatcccctttctgttgtatccgcacttccgagtgcgccgctgctagggccgccgccgctgccgcacttcccctttctgctagcgccggcgtcacctctcctctcctctcatgttgccggcgccagtcactcccctctcctcacgtgttgctagcgccgatgtcacctctcgccgcctgcatccggccgtccttattcaccaaaggagcgccgcctacaccgcccctgtcgggcgccaccccgtgccacacaccgcccagccatatgcagttgttcgtacccgtaattaaccacaagctcacttgccctttaccgtcaacgctagcccaccgccctccttcttccctgtggctctagtgcctcgtcttttgtccatctccaccatccactgtcaagccatcgtatctcctggccagatctgtaagcatagtaatctcctccccgcaccctagatcgtaactctaatgtcgtttgtcgggatcatagggcacgaattgtaaagcaaatactaagatcagtaatctgaaaaaaaaatgaactcctaagaatcaatgtcgaatgtgatttaacaattccgctaatattaactgttcagccattcattcagtactaggatcccacaggtaaactcacggcagttaatttttggggatttgccaaagcattgatttttcgagtcaaatccaacaacagcatttggacaaacgctctttactgcagcactaacttgctcagcacccattactgcgagggcctgagctagccagtagccagcacaaggcgagtcaaacctcgcgcaccacattaaccatctactccaaccaaccccacccgtcgatgagtctcagtttgctttctctaccactaccaccacgcgacgcggccggttgctcgctgctgccacggctaaaacgcgggctaaattacggccgccaccattccagcgacgacagcgagtgaagtgaactggaggagctgtaccactgtgtactcctagtctttaaagcctcagctcgcgcgcggccggccaccacctccccccacgcaggcgccacacagcgtcttggctcacccgcacacgcgatcttgttggtagcgagtcggagaagatgagctcgccggtgcatggcg

SEQ ID NO: 52499 - DNA, 1501 bp, Oryza sativa
gtggaccgccacctcgtctcgctgacatacgggccccgcctgtcggcgccggccccctctcttgctgacgtcagcggcagtccttttcatttgtgaaaatatttaataattgcgcaataaatcattaataattatagaaattcatttagtggctcaaaacttctaaaattcatatctaattcattcgaactccaaattgggccattcaaattgcaaaattcatctaaaattgagttctacatgtttgtttattttttaggtactgtttccttcgtttttattaggtttttcctcgttttgcgtgccagcgtatagaatccgtcgtttcggaagatcgcggtcgcgaggaaaagagttcagaaaatccaagtgaagaagcaaggcaagtcacacattccccttgagcatgttgatcccaatttacaaatgttttactgtttgcaaataaatatgcatgttttgctaattacatggggtcagggttttacctatctactcgcttgtgccatgtttacttgatatatgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgattgaatggtgggctgtgggtgcatggttttgctggtcgcacccatggcagttaagaaccggttcgtgggatgccctggaagaacttatcgtacttaccataagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacgacctctttccggtatgtcatggtggcatgtcggcgcacggaaacgtgtcgtggggctgtgtcttgtgggtacagttgtacacctctgatcagagtaaagctattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatattttacaaccgcctttatgcaaatagccacaaaccatccttgtatccccttgcacatctgcatcgttggtgtggcttgctgagtacggtggttgtactcagtcttgctattattcccccttttcagaagtgtagtgcttctgagctgaagat

SEQ ID NO: 52500 - DNA, 884 bp, Oryza sativa
tcctgcagcccgctctaaatttttcgggagtacgaaagcgacagcaaagcgaaaatactaataaagtgaccacagtgctcgatagtgtacgtttgtagtgctacgaacctgttatatgtttttccggagaataccgtcatttttgggaccgtaccagccgagcccccaacgaaaagctcgaatgattgaacttgaacttccgtctcggcgtattgctgatgacgccatcggatggcggctggggttggatggtttgtactgtggggcggtgggggtgatggcgatcggcggtaagagcgtgaccgtggcctggccgtgcccgcctgctggccgaacatgggcgaatagaagtaaatattgattattgacagtgattgttagtatcaaatgaaacagttttggtaggcatagccgcataggcatgaaattttcgttatcatattttttaaattgttgaatggtgcatttgcactaaaactttctacttcctccgtctaaaataaacttaaccttgaagaggatgggaccatcctggataaagaatttggacaacctcctttgtcgagattcccctcttaggttaagttttttttcgacggagtgagtatataatagctgctttaatgtattatataaaatatttttaaagtttatctatagtagtaataattaaaatgtaattaactatgagctaatgacattgttgtttttttccataacttcatctccatcttaagtagaaacgaacactacctaagtgggtagtgtctcatgagaaaaattctttagatgaaattctagcgaagttatatatatatatatatatatatatatatatatatatatatgtgagattatgtggaatttgacgaaattcatgagtt

SEQ ID NO: 52501 - DNA, 1501 bp, Oryza sativa
cacatcctttgtgctagtttccgtatcagttctttaattcagatcttcgtcgaaacagggcttaatgcttacaggatgtcttaaatattaagttgctagtatggcttaaatattaagttgctagtatgtttcccaaagagcaaattcacagtatccaaacatgtccgcgtacgatcttaaggatgtcttttactttctagtagaagattgtggtccacatttgatctccaaccccagtggtttcccaataatgcagtttagcacattcacaggccttaaggcacacgaaaaatccaagtggcataaaatacaactagctccagtaagcaatgcatctgtggctagtacaccaatgatttctgcaagtaattgtaattcagaatttggttaaatcaataagttatgaactttttacaatgcaaagcaccgtgttgtcctatgcgaactgcaatgtcacacatgctattttaagcaaagtacatgagtgttaactaactgtccctagtcataatcagtagacatgcttaagaactattcaccatgtgcaagtagcgaaagacaagatatgtaaaaaaaaaaaggatggtgcaaacataagtatatgcagacaagataaagtgcaaagttgagctcatcacttatggaaattttactgaattgagaataaataggtgatgaaactgagacaaggtttactatttacctgctgttttttaaggaaagttattcaatgctcttatttagttctgttaatcaaacatatgtacaattataagtatctgcccaagagattagaagttaggaaccgaagcatatgaaaaataacagatttaaaagcaacttctgcaagcacacaagtgattcatcacaagagtttcaaggctcgacagatcctcaacagtcttgaaaaactaatggaatgcaattatcacaaaagttgatgcaaatacgacataatcaataaggataaaaaggcttgacttcaataacgtaactgcttgtacagataggcaaatcaaggtgtacacagcgaaagcgaaacaccaccacatgacgagtttccacatatcaatggataagtaaacatatggaaagtaatgaaaatgatccgtcaccagattcaacctgctagaagaagaaccttttatgtgcaaaaatgctttcagaaattctcaggagacattcatcaaccccttcaaaagcttcgaacaaattcttgcaataagagctcttgtaaactgacatttcgtttaatttacctaatgtaaagaaaatgacactggggatggggggacaatgtgacacctaaactgaataacaactccacaagttcagaatatgcattgtgacatcagtcattgtggtaaaattaaatcacgcacacagatatagcacctggagttgcatcatataaaatagcagaaacatcatatggaatctttacacaataaaaagttaaaatcgcaatctaatgtgtccttgaagcttgactcatctggca

SEQ ID NO: 52502 - DNA, 1501 bp, Oryza sativa
acaaatgtgcttcgaaacgacctgtccaccgatgcctacatgacaacatcttcttgtcatctctacaagctctgaatctgtcacaaggcacaagaatttttcagtgtatatatggtttacttcttttacctgctaactccacgaaacctagagctcctcttgacagtgatgcctgacaaggacgacttgccaatgccaccaccattggtgtcaccatcaccattgatcggtgcgagcaaagacggctccctccttctcctcctgacaaccgggcccgcctcggcgccgccttccagcgcattgatgatcattgctggagatgatcctgagtagttttcaatctcattcttcaccatcatgatgctatgatccatggttgttagttgttactgcttactaacttggttcttggcctccaatgtagcatgtagctatctgaatgactgaatgaacagtagcaacactgaagaaaagaagcggatttgatccaggagagacaccattacctgcaggtgtgtttatgtactggttgcattggctggcgacagagtttgtcacctagtagagacaagacaatgtgttgatgattccatggctaaatgagcttcactgcgtccctgattactatgatgagttcttgtccatattcctgtttggaaacatcgattttaaccgcaaatgttttttgtctcaaggcggctgtgagatgtgcagaatcgagtacaattttttttacctgtttattgtcagcatattttgcggtgtcatacaggctgcaacaagaagccaaagtattattctcacacgagtccaagctcaaatcttggcgccttcttgtggcgagacaaaacagcagcaaatagctgagaaaactgtgctttttttccgccttgtttgtatctgtgttagcgtcttttgcagctcacggtctcatctgcagtctgagcgcgccatggacagagttctcattatgtctgggctcaccagagttcgtgtcatggacaggaatgccgatccaattagagccattgaagtttggatcgctaccaaattagagtgtctgggagcaaaatttgccttaaaatttctactagctacagtgttcgcccagaaggcggaagaagcaccggaaatatatgaaaataaagaacgtgcaacaaaaacggggtggtggcgcagttggctagcgcgtaggtctcatagctaaacgtgagtaatcctgaggtcgagagttcgagcctctctcaccccaaatattgagtgatgagggaatgctcctgtgacaactgggttcgtcacattcatctgatctcagatgtttacgagctagtctgaactcgattaaattttttttgttcaaatgcaactgatttcatgtataatctccacgttccaaacaagtcattgatgttaacgaagtactgcctagtggatggacaaaaaaaagcgcgagcaaagtttggacactagcaaacaggcaaccattattcagaacacattt

SEQ ID NO: 52503 - DNA, 1501 bp, Oryza sativa
agaaaagttggaagtttaaagataaacacggtgatgcgcgtagtgtgccaattcaggatgcgcaactaccgttgggattggtggttgcagaaaggcatactagtacttgcttctcaccgaagtacactgcccgtctgcattgcaagtttgcaacttcgcaagacaggcacagcgccggaaactgtaggcatattaagagaaaagaatatgtgtacggccatgtttccacgtcaaaataaataagaatacagcttgatgctcgtcaactttaagtatatagctgagtaaatgtgcatcagccaattgcatcctgcagaccagatacagattcttctgctgaagagaggaaaggccagggaaggaagagaacgagaaggtgatgattcttttttaatagaacgatggatttctgtgccaaaagcatactggaagttggaagcagcatttgctactaaggcccaggatcagtatgaagcccagcccatgtaatgacatggcagccagtaaaaggccggctcctcggtgttttgtttaggaataagtccatttaacctccctcatcttgtgcttgtctgaataacatcctccaaccggaaaaccggatatattacctcccccaagtgttaaaaccagtacaaaacaactccctcggtggtttttgacggtggttttgctgacgtggcagcctagtcatcgaaaaaaaattaaaatattacgtgagggcccacatgtaagtgtcatttctattcttcctcctccactctcctctctcctctcccttctctctccctggacagggcacggccaggggaggtgccgaagcgcgcgagagggatggggaccgccggaggatgcgggcgcgtgccgcgaggaaggggctcgccggccgcggcgcccgcggggagggttcgcttgccacggcaagcgcggggggcacggttcgccgggatgggtcgtcgaatcgccgccactgccgtcgccgccgacgagttggctcctctcgtcgccgttggtccaaagggaggagacggagacctcgctccccttgtcgaaatcggcggagctcaacctgggcattgctattgctgcctttggctccacctcccggatcggcaagacaacacagcggctgcgcaaatccggcagctcagcggcggtctccgccgcgggaggccgtggtagtggccagcggggtgacgagaggatctagtaggcaccggtgtctcgacatcggtggctgcaacgggagtcgtggtgggagacggcgaggcggtgatagtggccatcgtcgggcggcggcgcccgggtgtaggatcaaggaggccgactagagggggggtgaataggcggttttaaaacttagtggcacttaaacaaaactaacctaagttgctaggcaaggtaaggtgcaaggttaactaagcaactaagttaagttttgcaaacctaggtgatatgggctcaaatatgtctctatgaatgtaaatagaacaaatataaa

SEQ ID NO: 52504 - DNA, 257 bp, Oryza sativa
cctgcagcccacagggcggggtacacagtcgccgtcccatcggttattcaaccggtcagatgcgcagcacgccgcattaaatgcgacatggcgcggttgcatagaccgctttaaatgcagttaggtggcagttaggcgctcccacctaaccctgtacacgtgggctgatacatggaggggtcggggcagctcgaccccaagcgagggcggcctcctccctctagcttggaggggggcagccgccgcgccaccccagg

SEQ ID NO: 52505 - DNA, 1472 bp, Oryza sativa
aatacacgtcccggtgctcaataaccgcgagcacggctattcgaatagatttggtttactcatactgcagtggatgtacactttacccgcacttcgcgactgcccaacacatgagcccgtcccaacacatgagacgcgtcacggcaaagcttttcgataacctcacattggcaatacccgctccatgaactttacatcctcatgcactctaggcgtacacggtttctagcagtgagaggagttctagcgcacccgggaaggaaagactcacacatgcattaagttataattatgtttaaattctcacatggcagtcctaccgatggcgacaccactgtagacacccacctcgcggttctaccaatggctgccccaccgtagagcccctgcctcacacatcaagaaaccactatgcatggattccactcagctatctactccgctaggtctatacccatacgagaagtgcggttgtacgggggtagtttcatgcttaacttcatggctcggtccttaattgaccggggacgatactagccttttccggataccacccaaatcctccgtccgccccagtcgaaaacagttgtttaattttatttctcctttcacaaatcatgtcatcaacatcatggcaatgtggcgcttatgtctccacatgccgcatctcaataccttcccaaaggtaattgcccaagcatatagcatttgataaatatgagaatgcatgattctagagtagcatttctaagcatttgtcatagttgactagggactcatacgtaatcatggttacaagggaataagggtaaacaataatcaaggcatggcataatcacaagtaggatgttcatcattgcatgcaattttatttgtaaacaaaataattttcgcaattgggatcaacatgttcaaggaatagtgatgacttgcctgctcaggataattcttattattgatataatcttgatcaaccttcacctcctggaagttgtagacgttgcctcacgactaaccgatacacaaggtctataatacgcgagaaaaaccaatattcaaacaacaagcaaatatgcacaagcaaaagataattgttggggtcgatcctagggttgctcatactattcgtgtttgctaatggatttcaatcatgctagggctaaggcttcttaatctttctattgtcatcgtggtcgatttaggagttaaccaacatagcatttatgggatacatatatatttggctaatcggcgatttattctatcaaatggctatggaaggattatggctatatatgcatctattaaatagcacggttacataccagaggttctgttgttagatggatttgggatcaagcaattaatcgcagggaaccatttgtattattattttattgatggaggctttgctttaattatgaaaatattttacttgtcacgataaattagaaaaggttaataattatcca

SEQ ID NO: 52506 - DNA, 897 bp, Oryza sativa
tcaatcctacttgaaacacgttataaaaatatagtcaaacccacatgtcatccctatccatcttcttcctcttttcccatctccttcgccatcatagtccaacgagctaggtccacttgtcatcacctctctagggcgcccctgtctccttgcagaaacactattcaaacaataccaacgagagagagcaagagatatgagagaaagggtcattcctcaaggcgacaactttgtgagaggatgtcgtagcgaagactcgggaatgatgagatggcagtggactggatgacagaggagcttgccttgaactagctgttgaatagtcccacattggttgtggaagggtaaggatcctaatatataagtgggggagcccttcgcctcaataactagcttttggggtgggaaagaccctttacgatcctacactagctcccctattgagctctctcagtggtaccgagctcgaacaaccaccacggactcctccaagctgcaaggccatttgccacaaccaccatgtaccatagttattaagaccggacaggataatgaactggtcgagctctcggttcacctgtttgatggtccgaccaggttaggccggtccaaccgcggttcgatgtataatatgacgtaaatgtctcgtaccaacataagtgaatagatggagggttggctagcgcgtgctgctctcagccatgtgaccgaaggtcgaatccccactcccgcaccctcttctagcgatttttggtggggtttgctcagtgggcctcgcctcagcccatcaacaaaagccttacccggtctgaccactccagttcaaagcccggtttatataaaaaccgccggttcaattgcacacccgatcttttaagaggaccggacctgtcgagg

SEQ ID NO: 52507 - DNA, 818 bp, Oryza sativa
ctagcggcggctagcggcgaccggagtaacggaagcggcggcggcgggtggtttcacggcgcgggagcgatggggagcacgagggagttcggcgaaatagggaaaaagcgagagggggcgacgggaagcttaaataggggaggggagtcccggacgtggccggtaggggcaagattccgccggccaacgcggggagtgggagaggagagagaggcgggattcgaaaatcgaatcccggccatctcgggcgcgggagcggacgagagagagggggaagtgggcgcgggaggtgcggcgcacgcgcgggcgtggccgacgtggcccggaggaggcggaggcgtgggcgcgacggcggttgcgggcgcggcggcgcgggcgcgaggtaggagacgggcccgacaggtggggcccacctgtcggcgtcccgggtgggaggagggaggcggccgacctagctgggctttggccttcggccgacccagtggaggggaggggaggaaggagaatgggccggcggcccacccgaaaagaaaaggggaaaaagaaaaagaaaaaggaagaaaaggattttccctggaattaaaatattgcttgctcaattttaattggttaaatttatttctagggctctgaaaattccactaaaatcctgttaatgaatttctacatgtagaactcaagaaaaattccatatgccagattcgattattatttgtattattttcttagggttttctcttgatttgcaccagcattttcttagggtcatttataaattaaattttaggcttgggaggagaacttcagggtgtgacagt

SEQ ID NO: 52508 - DNA, 328 bp, Oryza sativa
tttggccctttacctgttgtttaactcctccaagtcccaatcaattggcagtattttctggggacttcttagggcagcttgctcagcatcctctgtgtcatctgtatgctagtttggactagtattagtgcaacaagttaccgcagttgatgtgtttttctaacatgcttagattttggcagcagtttctggggacttcttgggcagtttgctttgcatgtgtcatctatatgctagtttggaattggtgcaacaagttactgcaatagatgtgttattctagcatgctttgattttggtagtaacagagtgatttgcaaatttcagg

SEQ ID NO: 52509 - DNA, 884 bp, Oryza sativa
accctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatatgcatatgcccttttgcacctggaattgtttcgggaaaatttggagttttgcctttttggtttgcgggaaaaatcttggtcgttctttcggatcggattttttttttaaaaaaaagaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 52510 - DNA, 228 bp, Oryza sativa
aaaagttgtgctcaaagtgctgtagataataaagtaagtctcaaacaaaataataataatttcaaaaaaaattgaataagacgagtggttaaacgttacaagcaaaaactcaaaatcccttgtaacaggggacggagggagtaattaatgtagttacacctacgctgcatcgatgatcactgtagtctgtatcctaacagtgtctaaactctgaagaaaacctcgcca

SEQ ID NO: 52511 - DNA, 1501 bp, Oryza sativa
gaaacatctgaaagtaactaacgtacctttatttctgcttcctgaacctcagcaactttgataaatttttcaccatttaaaggatcaactagccaattccagttaccagatgttgtccaactgccctgcactgaacttaaccctatcagcagtctgatcagaactttatttatcaagcatctctacgtccatgccaaaataacttctttcttccatataggtgaaaggctacatgacagtgacatgtttgactggaacaaccattcggaaataaactacaccttaactcttattagctcagtagaagttagaactgaatgtttatgaagcaaagagatcaagcacatgtcattgctttgaaaaatcaacagtaatgtgcggcaaaactgcataagcagtcataacataacctgtggaaagtatgagaattaccaaacacgtatttcctcttcaaaatataataggcatggcattttatcgttcaaataagacacaatgtcaaactcttctcaagtaaaattacttcccaccataaccatatgaactagtttgtgcactgccacagcattcctatgaattggttttgcaacatcacaagcactaactaataatatccctccagattcaatgtgtacaaaaacaataagcagaaccccaaatgggagctctcttaccaaaattctgcacttccgccgggctcgaacctgaaatttcctgaggagacaccgtcgcgaatggcggcgtgtgcatccacctgccaatcaatcacccaaacgaagaatcgaacatatttattgcccgcaaccaaaaccacgatgccggatcgctcccaaaaaaaacggtggaaaaagcgagcgccgcaacgagcggctcgaccggaaactcgcatcagatcacccaaacgccaacggcgcccaaaccgccgcagcacgatccacgcacgcacgcacgcacgcacgcccattcccgacaaccctccacgcgagcagatcaggggagggggtttcagacagatcacctggaggcgagcgcggcggggcctgaccgccggacggcggcggcgaggcgccgccgggaaaggatgaggctcatggctctcgatcggcgagctcgggccgcgcgcggcgcggcgacccggcggtggagcggagcggagtggtgtcctcgcctcgctctcttctttccacggtacggtctcgtgtcgcgactcgctgcgtgcgtgtgcagtggcagcggcagcgtgggtgtcctcgatttatggaggcgagaagaggtgggctgatatgatgatgatccgatgatgtgatcggcgaggaggaggggaagtgaatcccggaattttttttatttttaatttttttattaaaagttttacaaaaataattttccattttaaaaattgacggaagtagtcgcctaccgccctctgggaaggcgatttttaaaaatcgccctcccagagggcggcgaaaatgacgtggcagacggccgttcgctctcg

SEQ ID NO: 52512 - DNA, 499 bp, Oryza sativa
tactccgtaggagtatttcagtaggagtaggcaggtcgggcccctgcagccaaaggacttgtcaagtccaaacggtgagtagcgcacagtactactagtggtctggtagtcctagtaagcactggcctaagctgtgcgtagtgtgacgcttcacgaaaaagctactgcatcagtcagtccagattgtgtaagaaaaacgctgccacggagaatcctttctgctgagctgagccatgctatagatttcgactggcatagagaactgagcagaaaaggctatagctacagtaggcacaagtatagcgctggtgttcagccatgacagtgtgtgacagttccccgatggaatctgtgtgggagtagtgctaatctacggcattttttttgcgacttagtggcagattccttcgctccctaaccggccattgcacatgcacgcaatctcattagttctcgtctaatcctaatcttgtctttgcgtggccgtgtgctgcacagg

SEQ ID NO: 52513 - DNA, 1501 bp, Oryza sativa
gccttatgagggtactagcttacaatgggccatgtgagttaccactgcttcatggcaagggcgggctttagcctactcaaagtccatcaaccgtgtgatttgctcgatttgtgggccgtgataaggccgaaggccagcttgctgccaaatctccaaccagccccgccgaccaccaggagcaaatcaacccgtttgacggtttgaaaagtggtctatactgatatggcatgttgatttggtccacctgtgatgaatgaactttgtatggttatatttgtagtaccacatctatatctatacctaatataaatattcggattttttctgtcgtcacatccttttcaccagcgatttttcgtcccgcgttatccgatttcttcccaccgcacacaagtatcacgcacaaaaaataccccacaccgattcctacttcaatttgccacattaagcccacaagcccaaattaagatagatgaggcacttcaatatttaagattggaaacagtaaaattagagaaaaaaaaataaacgaaattgaaggggaaaaaaagcctaaagtaaacaacaaaatcaaaattgaaatccaataaaacacgcatggattcccagctgattcgtctcaaattcacctcatcgggcagccaattcatcacaaattcaatcacaagaaaagagtaaataaaataaaagagagggaaaaaaagatcaaacccaataaaccacccacagattcgcagtcgattcatcacagactcgccttgtcgggcaaccgattcatcacagattcaatcacaacaaaggggaaaatcaaaatcaaaaagaggaaaaaactgcccaaaaaaaaggaggggatggtggagcctcagcgagcccaccaccgccacccgcgaccgctctcgtcgccgtcgtgttcaccgctgcagcactgtcacaccctgaagttctcctcccaagcctaaaatttaatttataaatgaccctaagaaaatgctggtgcaaatcaagagaaaaccctaagaaaataatacaaataataatcgaatctggcatatggaatttttcttgagttctacatgtagaaattcattaacaggattttagtggaattttcagagccctagaaataaatttaaccaattaaaattgagcaagcaatattttaattccagggaaaatccttttcttcctttttctttttctttttccccttttcttttcgggtgggccgccggcccattctccttcctcccctcccctccactgggtcggccgaaggccaaagcccagctaggtcggccgcctccctcctcccacccgggacgccgacaggtgggccccacctgtcgggcccgtctcctacctcgcgcccgcgccgccgcgcccgcaaccgccgtcgcgcccacgcctccgcctcctccgggccacgtcggccacgcccgcgcgtgcgccgcacctcccgcgcccacttccccctctctctcgtccgctcccgcgcccgaga

SEQ ID NO: 52514 - DNA, 1501 bp, Oryza sativa
gttgccaatcagatagtacctccagatcttcaaagcatgaaccactgctgccaattctagatcatgggttgggtaattcccttcgtgtagacgcaactgtcgcgaggcatacgcaaccactctgccctcctgcattagaacacacccaagcccgtggcgggatgcgtcgcaatagacttggaagtctttcatctggtcgggcagaatcaaaactggtgcggatactaatttcttcttgaactcctcaaagctcttatcgcactcagctgtccatttaaacttctcatctttcttaagcaactaagtcatgggtcgggcgatcctggagaagttctcgatgaatcggcggtaataacctgcaagtccaagaaaacttcaaatctgcgacacggtcttcggtggggtccatttggaactgactccacgtttgatgggtcgattgccacaccctgagctgtaataacatggcctagaaatttgacttccgtcaaccaaaaatcacacttgctgaacttggcgtataactggagctccttcaacttctagagcaccagacggagatgctgctcatgttctttttcagactttgaatagataagtatgtcgttgatgaagaccacaacgaacttatcgagaaattccatgaacactttgttcatcagattcatgaagaatgcgggtgcattggtaagtccgaaagacataactgtgcactcatacagcccgtaccgagtggtgaaagccatctttggaatatcctcttcccggattcttaattggtgatagcctgatcgcaggtctatcttagagaacaccttagctcccttcagttgatcaaacaaatcatcgatccgcggtaaaggatatttattcttgattgtgacctcgttgagtgcgcgataatcaacgcacatcctcttcgtcttatcctttttctccacaaaaatgaccggagcaccccaatgcgaagtacttggtcaaatgtaccctttctgcagctgctcatcaacctgtttcttgacctctactagttcgttggccgccatcctgtacggcctcttgtaaatgggcgcggttcccggtgccaaatcaatccggaattcaatctctcgcttgggtggcatggtagtgaggtcttcaggaaagacttctgggtactcgcaaactatgggaatctcttccaatttcctcgaattcttctcctcggtgaccactgggatttccgcctcaatctgattcaaggagaccccttgctttggtgagactagtgatttgtacactacggtttctcccttctcgttggtcaaggtgactgtgcgattcacacaatcaatgactcccttgaatttggtcagccaatccatcccaagaatgacatctaggtctttggattcaagaagaatgagattggctagaaatggtgatctttggatttctattagcactgaagggctaaaactgaccgaggttgaactatttcccggggtatgaaccctcattg

SEQ ID NO: 52515 - DNA, 1501 bp, Oryza sativa
tgagatttattcgtcagtcagttgggatttgatgggtgaaatgcattaggtcccagctcaggaatatgggttgcaaggtatttatgctcttattgttattattagtatgtatctaatttccccatcattttatcgttatgtaagtctgtcttatttattcgccctcatgcaaaatgatctatacataaaatttcgctcttattcgatactcttatttgagtcctttattactttatttaaattggatttgagcatgcattgatcctactcctttgtcttctctagatggccggccacccacccaaccaccacggagaaggcatgattgactttgtggcagagttagcacgtatgacgctggtggtgggctaccccaacgcgccggagtacacgactgttccaccgctcagtggcgagcttccccaccgtgtccgcttggaggtccatggctacgtggggacttgcctcgctaacatggtggttgaggcgtccggaggcacagcagatcacgcctgtcaggaggcagcatacctgatgatggccagactacgggagtgccacaactacatcttccatgacacggcgtatcgatttcaccctcgtcgagccagcggtgatgatgtcagtaccttccgtccaatagccggcgagaacgacaccacctttgatcacatgtgcgccgtgatgagggggatggacaggatgcacttggacctgcacaagacgtccaaggccttgaatgatgggaagctcatgaggatcgtcgttctaaaggacgagatagcgcgcttgaagagggagaatgctcagttaaagggtcttcccgcgccaggaggagtccggatccacactacgccccgcaagtcgacaacggcacccgtgcgcatccagcttgcgcccaggaacccacctccgcccgcagttcccgcagcacctccagttccgcccgcagctccagcagttcccgcagctccagcgccagctccagctcatgttcccgtgtcagctcctgcatccgctctctccttcgcgcctgcaacagccgtcaggggccccgccagtggcaatggaggttggttgccagctactcccagtggcagtcgcgacctcagcagcagcagctccagtggctcagagctgggtagcggcgagacttatctgccaggctccaggagtcgctcagagggacgtggtgacgagcaggaggacgcctttgactccaccgaccgcaggagccgttccgagcattaggctcgttttccattagcttatcgactgtctagcttttgcttgttagtttgtgtgtttaggttgcttgcttggggtcagtcgacggtcgatatcatgtgcctatgatatggctgtctcaataaggatttttgcttgctgtttcaagtgttttaattcagatcagaacaattgcagtttaaatttctatataataaagcttagttcctgagtatctgtttttctccgtttccccgtctactcttcctccaga

SEQ ID NO: 52516 - DNA, 1065 bp, Oryza sativa
ctcgtacgctggggttgggaaaaatagagcaagactgagtactatccactgtactcagcaagtcataccggaataggggtatgatgcagggaattatcaaaggagagctagggtggttcatttgcataaagcgagcatttataaacagaaatttaaagaagaaaacagtcgtaataattaatcaatattaatcatccaccatccaacgctataccacgttgcgacaggcccaaccatccacctatactatccaatttcaaaagactaaactagggtgagactaatcacggtgaatctggttaaccgcccataaccgcgggcatggctattcgaatagttttactctgatcagaggtgtacaactgtacccacaagacacagccccacaacacgttttcgtgcgccgacatgccaccacgacacaccggaaagaggccgtgacaggacccttcgcataaccctctctagccaatcacaccacacctcaggtttcacccccatccccagcgggcgacgggcaatcccctctcatgcctaggtgaatccggaagccgcataggccgtcgcagggcccatccaaactccatcacgcccacccttgcctggatgcatcagctagagaaaagctacactacaagcccagccgttgcccacgctggcttgtggtaagcacgataaattcttccagggtttcccgcgaaccggtccttaattgctatgggtgcgacaagcaaaaccatgcacccacagcccaccatgtgattcattttaattaaccaacaccaaagcggtggtactaaaccaacattatcatatgaacctacagtctatattttaaatgagatttccccattgtgtgctagttgaactaagcatggctaagcaactcctagtctaacgtctattcatgttataacccgagctaacaaaggagcaaggtaccaaaatagcatggctgtaacaataggtaaacatcccatagtgatattgcaaaacaaatgcagtatttgaaagaaaacattagaacatttgcaatataggatcaacatgatcaagtgacaagca

SEQ ID NO: 52517 - DNA, 558 bp, Oryza sativa
ctcgtacgctggggttgggaaaaatagagcaagactgagtactatccactgtactcagcaagtcataccggaataggggtatgatgcagggaattatcaaaggagagctagggtggttcatttgcataaagcgagcatttataaacagaaatttaaagaagaaaacagtcgtaataattaatcaatattaatcatccaccatccaacgctataccacgttgcgacaggcccaaccatccacctatactatccaatttcaaaagactaaactagggtgagactaatcacggtgaatctggttaaccgcccataaccgcgggcatggctattcgaatagttttactctgatcagaggtgtacaactgtacccacaagacacagccccacaacacgttttcgtgcgccgacatgccaccacgacacaccggaaagaggccgtgacaggacccttcgcataaccctctctagccaatcacaccacacctcaggtttcacccccatccccagcgggcgacgggcaatcccctctcatgcctaggtgaatccggaagccgcata

SEQ ID NO: 52518 - DNA, 1501 bp, Oryza sativa
tgataaagctgcaaaaatttatcaatgagaaagaagagccagtaagtggattagctatcaggtaaaataaactctgttgtgttagatgccttttgtaatgcatccaaagttggggttcaaacacaacagacagccaaaagaaaaaagtcaaacattggaaaaccatgcaatgcattagtagtacaagaaaactacactgacctctctggagctttaagtgggttgtgaagtccatgctttgggcaattagataaactctctacaaatggctgcaccggaaaaaaaaaatgcacgttgcctgaggatacgcttcagagcagataacagattcacagtaatatcaactaagtctaaatataaccgtagtcagtcattttaatgtaagagagtttgtttctttaacggatcaatctgtgggtttttttagtggagtaagctgaggaaggttaataacaattaatatcaccgcaacacggaaataataaaagaaacatctgaaagtaactaacgtacctttatttctgcttcctgaacctcagcaactttgataaatttttcaccatttaaaggatcaactagccaattccagttaccagatgttgtccaactgccctgcactgaacttaaccctatcagcagtctgatcagaactttatttatcaagcatctctacgtccatgccaaaataacttctttcttccatataggtgaaaggctacatgacagtgacatgtttgactggaacaaccattcggaaataaactacaccttaactcttattagctcagtagaagttagaactgaatgtttatgaagcaaagagatcaagcacatgtcattgctttgaaaaatcaacagtaatgtgcggcaaaactgcataagcagtcataacataacctgtggaaagtatgagaattaccaaacacgtatttcctcttcaaaatataataggcatggcattttatcgttcaaataagacacaatgtcaaactcttctcaagtaaaattacttcccaccataaccatatgaactagtttgtgcactgccacagcattcctatgaattggttttgcaacatcacaagcactaactaataatatccctccagattcaatgtgtacaaaaacaataagcagaaccccaaatgggagctctcttaccaaaattctgcacttccgccgggctcgaacctgaaatttcctgaggagacaccgtcgcgaatggcggcgtgtgcatccacctgccaatcaatcacccaaacgaagaatcgaacatatttattgcccgcaaccaaaaccacgatgccggatcgctcccaaaaaaaacggtggaaaaagcgagcgccgcaacgagcggctcgaccggaaactcgcatcagatcacccaaacgccaacggcgcccaaaccgccgcagcacgatccacgcacgcacgcacgcacgcacgcccattcccgacaaccctccacgcgagcagatcaggggagggggtttcagacaga

SEQ ID NO: 52519 - DNA, 1501 bp, Oryza sativa
ggcaaaaacctgtgatggagtatgccctaacaactctttcagttttctttcactaattggatggccttgaaacaggtcctcaacgatcttattgagtacctgtgtcaatcataaggaagatatcaagtaacaataagcgagtactataaaactgacagcatttggtgcatctggtgttattgtgtattaccattcaggaaataagcaccctatcacaagtcatatataacacactattgctactgtgttgttgtgatggctatccaaaaccaatatccaaatggtcctgaatctaaactcgagcatcagaatgcaatcgtgataattatcaggattttcccctttccaaaaaaaagtatctggactgcatttttttagatgatatgtacggcaagcttaactggatttgctgcttgctatcagtttccatgtgataaaacagtaatgttaccactaccccttaaagtaagttgataaagaaaagcatattggcaaaatgattgcaggtctcaggtctgtgccatgtgttattctaaggtaatatgtgaagcttcaatcagggaagtaatatatatttgagtagctggttttatgatttacaaaaaagataatgagctaaataaggtgaatgtagcacacaagtttcataccaaactacagcaattgtttggaaggagcaagacattggtcttgaatgcctgaaatctattttgatgctaaatactaaacaatcacaaaactatttaacaccgttccattgcccccaacaagtacactcaagtttgtagttcaacatatggtgaaaaaagtatctggggccactggaaagctaagacaaagccaaaatttgtttatgcgaaaagatactaaaactgccatataacaacttctaaagcccaaataacagcagctcgcacatgattaacttttgcaatttggctggcttgttttatatcaggacagccataatcttatatatgtagcacaattcataatagtatcgcaatgatgccaacgcgaaatcatagtccccattgagttcagaatgttagcttcagattttcagttgtaagtcatatcacaaatttacaatcatttgcaaatggtaaccattacacttactgctgagagacgaaaaccataaaagcagagtaaaatgaacaccaatgttatcccaaacaatgataacataagcaatcaatctgtatgtacaccacaaatactaccacattgaaagtaacaacataggagtatgcaatcccataatcactccaacattgggtaaaaatgtaaaatataccaccagccgcaagttcaaacctcacaagggccatcgaatcagtcattcatcgatgattgaacaatgtgaacaaaaagtatcctaccccaaataacaagcaatctctgaatcattttgacaaattagctatcaaaatcaaaagttcagaaaaaaaaatgtatcacatacatctaaatgcaatacagaaatggacaaaagcaa

SEQ ID NO: 52520 - DNA, 1501 bp, Oryza sativa
actgggttgtactgaagtccaagcagagccacctaccttctcttgcttctctcatctcttgccacaattattggaccggaaattcatgaagatcctctgccggtgctagaacatggcagtctgggtatggcctgagcagtaaagatttgttcatctttgtttattgggatttcttctttgtcaccttcatccctttagactctcccctttagacctctagtgttgctgctgtgcttgtgtatccatggcggcaatggcctcttctccccctacaacaccaaatctcggttcgcagcctacatgggtgccctatgagccaaccagggattgctcccagggcctctgcagcatgtactgcccgcagtggtgctacttcatcttcccgccaccgccgccggccttcgacatcaccggctccagctccgacgactcctccggcccaaccttctcgccgctcgtcatcgccatcatcggggtgctcgcgagcgccttcctcctcgtcagctactacaccatcatatccaagtactgcggcaccttcagctccctccggaacagactccttggctccagcgctcaccgcggcagcggcggcggcgccgacggcggagacaattccaggagccaggagccgtggagcgtcgcgctgtcggacgggatggacgagacgctgatcaacaagatcacagtgtgcaagtacaggcgcggcgacggcttcgtggacagcacggactgctccgtctgcctcggcgagttccgcgaaggcgagagcctccggctgctgcccaagtgcagccacgccttccacgtcccgtgcatcgacacctggctcaagtcccactccaactgcccgctctgccgctgcaacatcgcgttcgtcaccgtcgggatggtctcgccggagccggaggcccgcgttccacgggaggataggagagacaaccacgagctggtcctgacaattgacaacccggagcatgtgcgcgaggagccacagaacgtggtgaccggtgtcgccgtcggcaacggcggccgcaaccacgaggcgaaggatggtccggggaggtcggaagatgcaaatggcacagctgagatcagagaagacggcgccttgatgccgcccacaagggcgccgtcgtcgttgtcagacacgcaccgtgaaggccggatgtccattgccgatgtcctgcaggcgagcctggaagacgagctgatggtggccagggagagcggcctcctggcaggctcttcggggtcctcaagacggtgtcacggggagcacagcaaggacggcggcggccgcagtggccgggcattgccggacggcgcgaatatgaagagattggcgccggccgggagatcatgcttcagcagcaggagtggcagaggaaaggactccgttcttccaatgtgaggcaaccaaggtggttcttttgacagggaaacatgacaagaaacttttgtgtgttcttccggtggagatcaaatgatcaatgtgccg

SEQ ID NO: 52521 - DNA, 1501 bp, Oryza sativa
ttttagataattcgtcgcatgtattttacctcacaggaacaagaaaattacttttttttaatgaccgaccccttaatatttactacattgacattcaaactagacgtagagcattactctatatgtcatcttatgatgtagaataattattgtgcaagccatatgaagaggtaaatctccgtaaaaaaaaaactaacttctaaagacgaatttggacaagtatccgtctaagttcatattcagaagttggttttttcgtgacggagaccgtattctcgggttcccactttagtcggttcattttgactagtggacaaccaacttgaacgaaatcgtcagtgcaccatggactaaaaaaaccttggaactaaaatagtcttgggccttgtttagatcccaaaaaatttggcaaaaaacgtcacatcaaatgtttggacacgtgcatggggcattaaacgtggggaaaaaaacaattgcacagtttgtatgtaaattgcgagacgaatcttttgagcataattacgccatgatttgacaatgtgatgctacagtaaacatttgctaatgacgaattaattaggcttaataaattcgtgtcacagtttacaggcggaatctataatttattttgttattagtttacatttaatacttcaaatgtgtgtccgtatacttcaaaaactttacacccaaagaactaaacacacccttggttgctgagtttcttcgacgatctaagcaatttccaaaatggtcttattcccttcactgtttagtcttgggattttggaacacagtcacactgcatttttgtaccagcatcactccatatttttattactttatcccagccaaacatccactttattttcttatattccaaaggggacaaacgaggcaaaggaaaagaaataacagcgccggcagagggaaatgaaaagaaaaggggtagtggacgagagagcaggagcagtggtggcaatggcaccaaaggcaaagaaggccccaattcccaaccaccgccacctccctcctcctcatcaagcattcaggctctcctatcccaaaatgctttgctttccaagcaagcacactccctctctgctttggagattagctctcgtttctcttagtagcagcagctggtgtggcagcatctcatctcatgatctctgattcttcacggctgctgctctcttcccatctcatctcacatttcccagggccacgaaagaactgggttgtactgaagtccaagcagagccacctaccttctcttgcttctctcatctcttgccacaattattggaccggaaattcatgaagatcctctgccggtgctagaacatggcagtctgggtatggcctgagcagtaaagatttgttcatctttgtttattgggatttcttctttgtcaccttcatccctttagactctcccctttagacctctagtgttgctgctgtgcttgtgtatccatggcggcaatggcctcttctc

SEQ ID NO: 52522 - DNA, 599 bp, Oryza sativa
aaatctgcagtactgttcactggtacaaaacgtaaagcggccgctccctcaaactgtaatgagccagggtggaccagattaatgcaaagcagaaaagctttgctaccaagatgaattccatgaggttaatctactctgctgccgttttctttcagtaaatccacatgtcagcaagtgttttttttgctttactatgtaattagcaaggtaagagtggtactgattcttttagaaaaggaagacaggatgaccccatgcctcatgttcttgtggtccaaaattctaactacatctttcttctccaacaaatcttcttccattaatctgctttcttacacgtatccagatgaaaagaaatagagaaatagcaaaaaggggataggaaagttgtgatgtgattctacttgcgcaattcgtctataagaaaatataaaggaaatagcactcatcaatcttggatactactttcgttccgtcggagcctcagttcagttaaagttgctctattctgttattttgtctcatgatggttcacacccgcattagaacatggcatctctgtaaatcttgacaacttcgaactaaattcggcttgtaga

SEQ ID NO: 52523 - DNA, 1501 bp, Oryza sativa
tagaatattaaatatagaatacttacaatactaattacatagatagaggctagttcgagagacaaatctattaaacctaattaatctatgattagtacatatttaccgtaacactatattgtcaaatcaaggactaattaggtttaatagattcgcctcgcaaattaacctctatctgtataattagtctatgtttaataatctaaattagtgtttgatgtgatagggctaaaatttagtcaggttatccaaacacctctccggaactggagccacaagcgctgtgcggcaatggctgtatcaagagcagatgagatgcaatgcacgcggcacgccttgaaaaattcggcctttgtgccagagctggcctctcgcttttgaggtgtctcccgaactggagatgccaatatgccaacccactgaaagcagatcaggggtgtgtggtctataagctcatcactatactaagattcagtggattgaggtgactgccaacagttcagaaacaggagtgctcattttatttgtcttaataagttcggccaactgtacaaggtaacataattaggtcaaaatctgcgtctgaattattggcgcattgggcagattatgcgcgatctctcgacgaaatgcttacttgaacccgtgaatcaaggggacggccaagaatccaggagtgcagaaaatcgttaacagaaaacctgacggccatgtgtcatggactcatgggcggcgtgatggttcaactgttgaagcaacgtactacgccgctgtgtctatcgcagcagactggctgaactcaaatgggaaacctgattgctgaaacaaaaattcatgtcaacgcttgcttgttcgtttctacgacttggggacccactcagctaatattatatactgcgggtaatcgtcttactaacatgtaaatcttaatttgttcgtcattatctgctaagagattacgactggctccaaggagacgatgcgacgtataaccgctgcaagactaatcaatatgccgtatttctgactttatctttaacctggttactgattattcacatgatctcacacatcaatatcccatgggcccacacacgattcttcccacatgaaaatggaggtgaactggggttggaaaaaaaattcggacgaacagtccacaaaacgtgtgctcagatgctaatctaatcgatatatagtacaattcggtgtgtgactgtgtgcacagttccaagtaccagccaggaattgccgaaatgcagtagcacgcacaatggttcagatggcgttacaggagtgggtgaccaaaccacaaaccgaacgccctacgattgccagaaaatctgtagcatcacctgccgaattattgatgccatggttctaccggtttgtaggtttcaaaacggcaaaatgaaatggctttacaaaacggcaaatgaaattatgcagtaggccaccagaaaaaaggcatcctgattccagtaggccgtcgaggcttctc

SEQ ID NO: 52524 - DNA, 236 bp, Oryza sativa
tgttttaacacctttgtttcgaaaaacaaagggcgatgaatcaagttcgacaacgggtttttcaacgagtcgtacaaggaaggagctataggtactctaatatttgtattctcggtgtcatggaatggaagagataattaaattaattaggtattgaacttctaatttcctttagaatctagacattattccccccccttgcttccgaaataaaataaatagtaaagaaacactaa

SEQ ID NO: 52525 - DNA, 642 bp, Oryza sativa
catctttagtcccggtttttagtggaaccgagactattgtggatttcgggcgaccgaccaaagatggtttctccaccagtgtgtgtactctggttcatttttgtgccagttgtaaacgatgttggttcaaatgttcctgtcgaaaacaagatgaaatttaaagaaaacagtagtactatctatactgtgcctcatcctacatttaaagtgctgtttgtaactactactaattcacatatactaacagtactagcacttggggagtatttttcccctgaagtagctgtcgcatattctagtagctgtccctgaagtatcggtgaaaaaaaaatgagttttggtgataataatctcacaggattggcataaaacacgcaataaatgattgtcttgagccaccgtctttttggatagagcataacctgcatatggcatccaagtggttatttaagggatctgatactatgttgcctgacttgtctatcagtaacactaactttttgcgaccactccagctaatggagccagctaattcgtaaacattatactctcacaaatgctacacctagtgtttgtttgaattctaagtcatcaccgtaactggtatcgtctgagctaattaaatcatatactctaaatgaa

SEQ ID NO: 52526 - DNA, 1501 bp, Oryza sativa
cccggattgggattatgcagtcgactgcaccgtgtgccattgtcactgacatgtgggccgcgcgcggcgcacgagacacacgccgccctcctccttccagttcactccactccgctactttttccaaccgtcgccccacgcgaaccccgacgccgcgccccccttccccagcctccgcatccgattcccatggcgtgcttggcggcgggcgccgaggcggcccctctcctcttccggcggcggctagcgccgtccccagtcgccgcgcgccgccgccttctcgtgtcgtgccgagctcgccgccgcggtctcaggttggtagcccagagcgcaggatcgcgtggttgcggcgtggtcggtgcacccggttgtgattactggtgtgttgcgtggtctcgttcgttcgttctcagtagtctgctcctgcggcgaaccgggggaatggccttttggggtttgggttgggttgggttgggttgggtgacaggggatcgaggaattcaattcccttggtggtgcgtgcttgtatgcatagaatgcttcgatcgtgaccaagtggggatcatcaacctctgaatgctgctctcctaatattgtttggcttaggttctgaaatgcttcttaatcaccggaatgttccacctatctgagaaaatatcctagcttatgttgtgtaatcatgatcattgatcaaatcatcagaaatcgatactgtcggaacgctttatatttgtacatttttgttgttttgattcatagaatatgtcaagaaattctgttaagcttagcttcatttttgcgggttctaggactgctgcagaacttcctcggaagagtacaagtaatgataaacaccataatagggtgaatatgcagagagatgaagcatctgtttccagtgataaagaacggcaagaggtaccacagcacattcattagcaatttcatatgttttccgattttgtgagattgatataatatttgggccaatttcacgatactatgtatgtggtgtagattgaagtccccaaacactcaatatcccccttttaatacaattttctgtgtttttatattatttttacataagaaactgaagtgaaacacattgtcactaaactagctaaacaatttaatatccaaaggcaatacctgatattggcaggctatcttcacagaaaaatgccgggtcggccaaaggttggccgaccaatttcttaagattggggagaaaaacaaaggaatgttacagcgacattacaatgtcgcgctagtccgggagagatcccagacacagcgtgaacaagcgaaagagaaagagacaccatggatgcagtagttatcatgaagttactgtttgcgtcaatttcgtctttatttttatgtatgctcctacttgttcactgttgcttcttttaatattttgggctttgtgtgtttcaacagaaatatggagatgaaaatggtatatcaaaccttcaattggaagatttgatacaaa

SEQ ID NO: 52527 - DNA, 1501 bp, Oryza sativa
gattgttcggaaaaccggtggattgaatgacaggtaaatagttattaattaaccaactatctcccaatattattctccttaataatgtaaaatgcccccactcacctgctttgcagtgtcttcgatttcgacgacgaaacgatacctaaggagctgcggaatggctttacgtttgtgcatcctgatgaaaaggtggatgtcgtttcagttcatctctcctcttttggtggacacaactcatgtgggtgttccttttttgacaggctctaagtggtgcaatggagagagcgttcaactactacaatagaaagcctgaggtctggaaacagctggtgcagaaggacatgaggatagatttcagctgggcctcttcagcttcccagtacgaagatatctatcaaagagcagtggctcgagcgagggcagcagcatgaactctggcggtttagtgagacctgagcctttctctgacgcggcgcttgatgccacaggcacagattctgccttctgaagaagccgcaccatgcacctctctgatgtgcgaacatggcttcatctgcagcttcgattcttggaatggaacccaagatatttaaagacatgatccgtcagactcatgcaggaagccgagatgttccatagtgcagttatggaatggtcgaagaactaaaatcttggcacccattgtcgtgtcccagtgacagtgtggactatacagttatataacttatagtacgtgattgctcagtcgtgaaatttcactagcctcgatatatttatcatgcgctacggtgaaatgataagttttgttctttgtatcacttgcagtgtgctttgttatttgtgcaaagtcgtgtgtgttgtctatagaatattctttcgtcaaaagcaaagagatgagagacagaccctgttttttttcctgtttgaactctgaaatgtagaaaaaaatttcataggctctttgaaatttttttagagaacactacaattcatgtagaaaatttcatgtttttcttctctgatgtactcccaccgttaaggaaaggggatatttccattcggtcacaacagtagtcaaattttaaattttgaattgattggatttctcttctataagttttattggctgaaaatacctagatttctgtgcattaaatcagtatccaaaaaaaatatgtatgaaaattgaattccagaaatatttatactcctagatttaggaaccaagagaacaaaaatagaccaaaggtagcggaaccaatggtctgggcctggtcctgggcctgggcctgttcccatatgggcctcacatttcgcttcggtaaaaccgcctcatcattcatcacgtccatctatattctgccacgtggcacagacgcgagccgaccagaccagtcaactttctagtttctaggagtactgcagtgtggaggcgtgtccccgcaccgctctcctccccctcccccctctcgcctcgccgacctctccacctccccgg

SEQ ID NO: 52528 - DNA, 1501 bp, Oryza sativa
cttctccccgtccttggaggagggggacaggagcgcgaggatgcggttgtggagcgcgaggcgcgacggcgcgagcgacgggaggggctccgcgaggcgcacggcgctcggggacggcggcggcgtggggggcgtcgcgacgaacgcgtcgcggcgccgcgcccggcgggacgccgcggccgaggcggcgtcggcgtgcgcgagcgggaagagcgccgggacgaggcggcgcgccgagaacggcttcgacagcgacatctcccgcggctgggccggctgcggcggcggcggcggcgagcggcgagcgaggagagggttttggggactctggggctatgggaaaatcgcaaggcggtggcccgaaggcggtgtttggaaaaaatacgccttctctacaaagaaacggattttcgagccacacttcaaaatacttctgcttttctcggggattgcgaaaaaaaaataccaccttcatttcatattataaatcactttgattcttttagtcaaatttatttaagttttatcaaatttatagaaaaatttaataacaactatataaaataccaaattagtcttattaaaataatattatttattttttgataatatgtttgtttgtgttgaaaatatttttatgttatatatatataattatttgcaagaaattcatgctggggggagaaaaacgagcaatttcgagcttcgtatcagcatatgctattccctattggaaaaaaagaatatgcttgtgggaataaatggccatacatcactcttgcatttctttgattgcaaatttccaaggcagaagaaaatatgtgccaggtggagcagtatgtcattgtcaggaacaacaaagaacacaagaaaaatttcccaaaatccatttctcacaaacagaaaaaggaaaatttccgaagctgccaccacaagccaagctcaaaaactccagtgtcgactcgagctcactgggtccaagaccccgaccgcactggccgctccggccacgcgtccgccggcgattggccgcgccggacgccgagacggcgactccgaccacccgagaatcttcgcagtaatatgccaccgtggcgaattccccaaaacaacccctgcagcatctacccctcccatgccaccaaccacggtaataacgtaataacgcgagaaaaccaggggtaattttgtccaatgtgacatcggtataaaataactgaaccacctaatcgccatggccacaccaccactctccagtctccacctccgcggcgatgcggagcagcagccatggaggtgctcagctccagccgcttctctagggttttccccagcagcctcctcagccccgtctccaagccgctcaagcccccgcgccaccgccgccgccgcgtccagacgctatcctcctcgtcctccgatgccgcggcggcgccgtccacgccgccgccagtgtggccgcccgcctcgctctcccggctcctcgccgcggcgctgcggg

SEQ ID NO: 52529 - DNA, 1501 bp, Oryza sativa
ttggtggatttgtgtgtggaggagctacaaagtctgagccgacctatcccttgttctaggctctaaatctggaaaaaatcaatcctcccttccctatgggcaaggtcctccttttatactttaaggggataccacatgcactcttccctttccaaactggacttttcttctttacataaatggacggagatttgcacggttgccctccgaacgtccttctgatgggacggcacatacctacctccacttctgccgggggcaggcgcgtcgtgggaacgtggctgtgagctgacgacatgagcagtgtcagaccggtcacaaatcggtcatccttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgacccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgccatggccgtcagtcatgggcggtctcttcaagactgccgcatcacttgagcagcgctcgaatctaggcgtgcagattcgtttcgtctggagatatggtaacgtcgcttcggtcggcgagcgtaattaacgcgcacacgatacgatctatctcgactgccacaaccgcatatccacctcatgcgccgcaagcaggcgaatggaattagtggaagcgtgggcgcgagaaacgagggaacgagatagcgagtaacgagggagcgagatagtgggcacgagaaacgaggagccgggctcagcgatgggaagggtataaagccatcaaggaaaggacttgctcccttcctttcgccactattcccctttccttcgccgtttgcgccctaaactcactctttgctacgcctcaccttcgccacacacactcgttctcaaccctttctttctccgacgaca

SEQ ID NO: 52530 - DNA, 1501 bp, Oryza sativa
ttgggatagagagtagtgcttaattttttagctataggtttagtgctttaccattattacgtttatgtataataaaatgataggaataagacggaacttatttatgagccagtacacgagtgatgagtcgagtcaaattaaacattttgcttgtaaaattaacaagacgaagctgatccgactttttaattaggagctgtctatatgttgacagaaaaccctataaatcttgcaacgagctcagtccaccctaatcgcatagacaagactccatttcaaaacgagcagagcgtcaaaccgtttcctaatcaggccataaaaggcggttcaagccgttaatcaccacacataccctttaatctctcggtgacattggaggcgcatgcacggcgcccgctgacatgtggtcccaccctgcaaatactgtgggtggggactcgggttgacagctagccggttaaaaaagacgaggcttcccgcttttctcagtaaaaaaaaaaaggctccagtaccacaccagctgtacaaaaagttcgacatggcccactgacaagtggaccccacctcgcttcggccccactcctccccccatcattttttttcccaagccacgttcacctcgccccccaccgacgagccgcacccactcattaaaaaaaacaaacaaggccccacacgtcacactctcaggagcggggagtgggacccacatgtcagtgaaggtgggtcagcctcacctggtcaggcggggtacccgtactgggacggacgcgaggtggtggtggttccgttgggcggtggggcccgcacgctggctcagtcatcagttcgtcacactactcgccttttttttttcctctccctttttctcgcttttttttttttggcccaatttgttttatccgcttcagcgctctcgctgctgttttctttttcttcttctcgctgagctctactactgcactacactaccactctcttcgcgttctctctcgctgcaatggaggcgtagtgttgggaggagggagggagagagagagggagagagggagctagggtttttgggccgccgctgcctccttgagttcgtcgtccctccggtgagtctgcactctctcgttctcagatccggtgagtctgccgccgccgtctagatctgcgtctgctgggcggtgtaggcgtggttcttgggtttttcttgcgcggatttgagctggggttgcgtggatttgagtttgttggagctgcatttcggggggagttagttttctgtgcgagatatttaaccgtcagttttgttcttgcggggtttgattgctttgctacgaggcttgattccgctgggaaaaaaaacactggccttcgcttcttcttgcgtttcttgtgggccttttcgtagatagaatttttgaaaaatgggtattgggtgtagatctgtgagctgatgtgcggtggtattgcaggctccgaacccttgggcgtgcggcagtgtaggctccaa

SEQ ID NO: 52531 - DNA, 1501 bp, Oryza sativa
caaactttggaactgcgttgctagttaaattatacaattgaacacaagtgatagttaaattgaaagtggcaggaccatggaacagtagcctctatcacggtatcaccacagacactccacattatcagaaaataattgggcagaggaaaagttcaggcttggtttttaatccatgcatgttattggcagcccaatttcaggacagaacaacagcgtcaaatcccctttcggtcaaactgaagagaatgcagcacaatcatatgatatagacacgaagattaaattggtaaacacataaaaataaaaatctaggtaacgatctagacacgcatagcgtatatccggagttgcaagcttgaaaagcgggtatccctaaatctccctctccacaggcgacgtgcgggggacgcgattgaactgccagataaaccaccgacgatcaaggatccaagatcttgggttttagggaggagggggcgcacagacctggagggccatggagtcgtgggcgagcttgtagtccttgtagaggaagaagccgccggcggccccggcggcggcggcgccggcgaagaaggaggccagcctcacccgcagcatgaaccccatcgttctcgcgaggcggaatcccttgccttgcttgctcccttccccccttcctctgccgccgctccctgctgccaaaggcgtgcgtgccccgttgtttggtgttgtgctggccgcgacggcgccttgggcttgggcttgggctgctcgggctcgactggctcgtcctgcctgactgcatcgggcccatatgtcagtggttttgctataagtaaaactcaaaatttgtttaacaaggatactttgcagtactgtacttacacagtagtagtcgttataacacagtgttgctgctgcagctgcttacacaaatcactgtttcggccggctgcaccgcaggtccgcagccgcatgagttaagccgaacaggcccgtagtggttgacaggtggacccgatcctatatgtcagcggcagttagccagctactgcatgtgcagtactgcagataatccctactgaaatttgttccatgcaataaaaaaaggggtaaaacacgggcaaaattatttgcatagtagtttggtgaaaagggtaaaacgattaggcatagagtgcgatttaatgttatcttaaatataatacttcattgtatttatggtttcaaactgcaatttactagcctgatgtgatacacaaatggatttttttaaagaaaaaaaaatcaaacttctaccaagttgaaaactccacatcaaagttcatatctatctattttctttaaaaaacacggtttttattgttaataagattcatattcatatattagccttgaatatttctcttggtatgcctcaactcttttccatatacatcatccctaagaccagtatagtaacattaaataaaatagtactccatttgtctctaaatttttggttggatgttacacatct

SEQ ID NO: 52532 - DNA, 1501 bp, Oryza sativa
gaaaaaaaaagtactcccttcgtcccataaaaaaccaacctaggactggatgtgacacatcctagtaaaacgaatctagacatgcatatgttcatatttgttgtactagaatgtgccacaccagttctacattcgttttttatgggacaaagggagtaaattacaatccatactatgtattcttaaaaattcttaaaagttttcatataatattatactttaaccattttcatttacacaatagctaactttacatttttatttggactaccatattctatccatctccaagtccagtgactcagtaatcatttcgcacattaactctctctctctctctccattttctttttccatccgacagttggataaccgatggatctagcaagaaagagcctagatatagcgccttcgctcttcgtcgggtcagctcctgccttccaaagtccttgcaagctcgacatctccgaccttaatagcaaccataacaatagtgcgcatcacgataggggaggagaaaaagacatatcgattactagaggttaaggctgcgcatgtaaaggcaaagaggaggaacgatggtggctcatggagaaagagcgttacgtagagtggcagttagcggttgctggtggtatgaggaatttgttgtcgacacaatcgtttaattttttcctaagtattgatgatacgtgggtcaccagttatataaagaaatagcactagctagttttaaaatactaccttgtcccaaaataagtgtaactgtgaaaatccgtgtcgaatttttgaccgtccgtctttaaaaagtttatgaaaaattaaaataaattagtcacacgtaaaatattattcatgttttatcatctaataacaataaaaatactaatggacggagggagtggtaaataaaaatattgagataaggggggagtagtcttttttttttttgagaaccaggaatttattaaacttagaagcagagtacatgcttgagagtacaattaagggactcaaaatgattagatagaattctagcacaacagtcctttgttggataggcaatatggaaaatgttctgacaattgtaggttaggtaaggggggagtagtcgagtatcgcgtaaaagaaaaagaaatctctcgttgtctccgctccttgcgccgccgccaagacgagtcgcggctgaacaggggagggccgggcggcgatctccatcgcagcggaggggaggggaggggatcctggtgcgtcctctttctgattcatctctctctctcccaccccaccgggactggaatttgcttgcgcttctcttctagatcttctcctcctccttaatttgatagccttaaacctctcttaaataataacagtttgtttgttcacccaaaagtttggatccgcccctgttaatgccgcgtctgctgctactggcacctttgcagaattgcaggcgtagtctggtcgtcgtggcggtgaggtgagggggtgacggcga

SEQ ID NO: 52533 - DNA, 1501 bp, Oryza sativa
atttttatgatcttcaaaatatttttttcctaaactacttatccaatctatgactatatcacaccgttgtattcattgtaattaaatatttacaacaagatatcgcatgattatattttgatgaaagaaaaacatatgtttcaatcagttaacatttgttgtttcatatgtgatagcgacatgtttcaacgtgtatcttcaccgtatttcaccgtaatatgacactgagtttgttaagttctacagtatgtcattgtattttgcttaaattctataatataccatcgtcgtccatttagattccgttagtactgtataattttgtcctaatgattgaaatatccctaggacaaaaatttctaaaatttggccgaaaattccgaaatatcatattataaactaggcagagaagttgcccatctcaaactctttaagttttacaatctgtatgataaaattgtacaatgctaacggaggctaactagacgatggtatattatagaagttaagcaaaatgcgatgccatattagaacttgacaaacccaatgacatattgtagagcagggataaaattagtgacacacaatggattgtctctgttttttatggttgttcagttaactacctatctactatgatgcggcatttttagaaaaagttaaatcttatactataagtccaaatcttacacattaaattacatacacttataatataatttttcaaatataaaatgccctattctcattttataggagaaatatagaaaaatgatgtattatctatttaattatgagaaatatattagtccaaattaacatatatgtagaaaataaaaaataatatgaaagaattacggaaatacgtactaacgtagtcatcatatataatacaatgagaaaaaaagaccataaccgaatgctttattattgagcaaaagtgatggtattatttttatcatcttttagcggaatctatctaaccatagttaatcagcccgtgttagtagaagtctgtatcgtcatgcatcaacatatcatgagattattagttatagctaggtacaccggcataatcatacttagcatatcacgagactatcgggttatggacaattatctttagttgtgctagagaaaaaaaaagtactcccttcgtcccataaaaaaccaacctaggactggatgtgacacatcctagtaaaacgaatctagacatgcatatgttcatatttgttgtactagaatgtgccacaccagttctacattcgttttttatgggacaaagggagtaaattacaatccatactatgtattcttaaaaattcttaaaagttttcatataatattatactttaaccattttcatttacacaatagctaactttacatttttatttggactaccatattctatccatctccaagtccagtgactcagtaatcatttcgcacattaactctctctctctctctccattttctttttccatccgacagt

SEQ ID NO: 52534 - DNA, 457 bp, Oryza sativa
acctagacacataaatcatgagttatttgtgaagaaaaaacaattataaaccctaaatcacgactgattacatttacaccagtaacaaatcacacatagctgcagactctgtaacaaagaacacacccccaacctacctgaatccttactagtaggaaactaaaccaagcgggaaccacaaaccatcgcaatcacaaacctacacagatttgcttcagaaaataaatcaagccgtaattccaccgcaacttgctcccaactcctaaagcctaacccacacccacacccactgcccaccaaagtgctcctaccaacaaacacctactcgcagcaaaccaaaaaccaaaccaaaccagatactagtaaaagaacagaacaagataacttcacaagaacaccacccaaaaaaatgaaaggcgtcgtggggaggaactcacagctccgttcgcggcgtagg

SEQ ID NO: 52535 - DNA, 194 bp, Oryza sativa
attcctgcagcccctctggtgaagcaaccaacagttctggtgataaattagagaaagatgaaactagtcaatgcaaaacatctttccttgaggagccagctaagggatgcccgattgatggtatcaacaaggctgacctaaaagatgaaatcgtgccatgcatatcatctcatcacgattgtgtggctaatagg

SEQ ID NO: 52536 - DNA, 1501 bp, Oryza sativa
ggcatagttaatttaatatgcttcttctcatacgcagagcaacttggattcgatggatgataaatacatgctgagtgcaccttggcctgaaaatgagcagccccagtctgaggtatttgctaacctttctaagaatatgattgtcccagtcagtctgtttgggttccttaatgctgattttcaccaagtactgtttattaattttcactcagagcatttctgatacagtagataagaaagcaagttatgttcatgtcctttaataggtaatgaacccactttagtgcaacatctcatggaaaataacaatcaatggtatgaagcataagccttggtggtttgtttccctgatcatccctagggaactacgtgcctgttgtattttgtgctccgtgctcttatgtttcttcatgaaaaatacaattggtactctaattacttagtattttgccattttactatcttaatttgaagacttgcatgtagggcaccgttttgttgtgtgatatcgtgcagccctaattttttggactgcaggagttcaattgttagcttagactataaaaagttaatgtaatctaattttttagattaaaagattgggtgcccaagtgatttttatgttgcagctagctatgtattaccatgacatccctatacagtcggttgtatctaaaaatttgctaattttggctgttttttttcttgttcctttttttcagaatgacatggatttgttagatggggatacaaatatgcagtctgaacccctcagcacagagcagcctagctccaatgtaattttctatctatttgatcttctctggccctttgtaggcatgtgacccagttatatgtttaatggtgcacacaataagccttgaactgaaatatcttatccaactattctacataaactgtgataaccaggtgcctagagctccctaatattattgttggtggtgctgcaggatgaaatagatatctgggatgggaaaactaagcaagactcatcatcccttcttgacagcaagctgtgcaactccggcgtaagtggcttcacaatcacacctattactccctacaataaaatgaattgttttggggttcgtgcagtcaaactttgtaaatattagctgctaatgtgtctccagcagtattttagaaactatgcttataccatggcttaaaattatattataagtttataaccaaattaacagccaaagttatgttttagagactgttatgttcaaaacagttatgctaatgccattattttaatctttcttaaactgaacaaattggattgataaaaatgtttaacagagcggcgctgaaccttgcaacatggagggccaacaattttctttgtccttttcccgcaacactcaatctcaattggtggtatgttttatgcaatatcttcaaccctaagacttacgtatgctaatgacatattcaataattttgttatttttaaaatttcttcatatgcagg

SEQ ID NO: 52537 - DNA, 1501 bp, Oryza sativa
cgatcgccaccgctagcagtagtgttactgttggtagctgttcgccaatcagtcgcttgtgggacacgcacgctcggctcggtctcgcccctgcaatggcgcaagcgtccgagatttggaaccctctggatcccgaacgacgcggccgccggccacctcctctcccgatcggtaggcgccccgtcatctcaagcgtgtccgattgtccatgtggctaagtgacgctcccctcaccgcggctggattcttgcggggtgatcgacgcgacgcggctgcgttttgtttcggtggaaacagtggcttctgaccctcatactcctaagttctttattttttctcctttttttttcttttcgttaatccggtacaaaggcatgattgtgtcagcgacattatacagaaccacgatagatgtctgacgctccacggtagatgcatcgagtgaccactgaccgcagccgggggcgtctggtcctggatccctccctgcaagcaaaatggaccgatgcagcttttgtgcacgcgacgcacaccctccttccaggagtactagagaggagaaaacacgttgagcaaaggtagtagtatttcgaaagtcctatcccccgtcctccacgtggtttcttttttttttcaccgcattactttttaattttagtaaatttatacacctaaagtttatagacccaaagtttataagtcaaaagtttatatacctgattcaaatttgaatttaaattatatctggttcaaatttgaacttgaattcaaatattttttatatatagtatttctatacatataaagtttataaacccaaagttcataagtcaaaaagtttacatacccgttttaaatttgaatttaaattcaaatattagtttatagacccaaagtttataagtcaaaagtttacgtacccgtttcaaatttgaatttgaattcaaatattttttatatatagtatttctatatataaatttttccaactttgttttttttaaaaaaaattatggtgtagtaggaagagaagggaaggaggaagggggagaggagtgtataggccatatggggatagggatcgagcgatcgatcgcccattagccacccccgtagtatttagctatttgccttgctcatccaaggctgtggtggtacggcaaaaagcccacgggcaccgtccgatcctatcagccttccgtttccactcgatatcgaaggccctacaaaccatgggccaagcgtggagcaggtaccattgcccactagtggtctactagtgcagatcatgtgccatgactaaatagaacagtgcgatttatttcagctgggagacaaaagctgggaattttttttatttttaattttttttattaaaagttttacaaaaataattttccattttaaaaattgacggaagtagtcgcctaccgccctctgggagggcgatttttaaaaatcgccatcccagagggcggcgaaaatgacgtggcagacggcc

SEQ ID NO: 52538 - DNA, 1501 bp, Oryza sativa
gatgcctcgtcgtcccgtacggctgcaaccaggcaaaaaccggcgcggtgaggccaggtccgcgcgtgcgcgcctcgcaaagccgcgagtcgtccgtccaccagtccaccacacgggcgggcatggagaatggagaaagagaaaaaagaacaaacagcctcggtcccgtcacaaaagaccgacatgcggggcccatgtaactgaccccgacacgcctcattcccaccccgcacgtgcgccggcagccttatctctcagcgcggtggccaggattctctgcgtccagcgacactgtgaatggatttgcatattagtagtacactttataaatcttcgaattcatcatatataattttcataaatcttcgaattcatagtattactccaagcatgtcatactccctccgtcccataatataaggaattttgtgtttttgcttacaatgtttgatcactcgtcttatttaattttttttaaaattattatttattttatttgtgacttactttattatccacagtattttaagcacaacttttcgttttttatatttgcaaaaaaaattaaataagacaagtggtcaaacgttggaagcaaaaactcaaaatctcttagagcaaagataataatatagccaacctgttggctataaggttctttgtagccttctcttagcctactcatataatagttagctctttacgattaatacagggcccacttgtctttctcacagagtttattagttcttatgttcaagccggctgtaagtttatagcctgcttgtcctctctctcctctcttttctcctccatctcagcatttagccggcttatagcctactattatacttgctcttatatcgtgagacggagggagtcaattcggatcctctactgtagaggagaaatttcagaggtagctacagtgcccggcattaggagtactgtgaagcgtccgatagaagatggatggatcagatgagatgctacagtaaatctgctacagcactaaccagaggtgctacagtacattcatcccctgtagctacagtaaatcgtgactgtggtgtgcattagaacactgttcccctcacatattagtgtagctatagtgaccctctacattactgcagaggatccgaatccggagggagtacctcaaagtagggttttttatgggagtacattgttttgtacgagtgcggtgttcgcagaagatctttttcatattcctcagctgctagccgccagctctacggatggcacactcgtaaataactcgggagtacgtgccggtttggtgcgctcgcgaaaccacaagccgttagtagtaagctccggtggtggcgccttcattatggcctccgtctcgctctattccatttccattccgttctacagcgacgttgtgagtaacgcctcctctctctctctgagaagcgcggagcggagttaagagagggagagacgcagcaaccaacagcacgcgcggggctga

SEQ ID NO: 52539 - DNA, 1501 bp, Oryza sativa
tcctcccggatcccccaagccaagcccggggagccgggccgccgccaacgcgcgcggcggacacgaggaagggaaacaggcgacgacgagaagagaggatcagctgggggtgatgaattgttacgctgcatggacggagcaagcgagaagcctccccacaaggtacgcgtccccccgcgattccggttgtattattcccgcgcgcgcgcgagagagagagatcgagtgtttgagcttcagttcgtcagtctatggctggatttggttttggtcgtgccgcttgtatagaaggataagagagctgtgctgcggctgcgcgaaccagttgttttctattattggagtggccgatgacttgtatcttcgttcactgtggccaggaaaaaggtggataggccttcccaataatttgttggttggttctggaccaaaccttttttttctcctggggcattttgatactgtgattgatggctacaaatagtactggagctactgtggtattgctttgcccgcggtctcgctagtggacagcatatgattgtttggctggtggccagatttagtcatggtcaactgtgccgagtggccgaattccgtatggtggatttaggttcatcttcctcgcgcaaatgtttctaggttcttgattaatgcagcagcacaggatcgacatttaacctatggtctgtaatcggtgaattgagccttttagtacaaccctctcactgagggtttgagacgaagactggtgtttaggttcaatctgtggcaccattgtattgtaacggcccgtcaggtctccttgtcgaacaccaccctacaatattataggagtcctgttagctgtttcttttttaacctgaacttttgcagccatttggaaaatgctgatcaatgcattgctgatgtttgtttttgcttaaaccaatttccttaccttgatgtcctttattcatctaagacaaatgctgtgaattgcacaaactaggttctactttcttggcagatgcgttgctttgtctgtactattcttcacagcaaatgttatctactgacgaagtgaaggaattattattcaagcataaaacatctattaatagagtgtggccttgtgggtggttaaagggtgcaaaacaaccaaacaacttattactcagcatgcgatttagtgtatctttatttacaagacatcggggttgctaggcaattcaagcctgtatattgccacttgtatgcttcgctatggtatgaactcaatatgtgttattatatggtttttacaactctgttaatatgcaactcacctgcgctgtgagctatcatttgggcacttaatcttaataagtcatgctaatccaaaataaactcactttaccgcctatgtactcgtgacgtggactaccgtgccattcatattctgaaaagtgtccataatcaattatactatttcttgcacaggtacacttttttttaatacgtcttattcattatattcatt

SEQ ID NO: 52540 - DNA, 1501 bp, Oryza sativa
gtacatcttatttgtccatgagcttcttcagtactttctttgaggccaattggatgcttagctgtttcttttaacacaactatggatacggcagggcatctctctgttctttgtaacacaacaatggattctgtcgtatactaatgtatttttgctgcaagaaatgcatgcacgcagtttccagatgtagttcttggcttctcaccgaaaaaagagcaacagtttcgtggtgtttaacttgacacaaatacaaattaagcctatcctttctcatgaacgcctgacagaagtagatgacagtaaaacataacctcacatattctgtacatttagtccatgcagtaatatagcatagaagagttctggtgttatcagttttatcacagatctgccatgatgaacatatgctgagattaaaatgtgcttagttcggatcactagttccagtttggtgtttgatctcgaaatctccattcaagtatgtgttactcgtatcaagggagcactggagaaattcttttgatgcatgttttgattatatagctagcaattttagcggtacgccctccattcaggcacatgggacaacgtccttatatctgagttgcagtatatattttgttgctggacatggttggctgcctgttattataaactggtaggattagcacggagggttgaagaactcaggattctttactccgttgttattttgggatggagtacttgtttgccatcagtggaaggaatgcaggatgaagctagaaagagatgcaaaattttttcccaacggaaagttctaccagttgagttttcctggccagtctttccttgctgtgctgaccttgcaatcatcctctctctctctctctctctctctcaagaaaaaaaaaatgcaatcatcaagcggttcctttctgatttaaagttctggcctgtaaagcgagttagcgtgtgacgctggtgtttataccgtaccagcatttggaattttttttatttttattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccttcaacgaaatttgcaggcggcccccttgccgccctccgctagggcgattttgtactgtgcggagggccgcctgcaaatgggcggcggggggcctggaattttgcaggcggcccccttgccgccctgggggagggcgattttatactgtgctttatatttttgtataaatataaatagttatcaaatctttttatattgaaaactatacaagattaaaatctccaagacaggtaaaatacaattttattattttttagggcctatttggaatgttaccgtacaaatattttgttagtgccaaaatataagcaagttttggcactaccaaatatttggt

SEQ ID NO: 52541 - DNA, 174 bp, Oryza sativa
cagtagcgcatcatcgtcaacggagttgggcagcgcgagggggtggcggttagtggaatcggcagccggtgatggtgaggggatggatggtgtcggtggtggcggctgacgaatttgaaggtcgggtcggcgagggtggatagaggaggcagcgacgcataggcggagcagatc

SEQ ID NO: 52542 - DNA, 1501 bp, Oryza sativa
ctcattattagggcctattttgtgtgggcctcactatggaaaaaggatcgaaacgcacaatgggccttgtcactccctgcaggaatatgttctggaggtctctcaacttaacaacgagatttgttgaggttccttaaccacaaaaccagaaatgtatatccctaaactcacataaatcatgcactcaagatcctatagcagtatatatgggtggtttcgctggtatcctagttaaaaaaaaatgtgaggcccacatgtcagctgcacatcttttttcttctctgttcttcaccttctcttctcttttctctcttctctcttctcttcttcagtgagggaggccagcgatgggcgagcgcagatgcgggcggcatgtgagcgcgacagcggtcggcgggtggcgagcagagaggcttgggagggatggggagttcgccggcctccctcactgaagaagagaagagagaagagagaaaagagaagagaaggagaaggaaaatgatttgtaactgacatgtgggctccatgtactttttttaattttttttctgactaggatgccatgtcagcgaaaccatccattatactgttgttggaccttgagtgtatggtttatgtaaatttaaagatacatatttttggttttgtggttaagagatttcaaaatatctcgttagatcttcttcaatgcttggaattaattaggaccattgatctgcaatgatctaacggacagaaagagaaggtacctgaaaaaatgtattaaaagggtgagccaggtatggaaggtgggagggtaaaatggtaattgttttttattaaatttttttcggtaaagggcaaaagcgtattcttacaaattcagaacttttgagagaagcaacaaacgtttcagcaggaggaagaaaaaaaaacgagaggaagaattagaacgctcgcgtgcgagaggaacctacatgatctgctggttgtcgctgtcgtaaaaggccgccgcttgccgaggcctcacacgcccgccgctcgctgccgccgtacgcgcctacgaaagcagcagctggacaccgtcgccgccgccgacgcacgcgcccatagcgcccaccggtcgcagctgacgtacgcagcagtaggtcgccgtcaccgccgacgagcccgtcgcgccagccggttgccaccgtcgcacgggctggcttggttgattagggttaatcttgaatcaacggtgcgacggcttggttgattgggtgacgggtgggatttgagcaattactaagctacccttgttaataaaaatttgtgttcctaaattaccctttaaagattaactgtggataacaattcgttaaggagatacctagggtacctttcaaagcaccgtaaaagatctcatatctcgttgttcctcctgttaactcgtatcacctccctccctcactgaaccaatagggctcgtatcaccggtggactcctgtgggtctcacgtgtagtcaaacttgccttgtgc

SEQ ID NO: 52543 - DNA, 1501 bp, Oryza sativa
aatttggttacaacaacagatcccttctatctaactacaattccataactggactccataatcatcaagaaatcggttgcaacaacagtatttgccgcgcaaacaaagaggtgtaaaacataccgataaatctttcgccttggtagagccggacctcgatgacttcttcccgaagagcacggatttgatccacttcgccggagacttccccattggagcctacactgccgcacgcccaagggttcggagcctgcaataccaccgcacatcagctcacagatctacacccaatacccatttttcaaaaattctatctacgaaaaggcccacaagaaacgcaagaagaagcgaaggccagtgttttttttcccagcggaatcaagcctcgtagcaaagcaatcaaaccccgcaagaacaaaactgacggttaaatatctcgcacagaaaactaactccccccgaaatgcagctccaacaaactcaaatccacgcaaccccagctcaaatccgcgcaagaaaaacccaagaaccacgcctacaccgcccagcagacgcagatctagacggcggcggcagactcaccggatctgagaacgagagagtgcagactcaccggagggacgacgaactcaaggaggcagcggcggcccaaaaaccctagctccctctctccctctctctctccctccctcctcccaacactacgcctccattgcagcgagagagaacgcgaagagagtggtagtgtagtgcagtagtagagctcagcgagaagaagaaaaagaaaacagcagcgagagcgctgaagcggataaaacaaattgggccaaaaaaaaaaaagcgagaaaaagggagaggaaaaaaaaaaggcgagtagtgtgacgaactgatgactgagccagcgtgcgggccccaccgcccaacggaaccaccaccacctcgcgtccgtcccagtacgggtaccccgcctgaccaggtgaggctgacccaccttcactgacatgtgggtcccactccccgctcctgagagtgtgacgtgtggggccttgtttgttttttttaatgagtgggtgcggctcgtcggtggggggcgaggtgaacgtggcttgggaaaaaaaatgatggggggaggagtggggccgaagcgaggtggggtccacttgtcagtgggccatgtcgaactttttgtacagctggtgtggtactggagcctttttttttttactgagaaaagcgggaagcctcgtcttttttaaccggctagctgtcaacccgagtccccacccacagtatttgcagggtgggaccacatgtcagcgggcgccgtgcatgcgcctccaatgtcaccgagagattaaagggtatgtgtggtgattaacggcttgaaccgccttttatggcctgattaggaaacggtttgacgctctgctcgttttgaaatggagtcttgtctatgcgattagggtggactgagctcgttgcaagatttatagggttttct

SEQ ID NO: 52544 - DNA, 1501 bp, Oryza sativa
ttacatattttaggcttttaggaaatatacaaaaatcctccaagccttatttgacttttaactttgcacattttaatttttggaggctttcacaaggattttaattattctaagcataatttaaaggatatattttagggtcattttgggacgtgacatggcagcaacctgatcttgggtcaaccgattcgcaacctgcccgccatgttgtggctgctctctcattaacaaccgagggttcactggctggcctggcgccattgctgatggagcaggtaggggagttgatgccagtgccgtcggctgagatgttggtgcaacagagggaaccgcctgagttgatggctgaacatcggtaatcaaagaccgataatttggaaagacacctccttgcaaataaaccgggcctacaacctgatgctcagctattgaaccatcggctatggacttcatcatgtttgataaggtattgactaacaccccagattgattgatcaaagcatgatgcacagcgtagtcaacccgatcttggaaattactgaaaaaatcttgtgccgtatcactattctgattaagatctcctccttgcaacccctgggcaccaccaccttgaactccatgcaccccgtcaccttgcactccatggactccttgagaattgtcaccttgatttcctagagagctgtcggtagcacctttgttactcagctgagccgagccgtcttcttaactccagtgcaggtccaaagctcaccttcgaatgtatgagcgtgccagttgatttgatcctgtaatcaacaagaaatagaagcaaagaaaccgcagttaaatctataaatgatatcctatataatctaagtcaacatcggtatttaacctaatcggctgccttctattgacggatgttagccgattgtaggttggatatcgatattgccaaggattatgtaggatatatgataactcgacgaattacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaaggtggcgatgcaccgagattgtattgaacgtgtgtgttaaaagatacatagtgctcgggtctatttatacccgaaaattacaagatatgtccataacagacacgacaactatctctaacaaactccaagataccataagtctttgcggcagacttttgcccaagcatatctctaaggaaattatataaaacatcctaattaatagatacaattgacttctcaggactctatccatgtgcggcaatcaccttgaagcacctcaattcaacccgatgtcatacatcgagttgcattgtcggaatcggctgcatcggcttacctagcccaactcagacccagccgatcctaatcataaccgatctggactctagccgatt

SEQ ID NO: 52545 - DNA, 1501 bp, Oryza sativa
gtagcacctcggccatataaggaccggtcttcgggcctctattgcaaagcactaccatacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcgtgcctacctgtcccgggggttccagccgtaggtggggttgggtcggtactcttgtctatgactaggatgggttggaaactatgtcacgtcttccgtccgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaaggtggaacggatggcctgggttggcttgggacgagctgggacccagggtcgggttgccagttcggtctgaatcatcgtaggccttgggttaaggcaggctcgtgtgggttcacagccttgtttaataatattgtatagctctggaaacgtgtttacaaaatagctttgagcaactaagtgtcttttaaggctgtttactgcaaaccctaaccctttatatcataacccccttgtactcctttacatttatcctgcacttgtgggtgtgtcttgttgagtacggtggttgtactcagtcttgctcaatttttccaaacccagaagaggagtccctggaagatgaaggctttggtgtctagctcgtgcctgccgtcaagcgcctgtggtcgtcgccctagtcttctgctgtttctcgtttgtctttgtgtgtgctgggccctcgctgcccatgtaataaattaactatttacgcttccgcttgataaactctgaaatgtatcaacttttgatgtaccttgcctcctgggacaaggaataatacatgcacgtaaggaatgcccgttgggttaattccggtcgtgacacttcatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaatggtttattgcgtcagccgagagggaggggcgcgcggaccgggtccacgggagtggggcccacgtggcagcctcacggtccacggtggaccgggcgcacccgggctcacatcgaccggcgctgtgggtcccacgcgtcagccacacccgagggcgcgggcggctgacggccgggcctcacgcggcggccactcggcgcgcccgaaggcggcca

SEQ ID NO: 52546 - DNA, 1501 bp, Oryza sativa
cactaggcaacaaacattgtttgtactcaacattttccaggaccatattaacctcgctgaagtaacaggtgaaggatccaagtccacataaatatcagcccaaatattcagacgctgacaggaacaggaacactcacaaaacataaaactttgatctcgctgcaaggagatgatatgccaacaacacattataagaaaagacactgaagtgactgtctgattcattgattccactgaataatacggagtacacgataagtatttacaggaatgatacgaggtagcgtatcaatgcacattaatcccgatcaattggtctcatctgctgtggttttcttgtccagcgatgctcatctcggagcagctagcgaaaatgctccattgtttggatcgtttagaaatccttccaaagcagacatcgatcaaggagacccaaacagcagtacggcacctttcagcagggcatccggcaggacatctctgggagcgacagatgatgacgacgagtcgacgatgcgcttgcaagccaaacagaaaatatggtcacatatttgattggcaattgcaaaggaactcccatagatcataaaagaatacatatcttaggcacgttcttttgaaggaatgaagaattgattaatacaacacgcttctcaagttgctaaatgatatgattataaaataaatcttaaatgactatttaaatcgattctttcaattttataataattaatctattcatttctactctcgaacagtgattacaatatcattctactatttgggaaaaaaatgcatgtgcgcaatcaaagtacttcatctatttcaggtgataaagtgatttaattttagttaaagttaaactactttaagtttgactaattctgtagaaaaaagtagagtagtaacaaatcatatgaatacattatactagacactttattgtttaaaatatatgttttaggtatatgaaaataatatagtcaagtctatcttaatgaacattacataatagtacaattgtaaagtcttttgacatttataaaagagaatttgttggtgttatgttgacttttttttgggaacattactcccgcaaaataatatttagaaaaatgtacttcgtgcagtttttaggggacttagtaattaattaaaatatttagtactaataaccttcaattatatagcacattgcatttaggcggcggcccagtcagttgcccacccgctcaagaagccagcgaaaatggcgtcctcttcctcctccgcctcgtcgccgctcctacctcgccgaggccaccagctccaggagccagccatggccgcgtcccagatgcggtgcgggggcaggagggagaaccaggtaccagttcttggccggggtggagttgggttcccttgcatttttgctcgcgttcttggatcaaatcggttattattgctgttcttgttgttgctgctgtctgattctgaaaattctctcgtctgctccgggtgg

SEQ ID NO: 52547 - DNA, 1501 bp, Oryza sativa
gaattgagggtttgcatattgatttgctagaattagggtattttgtgagggataagggaccgagtgcataaatttaataccaacaaaaggtgtaaccaaaactggcaagacattgatcaagccagtaaaactgaaatttcagttaaacaggtgggtttctgccatcttagaataagggggtcaatgtggaagggaaggccagaagctcaatgtgcctggtcgtacagatgcacactctatagccttggcatgcgtcttggacaattttaagcaatgtatgctttatcatctcaaagttgatgatttctagtaatgctgattgggtgaaggagttacatgggtggagagagctcctggaggtctgcgaggttgagaaagaacatgagcatgggacttgtcatggttgtggttgggacgggaccaaacaggtttttgtggctggcccagccaagcattagtcaacatgcatgcccagcccttgaaattaaactgtagatgagaacttgttaattgtgaatttgaagaatgtgagccagtgatgcacttagctgtagatcattgtgctggagatttggtttccagcgcattccatttacaactaccaaatggctgaatcttcgatgtttgtttgaaatttaaattcaaggatatcgttgttttgacggctcaaacttcaaagtaaacgtttgctgctcattggatgctggttataagtgactagctggatcttccaaaattatcttacaacggtaaacttggatcgtgtagttaagaaatctgatgttcgttatattgcttattgtaactgggatttgcgtattgggttaattaagcgaagctatagtgtgtttaattgtgtgggacacttggagaagaacaaaaagcttctgtttctgttcctcttgattggtacaaggattgttcttgtattggaattgaactaagaaattatctgtgattgctttcttgtagttgtgatctgaatctttcctttgctaatgcaatttttgtgcactcaatatgtggtcaataaatcttatttctagtgtattcagagaataaaacaaaggacttatgtatctgctctttctgatgatagataattcttttatcagtattgcattttagattttaggttgagacattgcccggaacttttcttttgcctatttctgagctcttatgacctctttggcattgtaattgtcatgtgatcctcctaatgatgttttttttttccttttgctacaatggattgtcttcatgtattcgacgtgcatgcaataggcaagaacacatatcatcatgttacttgcgattttgcctttctgccacatttcttaaatcttgactttaaagtttgacagaggagagctaattttaacaagatttcaccttgtccttgcagatgtattatgttaaccaggaacttactgttgaggatttcctttatgatgataattacaagatgtatcttcctggatacaattcagatgttctc

SEQ ID NO: 52548 - DNA, 1501 bp, Oryza sativa
atatgggtaatatcaaattccgggtgatgtttggggtgctttttgtagtttttcctgtatgtattttaagtaaagaaagaagtgtgcgtggaaagcactcagccttctatgttagactattccttcatcactaatctacaattaagggcttgttcagattgatgacattttcaaccataccatatttggtaaaattgacaagtatgtggctactttagtttgttaccaaatattagcaatgcgtatagaattttggcaacattattaaaccaatcctaccaaaattttagcaatgttactaattttaccaaaattttaacattgctaaattttggtaaggttcattttggcatcaatctaaaccgccctaagagtagcatttcaattgtgggtcatacagcctaagcacacctattaagcctacaaggccttctcagatgggcctcattctcggcccacggcgtggacaagactgttttgtccctaattttccgccatattttttggttggtcggcacctccacggactccggagtccgctcggttcccctcctcaagctcgcctcctcctcccctcgcgccgtcgcgcgttgctgctgactccggagcaaaatcgagcgagcgcggcggatcaggtggtgctctccctgcgccgccgcgcgcgcgccctgttggttttggaacgagcgggcagggcagggcggagccgggagatcggagaggagcagagaagaagctggccatggggtcggtggagcggatcacgtccatgcctcggcggcaggtccaagcccgtggtaagccgcttctttgctccgtgcttccatggccctcttcgttgcactgtattgtgtacattgtcctgacatatagcttgttcagttaaatcagtaatcaggatactgctatcctctttttttttctttttttttgaggaagatatcttttattcttttgagatgaagtatactgcattattcctattgttccgagagactgagacagaagaaaaagtttggtttttcctgactgagacagtagtagctaagtgattcgattagattagctagcttaaaatctgagtacctcggaacgaatgttgctttcttttttctgattgcgcacttcaatttgcactctaccacagaagaataacttgggagggttcttgcccaaaatttgcataagagaaacaaattttatgtgtgcattgtactctcaattttacgctccattatcatcggtacctgccataaccatgatcacatgatgtattgcagatgggtcggttgcttcattggctaaacgaacgggctcaccctgccaacaggaagatgattatgaaggtgccaaaactatgacaaatccatggaccttccttccagaggtataaattttgcatgcatcattgttcacttacctttacaaatgcgatgttgaactgttctctgactcttgtgttttcaggacatctggtatcatatacactccttattgccac

SEQ ID NO: 52549 - DNA, 1501 bp, Oryza sativa
tgaaccccaattacatgcttgagatgaaagcatcttgtagcaatattcagctggttcgttatctgttctgctatgctgtcgatggctaccaccatttttgctacagcaacgagactactggtacaacataagttgatagaacagcagatgcctaaactgatgaaagttgtcgattgaagtggcatggagccatcaatggttcgttctttgatgtctggtctggtcccaactgtctatctctgaaagagaagttattcctttgctgtccagctcctgacaagcctcccaagattccgatgggaccattatgttgccaatgaaaatagcgtcactggatgctcgttgatcgtgaatagaggctttatcgttccgtgaaaatgacaaatatctgatgatatatcggtacacatcagggattcagggtccatttcttatgaatggaggaagagtcattatttcgataaacttgattctaacatacacatctcccttaatttcctaatcttgggctgtgtaatagacgggaagatcttacgaataagacctcttttagactcctttggaacacatgaattgagaaaaaaaataagaacgagaaaaaaaaatcataaattggacgtcatgatatacacaatcttgtaggtattgaaatcgcattgaaattaaacatatgtttgaatattccacaagaaattgaataaattttaggggaaaatattattagaataaagttaagaggagagataaagtgccttctacttttctaaggaaataaacacaaagaggtttgagctcatatgtttgaaatctaaaaaaatgagggaaaaatgattccaaataaagtttgctagtccaatatttcgatgggggcccttattggttgcccatattttctaataagttgtttaatagcttattattgaataaaagtcaataaaagtttgtttacaggtaggatttgatatatgtgttcttttagcgacttaaaagccaatgctgaaaacaaaactacgttgaaaatatcttaaaattaactccaaaattaagtttaaatttttaaattttagctttggtttttggcttattagggcaaccaatgaggctttgagttatttgcaaatccaattctttaaagaaaactaaaaataaggggtttaggcccctttgattcaaagtaaattcatagaaattttagagcatttcattcctataggaatttttcctacaaagccctttgaatcaaaggaatgaatcctatggaatcctatgaaattcctatggaatgccttttcccatacaagttttagaggaaatttaacaagaggtaaaacctcatggaaaaaatcctttgagtctttatctcacctcaaaatcctgtgtttttcctgtggtccaatcaaacggttattcctatgtttttcctgtgttttgcaatcctctgttttacacttatattcctatcagaatcctatgttttttctattcctctgttttttcattc

SEQ ID NO: 52550 - DNA, 1501 bp, Oryza sativa
tcgcattatcaggagggctcttggtgaattctagagaagcccagccttctttagccgatgcataaagaactgggaagtctaactgttcttctgcaaaacccgaataaaatagtgtcacatatttatgaaaaaacttccaaggcaccaaattgaagtactagaaatgcacctgtagcaccaagatttgcaaatagatcaaacaccaagctctctacttcattgcaggtctcttccgaaactgttggagtataattggttagttaaagagctatagcaaacataatatactagggatatatatatatgccaaaaataatgaatataatgctttatctatttctgagctggtgtatcccactgcagttggccatttttactttgtgggaagtgaatatatcgcagtagctcatctttcaaacaaaattattgctaacgctaaaaaacattcaatgctaataacaggctactcaaaaggaaaggccttctaactaaaaattacatgactggatatttctctttttctgtaaacatagaaaacaaaaggtagcctaattttgtgacgggaaatggaatattgtgtcattttggataaaaattattgtgtatttacccccaaagtatatgtttctgtttatctgcttaaactaaattacacatcaaaacttcatacttgctcagcttaagatcgtagcttgattcatatctaagacaattgaatcactttgttatgtacatgccatccattgctcacaaaatactgccatagtgagcagagcatctgagaataagcaaacctgatggcctgtcaaccttgttgagaaggagaattgggcgcaagccatacttcaaagcctttgaaagtacaaacttggtctgcgctaaaggtccctccccagcatcaacaaccaagaccgccccttcaaccattccaacaactctctcgacctgtcacataattggtgaggatcatgtcagataccatagaaaaatcatcatttcttcttgttcttaactgtatgaaattataaaagagtgctgagtgtgtacttcgccaccaaaatcagcgtgaccaggtgtatcaaccatgttgagttcgttctccttccaagagacagaagtgacctacacaaatagccgagacgaaaaaagtgagatgccacataaaaagttaccatactgaatgctatgcagctattggaccatcaatgaagaagtttcaacaaaaaaaaaaatcagaaggatgagataatgattatctcagcagatcagatttcgggagtgatttattgaactacaatagatgtgcaggctttacggagtacagaatgagcagagcagttgaaccataagtgacataaatcctcccagaaatttacttacgcactgaaatctgccaaggtgctcagcgatgtataacagggaaaacagtagcgcaagtttgagaatggcctttgaagcagatctcacttccttccccaagccaacattctaatccctcacg

SEQ ID NO: 52551 - DNA, 1501 bp, Oryza sativa
ccatcgacgtcgtgccggtgcggcattacgtacgcgcgcaaacgtaaacgagagtgagagtggccgaagcgacgacgagaggataggggcagcgatcgattgggccaggccagtggaaccttccaaagccacgtacggagacagcggtcgtcgtcagctcgtgttgttcgcgaagggccaagagcgttttctaatggctactacttctagacacagcgggcagacttgagctacccgctccctcgacgatatcggtcaaggcctcaagggtcaaaggagcattattgatccatccgtttcataaaagcaacgtcgtaatatagagtgcaacccattattcaaatttatagtagtagaatatgttatagcccgtgttttatttttaagagtgaaggagatatatttgactgtcattaccggatcgatgtggctctctctaataatcacccatcataaatgcatctaacaaggttatttgtgcatcgttgcattctcaagaacgtggcaactcgttagattaaatttaaggttatatatatgtgtcgcactatcaaacccagtggagcgcgcaatcggtaataggctcttccctgtcggcctgttagaccattaacattgggagcatcgatagttcgattcctgatcaaaagaacaaaagggaaggggaaaaggaaaaagaaaaaaaacacgtagattgcgcgaccgttgacgatcttcggcaagggtatagcacaatggtgttttggaaagagcgattcatcgaggtagcagtgtatgcttaagtataagttgtcatctccgtgacacatgctttatttttctaagatcggatggagaggcaagagggggatgtgagggagggaagacttgtattcgattctatcggccgacaagttatgctcgtgcgggagtagtcatccatttcattgcgagttccgtcttttgtgtactttctttatcacaaaatttaaaggatttatagattcgtattaggatgtatctatctcatgtatttaacatctctatatgttaaagctcacttgtgataatcccttagggtgtgtttggttggtgggatatatccggataagacatggctgccactttttggagggtgtttggatgctgggcgagagtgggatagggcggcccagaggggaatattccctccagatgctggatagagggatccggctgatttggccggatgcaaccgctcgaggctcgggtgagccgagcaagcgagttgcgtgactcgcgtcactcctcaccaccacgacgcgagcgaggcgacgagcgcggcagccggcgagaggggcgacgagctcggcggccggcgagagaggcgacgagcgcggtggccggcgagagtggcgacgagctcggggcggcggcaggaggaggcgagctgcgcggtgggaggaggcggccggcggcgggaggaagccggtgggaggaggctgccagcggcgtcggcgagcccagatctggcgctgctttt

SEQ ID NO: 52552 - DNA, 1501 bp, Oryza sativa
ctccatgtgacaatgtgcaaccttggcaaacatgcactagtggccactgatcagtgatgtgctactgatactggaatcgtgtagttgttccatcataggagagaagctaaactggaagatgcaatggaggacaatatgttgtgcaaaaaaatagaaaggtcgaatcattggtgccaattgccaaagagtaaccaatcatgctgccaatagaccattggccatttcttttaatatattgcaattgttctaccttggcatggcatggacataaaaattcaggaagcagagaagaagaggcgtatatgcaggcatcagattatgagtgacagatcgccgcgtatggttctgccattttcttgccatgcccatgcgtttgtggatcagaaagatcagaaaagagaagcttcaggcatatgcatgggtgaccaatggaccagcgcaattgcagaagaatcgttgggatagtgcaactgtgcaaggtgataacggcacgcaaaccaataagggattgtgcgtacggcatggtactgctcctgcgtactaaatgcaagataatgatagaagtaattcctttcggaagaggaagtattagtattattgaactgcacaagataaagtagtagtaaaactacggctgtgtttagttacacgtcaaaattgaaagtttgaaaaaattagaacgatgtaatggaaaagttgttcatttatgtacctatgaaagttcaatgtgacggaaaagttgaaagtttgaaaaaaaaagttgaaattatacagccatgtcagggacaagaaatcaggtcgtgtttagatttaaacttttctcttcaaaattctaacttttccgtcaaatcaaatgtttcgacacatgcatagagcattaaatgtggacgaaaaaaaccaattgcacagtttgtatgtaaatcgtgagacgaatcttttgagcctaattatgccatgattttataatgtggtgctacagtaaacatttgctaatgatggattaattaggcttaatatattcgtcgcacagtttataggcggaatctgtaatttgttttgttattagtctacgtttaatgcttcaaatatgtgtccgtatactttaaaaaaaattagcacacgaactaaacacagcctcagacgtctgatgaatttgtaatgcttgcatttgcttgtttgggggcatgcgcatcgcgcaacaaaggccaaaattaaaactattagtatagctaccttttttttttttttgaaacggcatagctaccatttttatgtgttagaggtgaaattctttttattgctgtagcatacaagttaaaagggtccttttattctcttgcgtaataagcctgatgatttcttgaatacccggcactagttttattggaagagaacgtgatccgaccagatgcatttgtgatgccctgaccacctaaacttataggccaaaagacaaggtaatcatgtctggaaagcggggggtcaacatggatagccaatg

SEQ ID NO: 52553 - DNA, 1501 bp, Oryza sativa
ggttcgtggactgagattctcgggaggcttttatgttttttgatcgaatggttcgtggtttctttgctggtttgtggttattttatcttcttggagtatatgtttgtcgagataattgttgatgtaaatgcagtcgtaaagctcttaaacgaactctaccaacagctcttattccgaaaaagtagctaaactgaaggatgaagaactctggttgggcggccgagcacctgcagcatcggccactgccttacgagtacttttcgtctgtgaggtcgactcgacatcaacccttgtaattccgtctgtgtggtacacaggatttgttatttagtaattgtaaccattcaaattatctactgctattcatttaaagttttcaacttacctagaagtgttttttgtcgctcgtcaatcgtcatgataacgaatgctcatacaacaaactgaaccagacgatacggacgaaactgcatgaagctagaatagctgtgtgttctagcagtgttgtctcgtagtaatactgtacgtaccagatcgtccagtacattcaaaattttcaccaagtgaagaactgagttctggaatcgttaagtgaagaactgagttctcgaatcgtgtgtgatttgtatagttccgagattagtactccctccgattaaggttttaatacgttgttagtaaaaaaaaggttttaatacgttttaattttagttaaagttaaagttaaactgttttaagtttgactaaatttatagacaaatataataatatttataatactaaattagtttcatcaaatcaataattaaatatatttttataataaatttattaattgaatatattttcataataaattgtctggggttaaaaatgttactatttttttatacaaacttggttaaacttaaatcagtttgactttgattaaactcaaaacgtcttataatctaaaacagagggagtactctctctgtctcattttaagtgcaactatgattatccgtatccaactttgattttccgttttatttgaaaattttttaaaattagtatttttactgttatgaaatgataaaatatggatagtaatttatacgtgacttatattttagttttttttaaataagacgaaaaatcaaagtcacacttaaaaggaaatggggcggcggagggaggactagtccactgataagtgataacgcatcattcaaaatgatcccgaagtgaaaaccgataaattctcaaagaggtgtgaattagaagtcaaactgcatcgacccagctgtccatggtcttcttccgttcgccctcgctttcttcccgcaccaaccccgcctaccgctccaccactactactacaccatcccctccaccggctccccctcaccaaacttccctccacgcctgcttcgcccaactcgttctcttggagcacctaactcgagctgagctcccttcccgcggaattcgggtccctccctgatggcggagccggagc

SEQ ID NO: 52554 - DNA, 357 bp, Oryza sativa
agtgtagggtccaatttttactgacccgatcgggcgctcgagcctgagcattttcaaaactattttatgaaataagttcatcagaggtctcttaatttgtcaacgaattcgattttcgtccttcaaccggaaaacgatatacaatgggtccctgaactattaaaaccggtaagtccaaggcggtctggagcacggtttcaactgatgtggcacccacatggctaattttactcgatattcgtcttatgtggcattaacgtggcatatgaagcaaaatttaacaatttaaaaattaaaacaaaatatttggacccacatgtcagtcaaacaataaaataaaagatagtggggcccaca

SEQ ID NO: 52555 - DNA, 760 bp, Oryza sativa
tcttaccaaacgaggaaccagacgagggctaacatgtaaattaccctgccttttttccgttaattcgaaaatttacagtgggttttcctttcttctcccacactgacccaagcctaaactcttcgttgtccctttccttctcctcttcccctcttccctaccacctactcgggctctcttccgggctccggtcgctgtcgcctccgctagccgctgggtggaattgtttgcgtggattttttttcgaattaattcaaaccagagcggtcgtgtcgctctcagttccagcgccgaatccgcgctccggctcgggtgcaaggtaagtgggatttctctgctggatttggttcctaatcgttggaatttgctcgtcgtgcttgaatctgcgttgtgtggattttttttccccggtggtttgtgggtgtttggatcgcatgcatttggtgtgagtggcttgaaattttgttgatgatttttttctgctgaatttgttcgtccgtttcagttggaactcgcatgcgctgatgatgttcacggaggggctagatcgagacgccctcaagtgggttcgtgaggtgagagttcgagctcgccgtgctcctcccgagccctagctggtttgctcggtgtcgcgttgggttttcgtcactgacgcgtgcttttttttttctgcgtggtggtgttggttgatgcaaaatgtggcagggccatggcggggcggtgcacagccacgaccgcatcgacgcgctccgcgcggtgc

SEQ ID NO: 52556 - DNA, 1501 bp, Oryza sativa
tgctcgctccttttctctgagtaccacctgtgtgtgtggtgtggtttcgcattctttggatggatctactttcattttcattcttctttttctggtacaattatactccctgtaactgtagtcctgtaccatgcaatttaactgtagcataattcgtattctagaagattttggcctgttaaaatacaaacaaattgatagtgtccgtagtacatgtggagtagtatgtgctgcccatttagatcgagttgtctgggtacttccacgccaccattttttccaagtccataaaatattttctatttattttagtacggcagattttcattcgctagccaaccatagaactgacacattacataggcactttctctttttcctgggataatacattaacatttggggtaacattttctagtggaccaaaaattttgtcggctggtaacacggcctttgagaaggcccagtactgcaggtataccattccgtccggtctccagcccgcttccttacgttgtacttagtaggataatttgggctggcacagtaagtaggcctagcattttcaccgaccacgcgcgtgggcctggctgggtggtgacaatgtgtgtcatgtggagcccaaattggcagattaaactcgtgttagcaagcgaaattaatgggcccacttgtcagtctcatttattctcgttaaacaaacaggcaaacattccgagccgttaataccgtagcctcgttactcgttactcactccgtccaaaaaaaaataaatctaaaatatagaatgtgacatatcctagtagaacgaatctggacatatgtatgtccagatttattgtactaggaagtactatgttggttttttatgagacggagggagtagccattacccgtgcagacaagcatggctccgttcgagcaggagagattgctgggagattgaggagaaaacatctacttttctacgcgcacacttcccaaactactaaacgatgcgtttttggcaaaaaaaaattcttttgaaaagttgttttaaaaaatcatattaatctatttttaaaacttacaatagttaatactcaattaataatacactaatggctcacctcaccttattttgcgtatcttctcaatcccctctttcctatcctctcaggattcaacccagttatcatcatcaccagtattaatagtttccagcccaaggaattattttgtttcggactagaagtctcagacacgatggtatttgcttcggattggctaaggatttggtgcatatttatcggcccagcccaaattcttatcgggcctagcccatccggtagccgccataaccccaccggccaccgtggtcagcttctcttatcgcgttgcccaaataattacacgaatcgaaccaaaccctagcttttcctcttcgattcccgatcccccacccagcgactcgccggaaccctagccctagatcccgcgcggcttgccgccgtgctagcca

SEQ ID NO: 52557 - DNA, 1021 bp, Oryza sativa
caaaaagtgctaggctcgggctgtcttttttgcatgggggccagagggcggcaagggttttcgtgcaaaaaaaaccctccctctcccgtctgccgtcaccgcccgtccctcccccgtttgccacgtcagcttgccgccctagtggagggcggcaggggtctatttttgtaattttttgcgccgatggattatttctgtaaatattaaaagaaaaaaattaaaaatgaaaaaaattcgtcagagaccgaggttctctttgtcactgggaagagtagcatcaggatcttgggctcagatatgagcaaggaagaaagtgaggtgctttttgtagccgaacaggggtgccgatggaacctcaaggttgctcggctgcttcgtttgggcctaggcattaagcaggccggagttatcagccagcgtaatttgctcagcccgtcagaaaattacggttttcagctttgagaaaattccatccatgccatgaagattttggccaaaatcaaagaacaccaaaatcctgttatttgcgcttcacacaagaaaacgtgctaatgaaaactttcctcttcactgtgttcctaatttcctatagctgaatctgcatacctgaagaaaaacacaacactatggctgaatctacataactaaaggaaaagacaaaacaaactgaaagtgtgtatctgttcagattctaatactaagatatatcatatcatgtattaagtttatttattttaggatggatagtgttttaaaattatgccatgatcttaccagtaataatcacaaaagagaagttatttaatccgaaagttggtactacagaaaccacatcaactgcaagcaaagggaatgctccggcaaagtcttgcaacagaaaatgcttaccgacaaaaaattttcgaagaattcactatttgcacaaaacatgaatatccccaaaacaacataccgatattggcaatacccagaaatccatccagccaacaatcatggtagcatgaaataattagaacttgtg

SEQ ID NO: 52558 - DNA, 486 bp, Oryza sativa
gcatttagccccttgccgcccttacagagagcggcaaggggctaaatgcaattttcgcagacggcggcagacggcgccgtcgagccgccgtctgccacgttagcttgccgccctccattagagcggcagggtctatttttgtaattttttgtgccaatagattatttctgtaaatattaaaagaaaaaaattaaaaatgaaataaattcgtctctgacctcactctgaacccttctccttttttttcaacggccaaacaagattgctttacgctatattgataaaagaagtttaagtacaaagtaaaaactgaaagaaaaaggaaaaactgtacattactgactgcaaactgcaaatatgcttgcacgtcagtccaccttattcctcatggcaataatctcgtaaagtattttgcgtcggtcaactctagcaacccaacttgtgattgattcttactctgaacccttaaccccctcaatgcagcca

SEQ ID NO: 52559 - DNA, 1061 bp, Oryza sativa
agtcaactgatgggagtggcatgagagggtgcgcaaatttagaccaatggcatataagggaagagccaattttcaatggtatataaggaatcagaccaattttcagtggtatataagggattatctctttttggaaccaggggaggaaacccctactccagtttcacatgaaaagaagcaacatcattctttgccaaggaatttttcacgttttacattccagtaatgcaccgttcaacaacttatattcccaattacaacctctctagggaggacaatgggtagactttgcaacttgcttgtttgtgagtgccaggaaaatttagtggctcgacatttcagctcagacttaaactgctcctcttcatgccattgttcttcatccatttcctagaatcactaatccatcattagcttgcaaagaaataaatgttttctgctactagcctactaccacatttacaataccagaaagatcactatagagctgcttcactatactgcactcaaacaggagatgattaacagtttttaaactggaaccgaaaagacaagtcatatactcatatcatctagtatgttttgtctcttactaaggttatctcgatttagattttttttcttctgaaggggcatctcgtttgaattttgttaggagagactaaccagagacagatttgcacaaaagaaaaaaagaatggaacttggctgaaaacttatggagggactaggacgtgacctgtaatctaggcctgggataaggcctcgtttggattggattgaatctattttgcatatccattgtttggaacaatggattgcttcctaatgtttgatctgagaggcaaataaaaatgagctcagatctcatggaaagctttttccatacgaagcaaatgtacaaatggacctgatttctaatccaatatttctttcctgtgttttgaactgatctttatgtgtcttatgttcctctgttttgccccattcctgcatccttccgtctaacgtttttctattcatgcttcctactaactgggaaatctgaatgttcgtgcaga

SEQ ID NO: 52560 - DNA, 1501 bp, Oryza sativa
gaggcatctaaggccttgtttctttcagcttggaattattataatccagattattgggagtaagctgaaagaaacatacaacttattgaagtagcttattataatctggtgcccagcttattataatatgataaactcatttaggtgagctttttccagattattgggtgaaaaattacccaccatgccaccccactccctctttagacttgcaaacccaataatctaggctctaataatctaggaaagaaacaactaaccgcttattctactacagattataacaatctagtttatagtaatctgactcaataatctagaatataataatcttaagctgaaagaaacagggcctaagagtagtgggtctttagccactcaataatttggaaaaagctcctctagtgaagattattggattatactaatctagtttatagatttgttaacaaccaaatttggtaatatcggcatcgggaaagaagattagatcgaagcaaagtcggaggtggagatcgagttcggaaacagagcaggaatcggctagagtccagatcggttatgattaggatcggctgggtctgagttgggctaggtaagccgatgcagccgattccgacaatgcaactcgatgtatgacatcgggttgaattgaggtgcttcaaggtgattgccgcacatggatagagtcctgagaagtcaattgtatctattaattaggatgttttatataatttccttagagatatgcttgggcaaaagtctgccgcaaagacttatggtatcttggagtttgttagagatagttgtcgtgtctgttatggacatatcttgtaattttcgggtataaatagacccgagcactatgtatcttttaacacacacgttcaatacaatctcggtgcatcgccaccttttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtaattcgtcgagttatcatatatcctacataatccttggcaatatcgatatccaacctacaatcggctaacatccgtcaatagaaggcagccgattaggttaaataccgatgttgacttagattatataggatatcatttatagatttaactgcggtttctttgcttctatttcttgttgattacaggatcaaatcaactggcacgctcatacattcgaaggtgagctttggacctgcactggagttaagaagacggctcggctcagctgagtaacaaaggtgctaccgacagctctctaggaaatcaaggtgacaattctcaaggagtccatggagtgcaaggtgacggggtgcatggagttcaaggtggtggtgcccaggggttgcaaggaggagatcttaatcagaatagtgatacggcacaagattttttcagt

SEQ ID NO: 52561 - DNA, 1501 bp, Oryza sativa
atatatatatatatatatatatatatatatatatatatatatatatatatatatatatatatatatatatatacatgtttatcagttattcttttatagtaatataaaatttgaaagaaaaataaaacataagtatgataagtgggggaaaataacctgcttatccgtcccacttgcatcgctataatggatgtgtgcaaactcactgtacggtgcggaatatggaaaatcttgtttcgtagaatcacaagatatttttcttttctcaatccaataatctaaaagcgaaaagttaacggtaaagcaacgactactttagttattcatcaaaaagttgggttccaaaactaaaagagccaaaagaaatatgcataaagtgccctcatacgtgctatgctgactggctggagaggaacaaaatatcacttccaggacaaggcaatcctattaaataattaacaatctattatatcattaactaaaataagttgttatgtgagcacctggggaggttcccctgaagactcttttctttgtagaaccttgtccatttttctataatggaaatggagggctatgccctttgctaaaaaaaaatcattcactaaaataagtttaaaaaaactatctgagacctaaaaattatcatattgataaaaagagagagagaaatatacattgcttgattgtaatgtgtacggtttctatccatgtagattgattgatatagttgtataatacaaaagaataccatatttgtaaaaatagaagtaagaattgtacatgtcaaattcaactcttaaaatctagttttgcgcaaaattgtttgggaaactatcctattttttgcatggacattatgttgttaatttaaaacgttagctaaccgacatttggcatatctttatggtttaattaacttttcctgtttactacatttatcctttgatgggtacttttttagctagggagtatatagtatctactttatggtggtgtttgagattgatgaagatgatgaagtgggtgcccgtaaaacgagaaaaccattaacgtatgatcaattaagttttaattattataaacttgaaaaataaatttattgtaccatttagcaatttgaaaacatgctaacagaaatcgagataaaatctacattttatgagaagacaacacggcctctaataaccagtaatatttgatacagctccctggtctgcttcatttaagcaatcatcagtgtcatctagtctactgtctacacatgctaggggaacatactagtatgtatataaaattggatatattcattttatcctcaactctaatcttattttaatcaacaccctttgcatagtttagagggagtatatctggatctattgtaggaaagtaccgacggtcagggccggccctggccctatgcagccgaggcgaccgctgggggcccatgatggtagggggcctataatggtgggggtgccaacacctaatactagta

SEQ ID NO: 52562 - DNA, 1501 bp, Oryza sativa
acatcatcttcaatttcaatcaaaatccaaattttgcgctgaactagacacagcccaattatccaaacctgtcctgttactgaagtctgaacagccaaaaactgaccagttatactgccacttgtgccaaagctttcctgggaatgtagttttttgcagtgaccagtgtaaccacttcttttaagtacattaattggataaaaatatttatacctgcttaatacacatcccccttccttacttgcctttgagtttagtctgcatgtatatacctttataaaattattccttttctatgattcatgcaattttatgtttgaaaatgactaaaaacccccaagtgagctgtcctgtatgatgagagagacattctgttgggtgcagaatgctgctaacaaaaccacttgaaagattcagaaaatcttcaggcttgtaactgaaagagtttcagtttcctatcttgtccaaaggaggtattatgaacctctatgcaaggacgaagttgcatgaaagtcaaaatgaaatgtggcgtagtagtaaacttggatccaggccgaacagcacagcagcagaaaccagtgagccagtgtcctgcaaacgcgttcaatgaaccgtccagtaaaaaggtcaaatggcttattaaaaggatggccgtgagggtccatgcctgtctctttaatttttcgtaccttaacctccccagaattacgctacgggccgtggtgatttcctccggacatgggcagctctggagtctggaccactgcatgaggctctccatggtgggatggtggatagggtagggttggtggatgtttcactttcaccacataatatcgtcgtgcatagtcacatggctgtccttgtaaggacattgaagcacagtaaagtggcctacccgcagtgccccaatgaaatgcattggatgtacaatagaaaaacatggacatgttttctctcctatagtactgaattagaggttttagctgttaaattttggcacaggagatttaattatggtacagtttatctgtgcaaccgtgctttcaactgggagggtagccataaaaacaagcttgagaagtcactcacttataagaaaaaccagtcctagaaatgaactttcccaaactctactgtgatggttcatttcacttgttacacatgtttccgtagaaaggttcccgtaaatgtcctaggtttttatctgaaatttatttttttttgtcactgttatgcatttgatttgagttgtacagtgccattcaattcagtctgagttgtacattattttatatatgtcataataaagatagtccagcgcattgtgtactaggttcagtgggggatcatatttacggttcgtcctatcctacaaaagggtagagctacacaacttaaaatagttatggttttattgcattgcagacttgcagtagatgtacttggcttcacttgcatgggaacgctttcacatataacatgggtagatattaagtag

SEQ ID NO: 52563 - DNA, 1501 bp, Oryza sativa
ttgatttgagagatagtatacataccctgcacctgtacatttgagatatacagcgtggaagcaactcctgatcagcaaccaagtttttattcttgtgagtccttcactcgggacaagcaaaagttcaagcttggggggttttgttgacggtcgttatcgatcagtttcgcccatcaatattaccaaaaataaaggagaaataagttatgcttgcaatgcatattgtgtcaaaataagatatattccactagcactaggcttcctaaccttttgcatataataaacataaaatagaggcgattcgacaataaaatggacgattaatcacggacgctgtcaaagatcagacttatgaacaaatggatcaagaacacagaattgacatgactaaaaatggccaaaattcacaagtctgaagataggagaggacaaagaggaggcctgtcaaaccgtcggctggttgggtcagcccagggttcaatcgaaccagccgtggctccgttggatccaggttttggctagacggttgagatgactccctaatgacggttggagggtattaccaacctttccaaccgtcgtaaccgttattctcaagctatataaagccctcagctcactccctccaacacacacctcaagcaagaagaatcaagctctctctcgcattgtagctcccgaatccggcggctgcagcatcaagaggaggtgtgaatcgtgaggacgaggaggcgtgaatgcatgatggtgtgagggagaccgaacagcgggtggatcgattgatctgcatggcggcggccgcgacgaaaaaaatccagaagatgaggagaggctgggggcaggtatttgcggccgccggtggcagggctcgagggcgacaagcggaggcggcagccgatggctgggcgcgggcaacggtggcaagcgatgcggggcggagtagccccctaggcgtgagggtgacgggcggatgcgacaggcggccgggcacgagggtgacaggcggaggaggcagggattctactacaggtggggcagggcggtcgccgatggtagggcgcgatggcgacggtcgtcggcggcaggcgatgcgcggtggagtagcgccgaggacgggggttggcggctagttcgggcgacgagcgttggcgtcaagcggcgctgggtggagtgggcggcagaggcggagaaaaaggagaggggagttgtgtcgcgatgggaggcgtcgctcgataaggatgcggagagaagcgcatctgcctattctgaaccgatggatttgacgatcgaatggttcatattccgcgtgtctgcctggaatggcctcaccaccaccactacggactttttaagtagtagagatactactctggtattgtactactttccgagtatatgagtaccaactttatcatacattcaaactatattgattatgatgctagcttatctggaaaatgcaatggtgtgggtataatgatcgtgcatacgattgctctat

SEQ ID NO: 52564 - DNA, 1501 bp, Oryza sativa
caagaatctggcaaactcacttgcaacacctttaattctgaataaaaatcattgatctcaacatcggatgagatattatgttactagtattaggtgttggcacccccaccattataggccccctaccatcatgggcccccagcggtcgcctcggctgcatagggccagggccggccctgaccgtcggtactttcctacaatagatccagatatactccctctaaactatgcaaagggtgttgattaaaataagattagagttgaggataaaatgaatatatccaattttatatacatactagtatgttcccctagcatgtgtagacagtagactagatgacactgatgattgcttaaatgaagcagaccagggagctgtatcaaatattactggttattagaggccgtgttgtcttctcataaaatgtagattttatctcgatttctgttagcatgttttcaaattgctaaatggtacaataaatttatttttcaagtttataataattaaaacttaattgatcatacgttaatggttttctcgttttacgggcacccacttcatcatcttcatcaatctcaaacaccaccataaagtagatactatatactccctagctaaaaaagtacccatcaaaggataaatgtagtaaacaggaaaagttaattaaaccataaagatatgccaaatgtcggttagctaacgttttaaattaacaacataatgtccatgcaaaaaataggatagtttcccaaacaattttgcgcaaaactagattttaagagttgaatttgacatgtacaattcttacttctatttttacaaatatggtattcttttgtattatacaactatatcaatcaatctacatggatagaaaccgtacacattacaatcaagcaatgtatatttctctctctctttttatcaatatgataatttttaggtctcagatagtttttttaaacttattttagtgaatgatttttttttagcaaagggcatagccctccatttccattatagaaaaatggacaaggttctacaaagaaaagagtcttcaggggaacctccccaggtgctcacataacaacttattttagttaatgatataatagattgttaattatttaataggattgccttgtcctggaagtgatattttgttcctctccagccagtcagcatagcacgtatgagggcactttatgcatatttcttttggctcttttagttttggaacccaactttttgatgaataactaaagtagtcgttgctttaccgttaacttttcgcttttagattattggattgagaaaagaaaaatatcttgtgattctacgaaacaagattttccatattccgcaccgtacagtgagtttgcacacatccattatagcgatgcaagtgggacggataagcaggttattttcccccacttatcatacttatgttttatttttctttcaaattttatattactataaaagaataactga

SEQ ID NO: 52565 - DNA, 445 bp, Oryza sativa
taaaacatcaattaattctgttttttcaagtctctctggctctcgctccggcgtgtgcggcgcgtgttaacgctgattcttggtaaagatgttcgtcttgattgagggcaaggcgattggtcatactgtaatgggggattaattatttgcaatgtgtcctcttggtgcctgaaactctgaattctttaagcattgtcatcctcctagtaaattatatattccatcgaagatagatagtagattctaggacgaattcgatttggacatagcaattttctgatatatctagtaaattatatatttaattccgaaatgttgggtgatacaggtatttgcctttcaccttgagtcggccccaatttccaatcttgatcttgacttccgcatatgaatgttgcttgatctgtattcgacctatgcaggtgctgttgatcgctttgtgaaa

SEQ ID NO: 52566 - DNA, 1501 bp, Oryza sativa
aattagtgtgttacagacatctgtagatcattttttcttcgtggtctttgacgagcagatcatagtactcattatcggttatcaatggtttggcaattgcatatcaaacaagtatcctgtttacgattaaacatatggttgccactgaaatttcttcctaacattttagagggaacctgatcatgctatctcatcagaggatagagaagcggtcatgggcaattatgtgtttgccatttagcttatataactgctgtgtgtgcagtattgggtatttatcctttttatgtcttttgtgctgcagaatgagagcagctcagcaagcgattgttagagaagaataggatcgagccccgcaccaagtagaggtgtttgtaaaaagtggctagcagaataggaaaagaagattacaaagctgcttgacttgaatagccttgacttgtgaaaatttttcatgcttgatacataggaggcggcaaaagcgagtgcaaaaggaacctcgacaatacgggtgaaatggtgggctgcagctcttcaatttgttcatccaattaatatacataagcctgttctgtagcttcgatgaaattcgacggatccatatgtttcaatgtttcctcccctctgaattgattccgagaggtaattttcttaattcgccgatgtggtgcttttcaaaatacattatactcatacatatgaaaaattaaattggtctgcccatttaaatatgaatacaaataaatccttaaatacactaactatcgaatgcacgccataaaaaggattgtgaaaaaaactatttaattactgcatggaaaaaaagttctcacgtgacatgaatcacattgtagtgctttaaaataggggaattcgattaatgagaaacaaaatatattttttgtctgtcaaatatgtaaaaggaaaacgtgaaaatccatcttttaatataggcattggcgatagttattaaagataaatagagttacaccgtagcgtttagcacacgtaaaatagcaaggatacaaaaaatttaagtaattattaattcttttcgtatcatttgatttattgttaaatatacttttatgtatacatatagttttatatatttcacaaaagtttttgaataagatgaacggtcaaacatgtttaaaaaagttatcggcatcaaatatttagagatggatggagtataaaaatcctgtgacactaatatactccatggagtgacaacggtcctctttattacagaaccatcccacaccgttcatatcatgccaagttgacgacaaacgagagctggcactatcattcatcaattttgtaatagggcccgtgcacatctatctgacaaccattcaatattttgggctgttcaaatggtagacaaaataaaccaaattttgacaatttgataatattgttaaaattttagtaggatttcgtatgtactaaagtttggcaaaaactctaccaaaaagtgatatgatttgaaata

SEQ ID NO: 52567 - DNA, 1501 bp, Oryza sativa
acccccgtctcataagatattaaattactataaatctgaacatacgagtatcttatatttgtatctatcttttttttatagagtagtacgtttgatcaagagtgaccatacagtttgactgaaattcccttaagagttttcatttgactagtgtacagacagtccaataaaaatatagttttataccgcttacactgccgtccaaaaatatagttttgactagtatacgcagccagcagagaataccgtcacatgccatgctcaggttgacccagctgttgtcagtgtgtcctatggtggactggtcgctggaagtgtggagcatatagactgttccctcttttttaccatcggttttgctaccgttccacttccacctcctcctccttttttcttttacagaacaaaatcaggcacaccgcacacgagatactacaaatatatcctcaggggtgtcgtaggtgctgagaaaagcggcgccactggacactggagtgagttggagtctcgtgcagaggctatgcacctgtgcggccggctgtgcgatggatatggaccgaatctcgtcacgacgtcttcaagggctgcacccaagcgtcgctagcttggctttgccacacacattagtgttgaacaggcaggccttcggagctagcaggcacctaccgcgtaccgcgtccccttatctgctttggacgctgctactgcacaaacttggtgagaggaacgtctcgtcaattcgtcatagtggtaccatgtttaatttgtgccacacagtaattcatatttttgctctattcccgtcactgcatccgttctactaatagtactcctactcactacatccgttataccgttccaataataagattgctcatttcaagatttattgtattagattatatcaaatacaatattaagttggtttttattagaacggagggagtactaagtagcactcctacagttctacttcttttgttaaaaaaaactcaatctaagtatttaattggatataggttcattgtactaactaataagggtgtgtttagttcacgctaaaattagaagttcggttgaaattggaacggtgtgacggaaaagttgaaagtttgtatgtgtaggaaagtttgtttgtgtgtgtagaaaagttttgatgtgatagaaaagttgaaagtttaaagaaaaagtctgtaactaaactcggcctaagtctaatccaatactatatatgttggacttttttaaggagccagtatatgctaatttgattgttcatggtgacagctggagcactgggtgaaatgattatatcgagggtttgctcgcgcgaaaagcaatccacaattcgatcggggcaaagcggcagcactaacccatcaatgctcgcgagtggcgtccgccccacatgccgcttaggtgcgagaccggcccggtcactcggcagtcggctccctgtagagatggtaccgtgccacgacgtcgtcccgtcccacctcgc

SEQ ID NO: 52568 - DNA, 1501 bp, Oryza sativa
tagcatggcccatttcctgattaattggactggttgatctgcaaaggttggtcttgttagctgaagtgacaccatatgcagcttattaccttgataaaaatgggagcaatgctctcatgcgtttttgagggaaaaaaagaggaagcagtgtcaacggaaactgatccttactgcagaggtgcatcaatactgaaatgagtcttgtgctacagttaattgtagtaaatcactacagcagtagcaatggtgtttccagtgtagtgcagacaacttctgttactgtagaatttcaactggaaagtacacctctgatctgatgttcagaattgatcctaaaacatgacccaaaattgatgccgactcaagtgaacttgtcaagagtctgcgtgacaagttgcttctgtatttaaagttggtgatgataatgccaaaattctggtgcatgaaggttctctaacccgttgttggatgggttttaagaaaaacaagttgtcaaccgatttttattgtaaatcattctaggaaacatactccaaactactatgaattttcctggttatttatttaatccgtgtgccactttacgtagaaaatcatgtgtttgtgtaaaccttaaattgacatgttggcaaatgtcaatatagaattgtttttcagaatttcgaggtgttgaagacatttcagtgaggaaggttacaatataacatcgagtataaggtggttacaacgcatagttggatgatttcagaggcgtgtacaacatgcataaggtgtttttcatatttcgttttacttatatattttggacgtacatgaaattgttttagaatcagtggcgttctacaatcaatgtctttaccgcaagaaagattcaagttttccagtgtttgtagtaaaagtttctttatagggatttttatggtcaataggaggtatcgagaggttattagagctaatacttcctccatctacttttaatagtcatattttatcttggcacacagaacaaggataagtaattttacttatcatccatttaaacatactactagtcattcctcgtaaacaaacgattcattaatatttatatttctcaatgcccatgtagccaatcatatgtggaagaatagagagacatacattgaatccgagaaagtcattaagaggatatgttgttggattgaaatatgcctatcaaaaataaattttttagatttaaaaaaaatgactatggagggagtataaaggtacgtaaaatctatttggagaggcatcttgattttaccttaactagcgacgcctaaacacggagaaacgtggagaagtccagctactacatagtactacatgcatgcatttttttaatatacatgtacgtcctttttctcttcaaacaaaattttctctcaaattacttatccgatctacaatctgattacatcattgtgttcgttacaattcaatcttcacaacaagatcttacatgattatattaagatga

SEQ ID NO: 52569 - DNA, 1501 bp, Oryza sativa
atgttggcaaatgtcaatatagaattgtttttcagaatttcgaggtgttgaagacatttcagtgaggaaggttacaatataacatcgagtataaggtggttacaacgcatagttggatgatttcagaggcgtgtacaacatgcataaggtgtttttcatatttcgttttacttatatattttggacgtacatgaaattgttttagaatcagtggcgttctacaatcaatgtctttaccgcaagaaagattcaagttttccagtgtttgtagtaaaagtttctttatagggatttttatggtcaataggaggtatcgagaggttattagagctaatacttcctccatctacttttaatagtcatattttatcttggcacacagaacaaggataagtaattttacttatcatccatttaaacatactactagtcattcctcgtaaacaaacgattcattaatatttatatttctcaatgcccatgtagccaatcatatgtggaagaatagagagacatacattgaatccgagaaagtcattaagaggatatgttgttggattgaaatatgcctatcaaaaataaattttttagatttaaaaaaaatgactatggagggagtataaaggtacgtaaaatctatttggagaggcatcttgattttaccttaactagcgacgcctaaacacggagaaacgtggagaagtccagctactacatagtactacatgcatgcatttttttaatatacatgtacgtcctttttctcttcaaacaaaattttctctcaaattacttatccgatctacaatctgattacatcattgtgttcgttacaattcaatcttcacaacaagatcttacatgattatattaagatgaaaaaaatatttatatttgtaaattacttttattttatatgtaaggtgtttttatcatatatatatatatatatatatatatatatatatatatatatatatatatatatatatatatataaggtacttttagagttgattaaactacttcttagatatataaaagtaaatttaatagagtctaaaagtaatttacatatattataaaagtaacataaaacaaaacggaagtaattttgtcacgacaatagaagtaaattcgtcgtacggataaaaatatgactttatataaaaattaaatttaatcagcacggatcaacacacataagtttaacaatttttaaaagtaacttcaatgttaattggaagtaacttttgcatggttcaaaagtaactctctataaatctgtttaatcatcgattgtttttttccctttcatttttgttttcatgtagaatgagaaaagaagatactgttgtattttttaagttgaaaggagatactagatggagtacaaagtagctaccactagctgtgtagtcacatccaattaaaaagacattctgtcagggttacggataaggtatgccctctatccttggatatacgatgggtaccgata

SEQ ID NO: 52570 - DNA, 1501 bp, Oryza sativa
acaaaagaggtttgatttaggacaaacccaaaatgatttataatatgaaatggaggaagtaggtgataactactccctctgtcccaagatacataaccaaaagttgttatattttgggatggaggtagtaataatttactactccctccattccataatataaggcgcaactactttttcgagatgtttcataatataaggaatgaatgcatgctattaactagcacttctttcccactaaattattattttttaaatcctccatactcaagatctttaattctgttgggtgcatgcatgatatttactagataaataccccgccgtctttctgtgggaaattaagttgtataatatgtacaaataagccacaatatattttataaccaaaacaaaatgacctcctaaaaatggttccaatatagtgcaaggtgaacatattttatgtaattgatacttatgaattttgagcctaaaaattgagattgcatggttttatgagagaagaaagaagagactatgtgtaccatagatctatcatccaaaggctagaaataattgtgatgtggcttcatgagagaagagagaaatagcattaactacacttagtggggatgaactataagtatataggattaggatgatccaaactatgatgtgataatatcttggtttttgggttaagggtggttgagccttatattttggaatgtagggaataatttataatattgaccaaccatcccaaattgtcttattggtttacatgatggtttttatggaatacagaaagctccagtaaaatataagaaaatgtggatgatttacatgatactacttttggtttcaaaaaagaaacaacttgtgtttcttagttttcattaagtcaaatcttacatagatattgcagcctacagagtaatagtcatgaaggactttttgtctattggatccaaccataaaacctatctaattttattatgtcactgtgggatgcatcctgccattagcttctgttcctatagttcaaggtaaggtctaaaggagccaggtgtctatacccttagttagcactatgaattcccgtagtctctcgagaaaacaatgtgctgaagattaaggttaggtcttacagacacttcacacaaatgaaaattgtgtgttactaaagcagcaagtgcaacagcaccatttaatcaaagctttcactctttcagcatatatcagctataacatttcacattatcatagtgcaatgcagaaactagaaaggcggtagaagtacattggaaagaaaaaaactacatgcctcaaagtttgaagaaaccgttggagtagaagccaaactacttttcagagcatctgaatcagcagagctaattaatgatttagtaaaatccctgtaaaataagaaggtgtttcagatagcagtgcttgcatgtaggtgtgcgcacacatgtctgtacagcaacctgcacaaacacataatctgtccgaaaaa

SEQ ID NO: 52571 - DNA, 1501 bp, Oryza sativa
atgcagtaatgtcctcgcatcggaccttgtcatggcaatccgcatcgcaaaatatcactacgtctgcagtatgctcttgcaactttacaagcctattccgcgcacacacaattgttcctcgttgcctcaaaccatgtgtgtttgatttctcaagcaagtcctttgttataatccgtcatatatattttttgcgagggttataatccgtcattgtaaccttgaacattgctttatacgatatatcatacttcctcaatttcacaatgtaagactttctagcattattcacattcatttagatgctaatgaatctaaacatatgtatcatggtggtgtttgaatttcctgaggatgaagataaagattaagtgtttcacgtaaaacgaggtggtaataacgtgtgactaattgggttttaaatattataaacttgaaaaatatattaatttgatattttagaacaactttcatatagaaagtttttgcacgatacacaccgtttagcagtttgaaaagtatgtcactagtatccaaattttcatccacttcttacattagaaacgaacggggttatgtgtttagattcattaacatatagatgtatatgggcaacggagggagcaatgactcctcacgactactatgaacgatgttatctggagggtgccaacagttgccaagcctcctcaataggagttgcgacgatcaattcgtcggaacttagtacccctctcatgcaacgagtaccttatcattaaggtggtacttatactcaacgagcatcaatggtagtgtttcgacacggtagcgacgtagatttgacatcaaaatcaaatacggtgattatctccctccaaggataaaaccacctttcatggagccagagaagaagctaagggtctatttagttctcgaacaaaaatttttaacgtgtcacattaaatatatggacacacattttaaatattaaatatagactaataataaaacaaattacagattccacttggaaactgcgagacgaatttattaagcctgattaatccatcattagtaaatgtttaatgtagcaccacattatcaaatcataacgcaattaggtttaaaagatttgtctcataatttacacggaatatatataattagttttttttcatatttaataattaatgcatgtgtacagatattcgatttaataaggtgaatttttttaaaaaaaactaaacaggcctaagctgcaacttcgcaatgtctcataattgttttatctcagtctcattttaccgaattattccttgctcccaacacaagaaatacagtactaagtacccacataggctaattagagtagagcctactgcttgcaaagtttgaaggctggtccggcttttcaacagggacgtgtcacacacccgagcagtcaattgctttcattgcttaaccgcccacactattgcagagattcacaaagcatggccgctcctgctgcctcacccccaca

SEQ ID NO: 52572 - DNA, 1501 bp, Oryza sativa
acaaacaaaaaggagttgcccaaagcaatagccgctttgaaaggaacaggtactaagggcagtcccaacctatggtgtccataagtagtgtctatggtgccatgtcaataagacatcacaatagaaactatactctacaacccatactttcttaaattagaccattaataaatacatcatctttcttctctaccaatcatatttattctttatctattatgaagacaatattctctcccaatgcaaaacttgataattctctcccaatgcaaaacttgatagtgtctagtgcataggttctcgtgttgaagttgtgtcttgcatgagacccagtttcttcctctcttcactctctctcaattaatatagtgccacataaactaaaagtcctacatggcaatgtagttaatgccatagacaccatcctagatggagggctgggactgccctaagagatgttgcaaatgattcattctagtgtataacggaaggattaatcaatgcgtacaaatatatctatgaaaatgaaataaatagttgtgctaaataaaatccaatcttttatagatattaggataatcctaacctttcatttatttattaattaaaagctataaccaagctattaatattatacattccgcagcccatatgtctgcatcgcaaaagcattaacggttgctaacataactcgaatgataagacatttttagaagcaaattgtattgctaaatttccatccatgattagaagtatagccatcatctctaaataatggcatgttgcatcatttcttggtcctcctcacaccttcaaaatccaatcgcacttttaaatctaacctcgtgtaaaattgtgcaacaaacagcctcattggggcctttcaacttataggcagttgccaaattttaaattttaaaactcaacttttaagttgattttaaggttttttcaattgtaatttgtttctaacattggttttaaaatcattaatgacacgtatataaaattttatccatgaattcatttttatgttgctgataaaatattatgttttataatcaacataaattcgcgtgccagttgagtgacgcatttgtgggttccaccctcttattcattgatcaggtgtacggtatctttatatgtttttcatgcgttttgcaacttgataaccattgcccataacgtatatgcatgatatgcatcgattgtacagctatgaacatcaatgagacaatgaccgtacgtgcaagtacaagcagggagccagggatcagctccggcgatgcttttattactctccctatcccatattataaatgatttttaagggatatgacacatcgacagaacattgtaaagttctttgatatataagagaagaaatgagggaattatattttttcccgagccatgaaaacaaaagtgggttgctccaagcttatatggccttccagttgcagcaataaagctaaccttcgtttccgtaaaaccagta

SEQ ID NO: 52573 - DNA, 485 bp, Oryza sativa
ccagtaaacgcatcatgtaattccggatggatctaaaattccatgagtactgaaataattgtaacgtcacaacactgctgcgtgctaccgctggaatgttctatgttattgaccaagtaacgttacaccatcgtctatggacacgataataagtttcgggccgtacattttcgtattacttttgctgaattcgtcgtctctttgttataacaagtttcatgccgttaccttgttgcattactttgactgagacggcagtggcaatgtggcatactggcatgatatgttcaggtaagcagaaggccgtgtggtggtgaactggtgatgctcaaccggtgacgcctctaattggcagttcattccaaacttatccaaaatagtttatttcgtactgatgcagccaaattttgaatatttaaactaactttaaattaaactaggtggttttgcatcaaagccttggctttcaaacggcgaaaagttac

SEQ ID NO: 52574 - DNA, 1501 bp, Oryza sativa
aaaagtttttttaatgtgtttgtattatgagcgtctgcgtttacacaatagaagttattaatcatgcattgatcattgtatatttgtattgtaccatggtgcagttaattttagagaaaaaattcaaagaaaaactagcgatccaaaccaatatattggtgttgatacttgttctaccaccataacgatatattggtgttggacgtgctagtgtgttttgaacaagatttttttagcgaggttaaaaatcccatattcaagccttgttacttctttcttaggttaagcacatcatttattaatattgccatctattactggataggatacatcatagtactacgaatcggatacatcactatattatatagtactaaattgttatattatgggatggagagagtattctataacacacattttgttttctcataagcaattatcatttcttcttttgttatgacgatcaagcaagagagattacatgagaggcatcatatgttgttattaggaagattatgggttgtttggttgatacctaactttgacataactaaggttagacaagtaatatgtctaagaaatagttggttatagcccgcaggggggatttacaattatgacattgcaaacattaacctttgctataataacactaggctcacattttatagacacagatggacccatttgtcatccactcggagtgtcaaaacagcgaagctctcgtgtttgcagtcccaatattacaaatttctcgcccgcatgtgtgatatgtttagttacaaatttgaaagtgcgggtaggtcttaagagtaagaaagtgtgcataattgtgaagtgaaacaatcacatgactaaataatcgtgatatgactaaagtgtggtatggtaaagtgagacaaccaacccatcacccccttagtcaatggccggtcagcagcttaatacggcatttgtagcctcacgactaatattgtatggttcttttaataggtttttcataggacgacacaaaatatatttttcgagatcgttataggaatgtaacaaaatatcgtacgcatagtattttccgttatgtttaccgttatgtttatgttattccagtttctttcccatgtttttattttttgagcggtttcccatgtttttatggttgtgcgcaacctatatacgtagaggtcggatgcaattttattgcgaaaaaaaagaagaaaaccattgaagctggaccgtaggactgaaaagatcgtctctccatccaacggcccaggagacgccggaacaattacaccaccagaaagtcgtgtaataaaaaaaagtagtggattggtggtgtaataaaaaaggaatctactagcgctctataagggcgagccgcacggcaccaccaatccaccactgatcatactagcacagagcgccgccgccgaggagagtccaatcgagaagaagggaggagaggcaagcggagaggaagaagaagaagaagagagga

SEQ ID NO: 52575 - DNA, 1501 bp, Oryza sativa
ggttcgttcggttataccgatcgcgcgcctgagacgagcacgaaattttgtgggagatcgatggttggaggcgcgcggcatgccgtcattgcatctgagtttgtgctgcggcgcagtgactagaatatgcatcgcgtgtcagactgtgtcaaagatagaatatactgtcaggatcgcgtgcgtttcaccggggaaatagtaacagctgccgcgtatcgggagcagcatgttcgcaaatccattgggatcagagatctcaccgcgcttttgcttgcttccacaatactactactgtacacgggaatcttccgcaacttggatcccgttaagcacacgcttttctcacggcctctgtacggacgacgtgttggatcggttctctccgttaatcttgcaaacgaaaagcaactcgttttgcccaatgaaggctcagcaatcaacacaagaaacgcacttttgccaactccaaggcccaaacaccacggcaaaagcttcatcaactaggcctgatattctattgggctgggtttagcagtaaggatggcctgatacagtacgattggactgccgaaaaagctaatgcgcgcgtgccggcggcgcgcgtcctctgaccttttttttcttttttttttccgattttttcgtttttttcacactttttttctgattattttttaaatcttttagcatattttgagtttgaaagtttttaaattttgagttgaaaattttcaaatctgaacttgaaagtttttaaatctcgatttgaaaattttcgaatctcgatttgaaagttttcgaatcttgagttgaaagttttcaaatctcaaattgaaagttttcaaaattttcaaatctggacttgaaagttttcgaatctcgattctcgagttgaaagtttcgattctgagttgaaagttttcaaatctcgagttgaaagttttcaaatttgagttgaaagtttttaaaatttgactttaaaatttaaaacttaaatcgaaagttttcaaatctaacttaaaatttttttaatctgttagtaaaaaaatctcccaaaaaatctccagaatctttcctaattactatcattagtgttaagtatattaactaatataagtagttaagactaaagagaacagggagtgctcgccagctggctttcctggcgcgcacgcgcgtgctagccacccccttggactgccttgtattcttatgtgctttcccaatggaaaaagtacatcgaaggtccctcaacttgtaattgatttataaaattgtccctcaaccgtaaaaccagatatatgacatctcccaacttacaaaaccgttcactttagatccttcggtagattttgttagagaatattatctcctggggagataaggtcctttcccgtggaccaatccgaaccggagtagagataatatctatcttctcctaagacccctatatataggggcagggtgtaacatctaaggttggcttacacttcagatcaga

SEQ ID NO: 52576 - DNA, 1501 bp, Oryza sativa
tgttaaatcgttttgtaattccattcttcgagagccaattctaacctcccatggcaaaacagcctcatgcccataaacaagtttgtaaggagggacttggatcgatccatgacaagccatcctataagaccacaatgcttcggccaacctagtatgccattgtcgaggataatcagaaattttccgcttaatcaatttgatcaaacttttattagacgcctcggcttgcccattagcttgtgcataataaggtgaagaattcaataatttgatacccatgctatcggcaaactgaacaaactcgtcagacacgaagattgacccctgatcagttataatagtttgaggaataccaaatcggtagattatatgttcttgaacgaattgaattgcatccccagaatcaactttcttcaaaggaatcgcctccacccacttggtgaaataatcagttgccaccaatataaacttatgtcatttactcgatggtgggtttatcataccgatcatatcaattccccaacctcggaatggccatggcttaataataggattcatagccgatgccggatctcgctgaattgccccaaatttctgacaatcttgacaccccctataatatctgaaacaatcctccagcattgtcagccaaaaataccctgcacgccgaagtaaccacttcatcttatgagccgattgatgagtaccacaaattccttcatgaacttcgccggttgcaactttagcctgatcggcacccaaacacttaagtaacactccatcaatcgtccggtaataaagctcatcatccaacagagtatacttcaatgccttatatcgcaatttcttagaagccgattgagacggattatgcaaatactgatgcacatcatacctccaatcatcggctgtcattgctgcaatttcaaccttaacatctttgatcatcggcttatatcccgatgccccttgggccaaatcattagcttcaatattttgttctcgagagacatgctttaaagtaaccagtcgaaactccttcattaggtcttgacacttctcattataaaccatcaacgtatcattcttgcattcatactctcctgccaattgactgattactagcaaagaatcccccatgatttcaatggcattggtttcaacttccttgagtaattgcaaccctttgagcactgcctcatactcagcttgattattagtcgcatacggtttaatagtataagcaaactcgaaacatgcccccctagggaaaattataactaggccgataccacaaccgtgagtacacaccgatccatcaaagaataaagtccatggcactatttcaaccgagccgattgaatcatcatgatgttccacaataaaatcagctatagcttgtcccttaatcgccttcggcgactcataccgaagatcaaactcggttaaggaaaatatccaatttccaacccttcctttcaatattggagccgatagcatg

SEQ ID NO: 52577 - DNA, 1501 bp, Oryza sativa
aaaataaattattgtccgtgtgtgtgataaaaaaaagttattatctgcgcgtgtgagaaagagatagcaggcctgatcttttgtcaagctaggaaaaatgctaactgtctcaccattagtgcagagtgtttgatctgcaactaattcttgaagtacggtgattctcagaccttcgagctaaactactgaagaaccgaactctaattgtgagtacctgtttaatttttgtctgaagatacaaatttgttcgaaagtgactgaaagagacataaaattcaaaataaaaatgaatctaatctttttgatatattttcctctgttgcactatagcatccatcagtgccattgagttcagtttcatgttaaaattaattagtatatagtgttgttggttcagctgaattgccaaaatataggatgccatcagtattttattttttaagctctcccgctgatttggtttcatttcatttaggtcgatactgtgctaaatttattccaaatcaaaattagatcttccccatcaccaccactctccatcagtctcatcctgctctctgctctctccaaggtgagtattggaaaccttgtcccgtggttatttcagaaatggagaatttcgttcagctgatgaattatcccttgatcatggccattataaatgaaataaatgcttaattgcactatctacatgatataacttctataattggattttgcttttctgaatttccattatgacacaaaaggtatgccagtataaaggctgtctgtttcagtggaagaaacagagaatgattaggatgggtgcaatggttatgtttgctttttgctaaacgtctgaggtttgcaacaatagcaattcttggctcatacttttttccctcacaatattccaaactgttaatattgcatgacggattcatttgttttgagttctaattagtgaactgtacttgaatagtttatactactgagaaattaaggtacgggcatgaatgataagtagttgtgagttgtgaattgaagaggtgaagtggagaccatcagatttattttggtcctttatatttttaatattgtcatgcatctgtgatcagtttccggggtttagattcattatgttctatatcatggttaattattctatgggtcttccgaaacatggcacattgccacacatcctatgttgtgttctatatgttatcaatgagcactgtggatatactattttggaaactgctttgtgattttcacttctatatatgtgtgatatctatactgattcgtttagttgtctcctacatacaagggacaaggtggacggggagctgaagctgtgtcaccttctctccagttgcatcggcggataaaattgtgagggcaagaaaaatatttgtactcttttcaaattagtaaattaatgcttgcaggaataattttgaaaatttaggagtactacttgtaaataaatggaatagcaaaaaaatggtagataacc

SEQ ID NO: 52578 - DNA, 1501 bp, Oryza sativa
attaccatccttttgtaattgggatccttcctgcaatcaatttaaagcaacattgatggcattagaactaaaggtagcagatacaaattaacaagtgtgatacactgaagtaaacctggttacgcatacaaagcatatactgcattaccagaagttcttgtatgtatgaggtcaaatcgaaatatatttgatgtcataactaactgacaaactttgacaaaagaaaccaaatagctcatattattattatttcttttttttttggtatggtaatgcacctcctgtccgctaaaattatcagatttgcatgttccattttcaccaaaagtcgtgaaaagctttcatccgcttatgaaattacgttattaataggaatactggtgtatgcttgccacagattggaatttactaagacctgacatcctaagcacttataatgttcagaacgaaacgtgcaattctgtgaatatttctttttcggaataccaattctgtgacccattcccgcccatgctttagagactacgtccaagtactatagcacgaagcaagggaactgtagtgataactctagttcaaccagtagagtttgtaccgtccaattgaaatggtatagcctaaaaactagagcaatagagtgtagaactgtataattgattattattgaaggtcataaaaacaaggggcgagaattagaaaggcacctcttcaacaaaagtaagtccatacatatcccataggaaagtaccacccacaggaccttggtttcaatcactgattatctgctacttcactttcttgtttaagaagaatactcaatccgtaagaaaaggtaggtgcatttccatacccatgcctcacgaaacagtgtatggaaggaagggcaaaactctgggtatggtagtctgtaacctgacttgtaggttattacttgtaggcgcgcaagcgcaacactaaccaactaaacacaaagctgacacgccgaatcgcaggatcatcagaaaagacattgaaaaaaagtttaaatgttgtgcagacatttgtgaggtgatcgattggagattttaatcttaatgcatgctatacccttgcgccagtgcagattgcaacaaaatcctgaaaatagcagtaaattcggttccttgtttacaatccaacaaagctatcgcctttcatctagcatattccctccccttccaatcctgggagccgggtgcaaccggacggcaatcccctccctaaaacatagtcccttttccgatcaatcagaagaggcaacaaaccaagggtgcccgcggcgtaaacgatccccacagattcacgcccatgacgaccatatctgatatctccataacgccaaaatgcatatatcaaactaattaactaagatttcgcaaggaaacatggagagagtaaccggaaaccaaccagctcgaacggatgatctccctccagttgggcggcggcaggttccgcggcccggacacgtggaagtcgtagg

SEQ ID NO: 52579 - DNA, 1501 bp, Oryza sativa
ttgggtgctagctgcagcctgcaggtttctgctgcgcatgcgaagctcactgaattttgtcacctcctaattaccatctgcagcgtcagaaatcagaatcaccttctgagtttctgacaaaggaaagaaggccacaatgagacggatcggatttattagaactgaactcacatagaaatcggtctcgcggtaaaatattgtagtagtcttgatcaattgttttctactaccagtagcgaccactgtaaaagttatttattagcatcggggtatccctgattccctactactgcatactgatagagagtgcatacgagagagctagcattccgtcgccattgtcagtctgtcatgtggtttctgcagtctgcggggacgcatgaatcatcaatgggaagcaaacaacatgcttccatataattgaggtcactcgatcgctcaactcaaggcataggcactgctcaacaatgcgttgtcaaggaggaggctgtaaatttttgtggtccaaagtgacctcttcactgtcacctcaatataaagagctggtcgccgtcagaggatgcatccgctgaacctgaataatggatgctcaccgacgactgcactgctggaccgttaccaaaatgtgcatcagtagatgtcatcagaagtactacaatctagcgacgatggcgaagagaaactgtacagcaaatcgaccagcttactagaggctcgtctccagcgtacagaagagataggcccaaaactattttgggctgttcccgtaccgtactgagcttaaaagggcgcggccgctacagtgttcggagatttggccctacgtagagcttggacgatcgttcttaattacttcttcttagccttcgaatttccacatttcctcccatttttttttatcttggttttgtttgtctctttcaaggcattactaagtataagatgaatatttatttttctctgcatcttcaactacgactccgtggcccaatggataaggcgctggtctacggaaccagagattctgggttcgatccccagcggagtcgttttgttatttcaatattaaccattttaaccctcgatataagccttaatcgttcttttggtcgagattccggtggcgttttcattattttgtcatgatggaaatggaaaagcttcagaaccactccctacaattttggtggccttcttcatcatctgccatgctacatttcattctggaaaaagcttcagagctgcacccaacgaacatcagctaagcgaaccatcgaaagatcatgacatggatgctaatttgccatgctacattcattctggaaaagcttcacagttgcaccctacgaacatcagccaagtgcaccatcaaaagatcataatcataaacatggatgctaatcggtatccagacatactagtatcccttatatcccttgtaacaatttagagtcttgaaaacctctgacagaagatggaacatgaaaaatatcaatgtatt

SEQ ID NO: 52580 - DNA, 1501 bp, Oryza sativa
ggatcgcacacatatgatcgtttactccagatagactgaactgaatagctccagtagcatcaaatttaaacagacagatgattcagtttataatgaataaactaacggaacctgtacataaactccacccatgcagcaagaatgatagccgatcagagcaagaagactttgtcagaaatcagaacatgcctaggaccaaattaaccaacgcagcaacgatggtgccaaaacgtatggaatcgccatctccttcctgacctaggcggtggcggcggcataacacagaggaaaacaaaaaaccaatctcctaatacaaggaacatggcatatataggtggtacaaaggcctagccagctgaacggactaaagcccaacatggactcctacataccgatccaaataacagaaaaaaaaccttattaatgtaaaaccctgattacttggtaatcctgccgctaagcatggaaggaaagcatccacatgcatgcgtacatgcggacgttgtgggagaggatttcgtttttttgtgggtcctcatctcctctcctcccaccacgtgccagcttgagagcgcttttaggatgccacatgtcagcttgagagcgattttagaaaggttaatggacttttagtatataatagaagataggtaaagaaaagataaagattaggaaaggagatgaaaattagattgaatacaaaaatttagggacggaatattcagtttttgttagcaataaataaataaataaattcctcaataagaagggggtttctcttttctttggcgcgtgcgttcctctcctcaggtggtgactcggtcaccccttgcctccttcggccaccctctcctcctctcctctcctctcctcttcctcttcctccctctcctcgtcgcccttccaccaaagcgagagatcgaccgactcctctccctccgccgccgacccccctaggtgagcgatccagcctagatcctttcctcctcctcgcgttgctcgatccccactccgttgttgtttcctacctgtactgtatcgcgcgcggttcttggggggaaaaaatcctttctgattaagatacagaattgttttaaaatatcaattaattcttttttttcaagtctctctcgctctcgctccggcgtgtgcggcgcgtgtaatgggggattggtcatactgtaatgggggattaattagttacaatgtgttttcttggtgcctgaaactctgaattctttaaacattattgtcattgtcctagtaaattatatatttcatcgaagatatatagtagattctaggacgaattcgatttggacatagcaattttctgatatctctagtaaattacaatttaattccgaaatgttgggtgatacaggtatttgtctttcaccttgagtcggccccaatttccaatcttgatcttgacttcagcatatgaatgttgcttgatctgtattcgacctatgcaggtgttgttgatcgctttgcgaaa

SEQ ID NO: 52581 - DNA, 1501 bp, Oryza sativa
gataagagtttttttttctactagtaatgtagccgatccatttggatatctatggataacctagtgatataatggactcatgatggattgaccctattaaaccatggatcaacaaactcacttaaaactgtttggttcaatccatatcctaaccattcccatcctgagtcaaaacaggttttaactaaataccactatgcagttcggattcgctgaaataccattctcaattgaggggcttcgccgaaacaccattttcttccaattctctctttcctctcatctttgttgaccaaaatgcccctaattgaattaattcaagtaaaacaaatatgtagattacagagtatatatcacctaaatatcttgacatgcaatatatatatatatatatatatatatatatatatatatatatatatatatatatatatatatatatatatatatatatattcttttctttacactaaattatagagtataagacactatctttacatcataaataaaaataatttttatatcattgaaaacattgtgagtttttgagatagtacgttgcatactatgtaatctggtgtagagaaaaaaaaaataacatgtaaaactatttttggcgtatttactttataatctacgtatttttatatacttatattgattcaactaggagcattttggttaataatgatgagagtaaagagataattggaagaaaatggtatatgggcagagccccttaattgagaatggtatttcggtcaatcccagctgtatagtggtatttgggcgaatacctttttacgatggtaaaatgtcaattttctcgcgctggagcgtggccgtgcccaggcgaaagtcctaatgagcgattgatcgctggcggcgatcgtttttttattttcctcttttattaagtttatacgcctaaagtttacacatctaaagtttatccatctaaagtttgtacagcgaatgtttataagtcaaaagtttatatacccaattcaaatttgaatttgaattcaaatattttttttatatatagtatttctatacatctaaagtttatacacctaaagtttatagacacaaagtttataagtcaaaagtttatgtacccgattcaaatttgaatttgaattcaaatattttatatatatagtatttctatacatctaaagttgatacacctaaagtttatagacccaaagtttataagtcaaaagtttacatacccgattcaaatttgaatttgaattcaaatattagtttatagacccaaagtttataagtcaaaagtttacatacccattttaaatttgaatttgaattaaaatttttttatatatttctatacataattttttccaactttgttttttatatattttttagagtaaatttcacaaaactacatgttttgtggttcaagttgtagaaaaccacacacattttgacacttggtacttaaagtacatatattttggttatgtag

SEQ ID NO: 52582 - DNA, 1501 bp, Oryza sativa
  unsure (1)..(1501): unsure at all n locations
tccctccctgcagcgggggaatcacnnncccgcctcctcctcctcctcctcctcctcctcctcctcctccgccgccgccgccgtgccgcttcttctggatcttcccgcccgccatggcgatgggctcgcacgtccagccgccgccgctggaagaattgggagaggccggaggcagctccgcggcatggctggcgcgtgggggatgggggaaggcgggagacagtgcgacgcggggaggagaagcgagtgcgccggctggcgggacatcggcgcagctggcgcgcgcgcgcgagggagaaggagaagcgaggtgggcccgcggcgcatctctctcgcacgcgcatgggggcagaggagaagcgagcgcagcggcagcgggggaggggaaggagcgcttcatggcgcatctctctctcgcgcgctcgggtgcagagcagaagcgagcgcgggcccgcgccgcagctcgcgcggcgctgtgcgggacggagaaggagcgcggggcaggagaagtgagtgcgaccgcatctggcggcggcatcggtagggcggatgggaactaaatggatttcttgacactgtcatcaaattgaaagtgaataaagtatagtgtgtagtgttaaaaataaagcaatagccctgtaaaaattttagtcaaagaggaactgaaagaggcttaagagggaaataaatggaattaatcgccggtgatggacggctcattgttggtgagtaaatgtgtcagggttatggataccacatacctaatagtagttgactaaatctcggcaggacccaccacataccatgtcctatacggaaacaacctgcggatataggaggagttccggataaggaaagacaaccagagttttatatggaaacgacaaggactactcggattgtatctatattggttttcctagttctacttagacaaggggacacttatgggtataaatacaaggccccctaggaggagaggggatacagacaacatagacgccacaaagccacgagccaatacaagccaacatacgtcaagataagacgtcagatatcgacatcagagatatgcctagatcgaccctatccggtaactacagaggccagccgtagggatctagtgctgtctttgatctcgccgggcatgaactcgaggaggaagactaccctgttgtcgactacgagtcaaaccttcagaccgccatgtcgacaacagttagataggctatcccaaatattgtactggtgtgattatggtgaataagagcaataccggctttggccaacaggatgtagggttattgcctgacaattcaggggcccgaacctatataaaaatccctgtgtccgtctcttttacctcagtcccgcgtatatcctagtaccaacgatccccatactatgcaaataccggaatcgtgacatcaaacgtcgacagtggcgcaccaggtagggagattttggtgcttctggattttgacgagatgggtttaagata

SEQ ID NO: 52583 - DNA, 1501 bp, Oryza sativa
gcagtaccttgatgcactagagtacttcaatatttttggcagcaatgacctaacacaattacctgagagcatgcgaagcctcacctccctccacaagctaatcatccacgactgtcccacctttggcatgctgccagaatggcttggagaactgtgttctttacagtccctgtttatcaaggggaccccaatgatggacagtctccctcaatcgattggctgccttacgtccctcacgcacttgactattgcatgcgataatttgaaacagctgcctgagacgtttcaccacctcacctcccttcgagaactcgacttggcaggatgtggtgccctgactgcactgccagaaaacatcgggaaactctctgcacttgaagcactatatgtcggaccgtgctctgccattcaatgcctgcccgagtccataaaacaccttactaatctccggcgattgaacatttctggttgccctaatttggtcaagcgttgcgagcaagaagtgggggaagactggcagcttgtctctcatattcctaatttaataagtgactaaggctctgagggcagcatccgacccttggtacgttctggagtacctgtcactgatttgctacatcagcttgtgtttgctaatgttctaaggtccctgctttatttttatgtatgagtattgagtttacagtagtctcttatactggtactaaaagcacttgtatgcttcgtatttcaagtttcaacacagtcttgcctgcctctcttccctagagtgtggttctacttgttcctcccaatataacatgtcctctacaatcgcactcctgttttcttctcgtaatgatagatttcatgccgatgctaataaactacgcttcttgcgtacaggttttcagattggagaaagtgataagaaggattggactgtcgaagactgtctgctgagtacatttcttcttctgctggaccattcagaaaatgcttccgtgcttcttttgtactgtatgctgatcatcttagatctataccgtttaaagagtgtggagactacaactttactctggatctcgtcttttgtacttctgtatattggtcatcttactctgctagagtctggtctcactacacgcgtttggttagcatgtgacatgtttttgctacttactcttgtggtttctgtgaggagtcacatttgatcgatcaattactcttgagcttcctggaagcggtggtgatcaagcttcttttcctgactaagcgatatcctaaactgtacaagggaaggatatatatatttgtagtctgctttactgccatttcatgttttgctaaattgtcaattccttatcctcagattcatcgtaaaaaagtatgttttgaaatcatggaaaaaagtctaatcataaaagttggtgattgcatggccctttctttatgtatcattttaggatgcaggccgtggcaccttcgtaggtcactacagtagttcatttgaattcctaaa

SEQ ID NO: 52584 - DNA, 528 bp, Oryza sativa
cacctaacccgcgatctgaccggtctgtgaccggtcacacactgcgaccggtcacggaccggatatgcgtgcgccgtgctgcattaaatgcggcgtggcgcgcttgtccattccgcaataaaagtggtttggtgagcgccgctgtgcccacctaacccacacccgtggcgccaataccacagggggtcggggcgccccagccctcggggccgaaacaggagcggctcgacccctcggggagacagaggagggggtgggcacgtccccctcgggcccgaccctcccgagggggttaggccacgtgggtgaccgcagctgcccaagcctctagtcatgatactcccggtcccatgtcaccgacagtagcccccggcgttatgccagggcgatcgcccccctcgagggaagcgctcgggcgtgacgccactctttagacctggtgacaggtggggccgctctctacaggcgggcaggaacccagcggtcgcaaatcgcgtgcatcggctagggaaaaacgaccgataacaa

SEQ ID NO: 52585 - DNA, 1501 bp, Oryza sativa
cccctagctaattaactgtcaggtaattaagctagtactcgatccataataattgttcaataatggtcatcagtgtcaaagatagagattgtttagcattacagcgtaacagtgtcatagtccatcccgtgtctctacgtctatgactctatgtaaacatttatatatctgcatcgaataattgaattgattgatcacttccaagggaacggagatgaccattcattgactccactgtactactgtagagttagtactgaaatctctgagggcacccacaatggttatctataggctctctacaagagatctatgtcagtatatttttctacttgaaaggtattaaatgaagagagagagcaaagctatctactaatttagagatagtctatagagaaaaacgaggcaatgtatgagagagctatagataccaatgtagacatactattaaggtggtttactattaatcgagtctattgctgagatgtacatgttttatagagagcaccttactttaccattgcgggtgctctgatgcttcttcagtccaagtaaatgccattggcttcattcagtctttcaagggaggactcaactttgcatcagaacgcatgcatatgctgctttatactccaccaccagtcacgaaatataataattttaaactacaaatttaaacaagcacttctttaaatttaaaagttagttactatcactagtagacataggggttccccacccaaaaattcgtaaaaacaacacattacatacttagttatgcttaatttagcttaatactttactcttggtcctcttttttcttgacaaatactgtatatttctctggactattgatcacatcacttatactttattcacgtcactgattactatgattaaatattaatggaggacgacgacgaggagataaccgcggcactgcaatgacgaccatgtttgtgtaggagtaggcacgagtatgtccaagtgtgaagtagtctacggggctgcaataccaccggcattgtatcgcgtgcatgaacacgtcagacctggactctcctatcaccatttatttgtgttaggccaaaacaattaaaactgcagtggactaaaggatcatcgtcgtcgacgatcactaatgaccatatcgacgtctgcttcgtgcttgactctctcctccctcgaccagtaattacttctctcttcggtcaatttccattttcatcccggtcagacccggtcaaccaaatactactactactacatccatttacaaagagtagtgtgatcttacatacatggataaaatgtatgatgaaacatccatgataagaattgatcaggcaagcaagcatatactcaaccatgataagagtatgatgtaacatccatgataagaatgtacaggttaattaggaacaggtcggctcttgcatgcgacatgcgtgtccgaatgcagcatccatcagcctgcctacacctgtgacctgcaactgta

SEQ ID NO: 52586 - DNA, 393 bp, Oryza sativa
tgagtagttattgtgtgacgtaggtttggtcaggagtaattgcctgcctcctccggcctcctcttgcgatgtgcagtgcagacccaaattcaatgtggagcagatgcaggcatctgtaattctggctgggaaacacggttcagacatgtaccagtgcatatgctcaccggagcttgctacaagattaataagagcaagctatataagtctaaaaatttaagtggagtacgtacttgaagtataatcaagtgttatgtagacgttgttaactaaaggattgatctatggtagtattaccgaattattaattgttgactagaagaaaaaaattgagcctaatttgctgatacatgtgtctaatttgctgtgttctgaacttccactacaatttac

SEQ ID NO: 52587 - DNA, 1501 bp, Oryza sativa
gccgtcatgggtcgcggcaacaacaagcaccagcttgggcggattttacgcatgctcctcgctgggcaacggcggataggaggcggtcgggtgtgcggtactcggtggccatgggaagtggctgcgctagggttagggtttagactcgggagagagggcgaatgaggaggaggcaaggaggaaataaaggtgagggatttggaaaagacgtcgccatctaggaggagcagaggggggagaaggggtggaggtcaaatcgatctcgatacatccttgcccttgctcttgctctcgatgcaatgtgtggagaaagctgataagaggtggatagagatggggaaaatagaagagaggaggatagaggaaaaagatgaatctgacgagtgagtcccacacacagatggggaagaagatgaaaaacatgacggtgatggcatggttttaattttgtaaaatttgtatggcatgacttcgaatagacgaattatattgacatttatctgaatatgcatatttataatgacgcctattaaataaacccttaaaagaatttactgtaagttacatgtctttatggacaaatgctggaacgagcaatagcggttatattcaataagatatagagacaatgagcaatcatatgttatggtccataacaccatgttcaaatggtgtagatatccgtgtaaaaatgtttatattttggagcggatggagtagctatttttggctaccaatctaggtcaactattatatttaagatcaatattaagttacagagtacctagacaaccaatcgaactccatatcgtgtgacttttggtatatcctctttaagattcatgcatagccccctccgtcaaattggactcattcccctcacccctcatcctccccacgcccatggtagctgggtgtacctgccttaccgttttccccatctcgtgtgactccacaccacaagctaccatcgaatagtcgcttcgtctgctcctgttggcaacactgatccactgctcatggttgactccgtggctcggttgctatcaccccatctgtatgtgtccaccgcctagatataaatcttaacctgaattcaacgggtcaacaatatcctctgactttctagtgtgttgtttcctcctttctaaaataatttcatttctcatctatcaacgcatatcaataagaaaattaaaatgctctcaactttatcaaattacaatacgattatttttctactctatctactctaaatgtatttacctctcattttcataaacttctccaatgtaatgattgatgaaaaataaatttactctgtgactaataagagcgacgaaaaataaatctattataaaaaatagattatttagcaaattcaataatttattagtctccagcagtcaatggcacgacagcccactcctgccccagtgcaggctttctcatgctttggttgtgtttagttcacgtgctaaaattttttttatatatggac

SEQ ID NO: 52588 - DNA, 234 bp, Oryza sativa
cccctacatctaaagggggcgaaagtaaccacgagtcgttctaaaactgtattgatttttctgaacgggtggaaatggtgagatccgtgttactagttaaaatatcccgtgttaaaccctagcccaggcggatggatcttagacatcgaagtcaaagggagaccgggggaggaaacgcgcctagctagatctatcgaaacgcgggagacgaagcggagtcgagagatatccagg

SEQ ID NO: 52589 - DNA, 1501 bp, Oryza sativa
agaacttcaggaggaagctcttactgcctcacatcactggagcatcagcggctcacgcgcatcaagcgtggctaaaattgcgtcatcgtccagtgattgcagttgatttcccagcaatgtggaatgtgaataagctgcagccagcacatcctctcgtccttcaggataaggctgttcatggagcgcaacagcagcagctcaacaggagcgtgagactgaacccatctacaggatattgaaacgaagcctgaattggaacagggaaaaagctcaactgaagaagagcattcttgtccattgcaaatccaggggggtgatgctctctgcctgccaaaagaaatggttggtttgcttttttctgaagttctttatttaagttgtctgtcgtgcgtgatgattgagtttgatggtgtgctactgcttaccagtatgtgtgtatgcttcgttcgatagtctccaatttgttgttttgtattcagtggtgactggtgatctactgatctccaattgcactactgtatggtatccgtttggaatgagcattgttcgtcttgatcacctatccttgttatcacgcttgtgcttcagcatgtgcatctctgaataatgcaatcgtagcagttcggcatctggttataagatgcagtactgactactgagaagtcagaactgctgttttttactcttgcatattcaattctttgcaaatttccacgcgtataagattatgatatgaaacaaggctggaaattggaatagtttactttggacatctcaaggaacataaaagtatgacaggattcatacaaaagggaactcacttctgccaagtttgtgatgtttagcacagaacaaatacaagaatatacaaaacaatgtgctacatggcacatttatttctacaattgaacaatcaatacatatttccttgctcaaatgcacgcgacaactatcatccgtaaataccaccatgtgacaaaaagatgcacaacaaactagtctccaaatgtgaaatatgcagtaccattacggatgatagcgcagtagcaacctcagaggcttgacttaaagtgcagcaaagaatactgatcgaagatggctcaagtgcctttgattacaacaactggacagaccacattgttgatgcagtagttgctcacacttcctaagaacattctgtagaacaaaaccaactcagaatttcaatcagaaaccaaaacaagacgattcatatttgatatagaaaaaaaaggggaataaataagctgacaatcaaacaaaatcaagcaagaagtacttaaaaatcttcatgacctagatacatgaacactagatcaactgcactccataaaataggagtcagttgcgccgagcatttgaagattgtatgggtataggtatggcgagcaggccagccccccttggattttaggttcttaactaccgaagtgaagaaaagctggatcaagaaaaggaggggcactactagccctctgcccca

SEQ ID NO: 52590 - DNA, 1501 bp, Oryza sativa
aggaatctttagaagaaaataggtgcactattacaaaattatcacatactactagtgaattaaacaacattaatcaacctaataatgtgctttagttgcttgatggcatgatttgcctcgttcccacgcgaagggagagaaaaaagaggtcagcatggatgtttttcttcctatgatcttccagtgatatggctagcgtaggaaatttctctatgtatttcctacgaacattttcatgtgatccaaatgacgccacagtaaagcaatccataggaacccaaatccttcatttttcctgtgtttctcctctattctgaacaagccctaaagaaattcaaggaggcacctgaacgccggccaattagtgccagcgcaaacagccgatcgctgagaaaatgtgaataaggcaaagcgcgaactctggaaagcgctcgagagaggtcggccggcgacccaacaacacaccaccaccggcctcgcgcccgcggcgcacacaagatcgccacagcgccgtggtcggaacagcgaatccggccgcctgcaggcacaggcggcagtgccacctccccacccccccaatccgctgcgtttccctctggcctcgtcccttcccaacaaacaaacccgccaccacacggcgcccagcgcccgtgctctcctctcctctcctctacccgcccagcccagccgcccatcccccctcctttccgcggtccttttgctcggttcagcacgcacgcgggcacgcggcacgccatcaccgcgcggccggccgcctgctgctgctacagccagtggagtactgttctgggccgcccgcgccgcccgaagccaccaccctttccttttccggaagcctccccaatcctccgccattccccgcatagcgccccatgcccctaccgaccatagcctcccaatcccccatcgcctagctgcttccccgtttattttaagatttttctttgggttgtgagtaaggcttggtggggcccagctcacggttccttctggcataaacaatgacttgggcctgcccgccccgtggcctcgccatccgacactgtgcctctcatcccgcgattagtatatttttgctgtttttttatgggtgaaaaactgtgtgggctctctcgttgggttgctatccgtccacccgtccattcatcctcgcctttgccagttgcggtgttgcccccctcgctttatttatgtcgacctgccaataggagcaagtccccgtctcgagacaccagccgcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcga

SEQ ID NO: 52591 - DNA, 1501 bp, Oryza sativa
gtctggctaagtagtggacacatgttagccaacatgaacaatagatgacaatatggatgacgccgtgtgcattggtttgagtccaagcatggaaggtggtgtgatgtgaaagttaatttgtcatccctcggtgcaaagcgaaggtatatatgaaaccgggtgtaaagggaaaacaaaataaatctacccgatgttaagtgcaatttactctttatttatttttacttatttgattatgctgtaaccgagttggatggcaaaccacgtatggtgtgatagatttacttccaccattatcctcctttttatctcctacatatgtgtttacagttcgcttatagtatgctgttgtatatgctctcactgcaaactataattaattaacctgaaaaatataacaaaggtcctttcagattgctgccgagtctaagggctcattcggaatgtaggattgaaaaaaatataggaataggaaaaatataggaataggataggaatgcaagtgtaaaacagatgatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttgcttgatggcatgatttgcctcgttcccacgcgaagggagagaaaaaagaggtcagcatggatgtttttcttcctatgatcttccagtgatatggctagcgtaggaaatttctctatgtatttcctacgaacattttcatgtgatccaaatgacgccacagtaaagcaatccataggaacccaaatccttcatttttcctgtgtttctcctctattctgaacaagccctaaagaaattcaaggaggcacctgaacgccggccaattagtgccagcgcaaacagccgatcgctgagaaaatgtgaataaggcaaagcgcgaactctggaaagcgctcgagagaggtcggccggcgacccaacaacacaccaccaccggcctcgcgcccgcggcgcacacaagatcgccacagcgccgtggtcggaacagcgaatccggccgcctgcaggcacaggcggcagtgccacctccccacccccccaatccgctgcgtttccctctggcctcgtcccttcccaacaaacaaacccgccaccacacggcgcccagcgcccgtgctctcctctcctctcctctacccgcccagcccagccgcccatcccccctcctttccgcggtccttttgctcggttcagcacgcacgcgggcacgcggcacgccatcaccgcgcggccggccgcctgctgctgctacagccagtggagtactgttctgggccgcccgcgccgcccgaagccaccaccctttccttttccggaagcctccccaatcctccgccattccccgcatagcgccccatgcccctaccgaccatagcctcccaatcccccat

SEQ ID NO: 52592 - DNA, 1501 bp, Oryza sativa
tgttttcttttgcaatgtgttaaatcattgcagagctgttgtttgatgagaaatatcctgttgttgttttcttttgcaatgtgttaaatcattgcagagctgttgtttgatgagaaatatggtagtctcctacacgtatcgttcgtcatatccatctcgccttatttgaggacaatgctttcctcattgcaatcccttttctgcgccttaattaggtattatactgttatgctgtatcgctatatgtatttacatcgtgctgttcagtcttgtttgcagctgtacaatatgagtttgtttatgatatactcgccctttaatttgttactcatgataacaaactgaaataatttactcatagatctttatcttgcatgtatccatttcgaaaagtttcctttgtcttaataaaagaaatgttgtactagtacatatctcattatatcttcatgtacctgtccatcacttcatcgtcactatatatatatatatatatatatatatatatatatatacaaacaaacaaaaatggtgttagctagaattctcttttgctgagaaagtatcttaattattatttcaggtttgttaatttgcatcaatttataataccttaacttcttttacttcaaacagggattttgttaaacaattgcaatttgttttatgtaaatttaagtacatcatttttcatttcttcgatgaatgtagattatctcagataagataacctgatacttcctttactcttctacatatgaatttgtttagttcatatcatatataaaagaatggacggagtatgttttttatggttttacatcagttgtcagtagcacaacttaagcaaggattcaacttctcttgatgtacttttttagaaatgtgcacatatacaacttaatttcatccatggtacaatttatttttagttcatttctacaaactagagttaagtgttggaagaagataaagaataaactgggatggctggtactgttatatgtggacaatcattcagccttggtagcatttaaatatgttcattttacctggtagtgagtactggtagaatccataaatcgtgcttctatcaataaaaaatcacactctataatattaattcaattttggagctgcaaggcttggtttatctaagaagttactatttataaactaacatttgtcttgattatttgttctacagctggacaatgtattgatcctttcttctacatttggatgccataatatctgattttcttactgttttctttttcagtgcttaattcctatatttctgtcaatatcaacttacccgtgttaatttgaccagggaaaaccactttcatttctcaagattactcctgcaatgttatagacttgtagtctacttggcccgtgcctttataattatgaacattcatgtataatttatgttctattttcgttttatctgatggtctgtggcctactgtggtattgatgatgccttctgttg

SEQ ID NO: 52593 - DNA, 968 bp, Oryza sativa
ggtgggccccacccgtcagcgagggggacgggcggcccagcccgtcagcggcgcgcgcgcagggagaggccggatgggccgcggggagaggagagggagggggagggagatgggccgagccggcccaagagggagtgggagggaaaagggactttttagagcttttctttttataaaaacattttaactttgtttatttcttaatgattattatttgtgctctgaaaattccactaaaatttatttacgcattttagacttttaggaaatatacaaaaattctccaagccttatttgacttttaactttgcacattttaattgttggaggctttcacacggattttaattattctaggcataatttagaggttgtattttagggtcgttttgggacgtgacatgaagtttattagagtaaaagcctttttccttcccgttggtcgtgtagacgctgcagcttcgttagatccgctcttcgtggaggttgaagccgacgtttgggaaagcgagcaaggcaagtcacatcatccttgaacatattgaatcccagtttatgaaattattttgatttaaattaatgcattatcactttatttaaattctcgcgttatcactgttttatttagccatgcctatttacctttgttatgaccttattattattgttattgttattattaccttgttcaccctagaataaacaaaactccaactagtgggtactctatttatggttccactagtatgaacttaggtagatgcttcgctggttaattatgcaacattaggtggttttacaactctaaactttgggaatgttcttatcacctggacactatggaatggttggattattgtggaattggattcacacctccccctctattcaaaatcctcaaaatggttttaggctgggctcggggtgcatggttttgatagtagcacctcggccacataaggaccggt

SEQ ID NO: 52594 - DNA, 1501 bp, Oryza sativa
attgcacgatctctttccctgagtaaagctgatctctttcccttcttttctggctatcattatttgtatggcaaatgctaacacttaacgccttgttgatctgaataacaataatgaaatctctacctgtcattcataattattcatccatgaaccgagaacagtcaaattcgtctatcttacaatccaattccaatcgcaaatggagtatttttttttcacaagataataggcatagggagaacaagtggcttatttaagctcagatcgagacctatcaaaagacgagaagaatcacattggtgccacgcagataaatcacaacatgaaaaatgtgaatcatgcaaattcggctaaattccacttatgttatctccttgctatgtacagattacaaaattacgtaccgactattggtcaagtcactgctgcaacaaccaatatcatcgacaatggatgcaagaaagaagagaacaaaaataaaagagagagaaaagggaaaaaaagaaaaagaaggtgaagaaaaaggaatgcacatcgctcagcattcagcaaccacaagacccggtcgagatcaaacaggcattgaaggcgatcgagtcagcggccggccggctcatgggcggcggcattggcggcgccggcggcgggcgcgggcgcgagcgcggcgtagtgcgcggcggggcggcggccgtcgtcgaagttcttggcgtagctggcggcgtcgtagccgaacgtgatgggcctggaggaggcggcgcccgacggggacgacgagctgcagatgcacctcgtctcctgcgccaggcgccggagcagccgccgccacgcgcggtggccgcaccaccccgcggcggggctgacgtcgcgcaccacgagctgcaggctccggaccacggcggagccgcgccgcctgcccgtgccgccggcgccggacagagaaggccacgaggacggcaggcagcccgatgagccgccggagacgacgttggcggcggggtggcgcgccgcggttagctctgtggtggttgtggtggtggtgcccgctcccatggtggtttggagaggcgcgcaggaaggaagaagtgggagagagctctctcgtggcggttatacctgtggttatatgggaagcgagacgaataatagcagtattaggctgttagcatgtcgagatgagaaaacaatggtggttattgggctgcggagtagacaagtggtagagtgagatgagctcatgggtttttgtggtggttacttttggagatggaatggacatgcatgggagcttgtgctatttttagacacaagaggatgagtgatccttgtgcagttgtggaatgagtagttagtggattataatttaattactgttagtatcttatattcgagggaatatgttaggaaaaatgttagtgatggatagtagcgaatgtgattttcaaggtgcatcttgtacttttttaaaaaaaaaatgtttgagccactgtaaatgtattac

SEQ ID NO: 52595 - DNA, 860 bp, Oryza sativa
attcctgcagccccgctgaaattagtaaacatttcataaccgatcactgccgttagagagctttacgaccggaataacttcttgcccaaaagctttttcatattgttatgttttatcatcgggatataattatgttccaagtggcattacgatggttcttttctacctatagacaacttttttttttcatttgcattggcaaaatcctattaaagttagcaaataatactcactctgtttcatattagtataggatgttttgaatctttttctagttaaactttttaaagtataagtttgaccaactttacagaaaagcataagaacattttcaacgcaaattaaatgtaatatcaaaatacatatatttaatattaaagtttgccttatagaaaaaaaagataaaaacatcttataatatggataaaacggaggtggtacatatgatcccaaaaatgatggaaccaaacaatcatatgagacacacaggtccatcacatgagacacaatggcaaagcctgttccaacctgcggagccgtacacgtgtaccacaggccgtggaatcaaccatcctgaaaaagaagagaaaggaaaaaggaaagcgagagggaataatgtaagaaaaaaaagaaaaaaaaagctttggaatgaggaggaggagtggcgtgatccgctccaccaccggcgtcgcctcgccgtggcctcttcctcttcctcttcctccgcgtataaatagattcccctcttggggccttgcctttcgctgtcagcctcagccaaactcttctcttctcttctgcctacttcccacgccacccccaccctcgccgccgattccgattccgattgcgctcgccca

SEQ ID NO: 52596 - DNA, 1501 bp, Oryza sativa
ccctcctgcgccgctttttctggttgagcagcgccgccgaaaacggcgtgccgctacgctcgccccccgctcgcgttcacctgcgcctgggcacggggacgcggctaatgaacgcttatccccatccccccgcgtcttctcttcctactagaccataaattaaaaaaaagaggaaatttcacaaaactaaatattttatggtttaagttatagaaaatcacacatatattaacacttggcacttaagtacatatattttggtagtttagttttacaaaaccacactatcgatgaatagtttcacccgtgatattatgtggttgtttcatctagtctgaggacgtggtatcatattaatttcgtgcgatggctgataatagaatgtcatgtcctcgtcctaggtgaaacagccacatcatctcgcgggtgaatctatacatcgatagtgtagttttgtgaaactacataaccaaaatatatgtactttaagtaccaagtgtcaaaatgtgtgtggttttctacaacttgaaccacaaaacatgtagttttgtgaaatttactctaaaaaatatataaaaaacaaagttggaaaaaattatgtatagaaatatataaaaaaattttaattcaaattcaaatttaaaatgggtatgtaaacttttgacttataaactttgggtctataaactaatatttgaattcaaattcaaatttgaatcgggtatgtaaacttttgacttataaactttgggtctataaactttaggtgtatcaactttagatgtatagaaatactatatatataaaatatttgaattcaaattcaaatttgaatcgggtacataaacttttgacttataaactttgtgtctataaactttaggtgtataaactttagatgtatagaaatactatatataaaaaaaatatttgaattcaaattcaaatttgaattgggtatataaacttttgacttataaacattcgctgtacaaactttagatggataaactttagatgtgtaaactttaggcgtataaacttaataaaagaggaaaataaaaaaacgatcgccgccagcgatcaatcgctcattaggactttcgcctgggcacggccacgctccagcgcgagaaaattgacattttaccatcgtaaaaaggtattcgcccaaataccactatacagctgggattgaccgaaataccattctcaattaaggggctctgcccatataccattttcttccaattatctctttactctcatcattattaaccaaaatgctcctagttgaatcaatataagtatataaaaatacgtagattataaagtaaatacgccaaaaatagttttacatgttattttttttttctctacaccagattacatagtatgcaacgtactatctcaaaaactcacaatgttttcaatgatataaaaattatttttatttatgatgtaaagatagtgtcttatactctataatttagtgtaaaga

SEQ ID NO: 52597 - DNA, 1501 bp, Oryza sativa
acaccaattgaagtgctagagttggtttattacatgtgcatctcatgtagccagcatgactcacgcacccaacttatagcatatccagatgtccgttcgcaatcatgtcgggtgatcaagccgacggcgttcgcgaggagttatccgttaacaaccttttctcgagtagtccagccatggccggtgctatgagataggtcatcggtcttcgttggtaggttaggtgcgacgactctgcatttgtcgagatcgttctcgacaatacggtgtacttgaccacaacctactcgagtgctcaatggttcctgaaaaatattttctagaaggtaagacatatagcagagaatatcgagtatgtatttgaaaaactgtatggatcttctagtattatcaggatatagcgagcagatgtaaatatcaggcattatgtaaaccgtaaacaagcatgatttatacggaagaaaatagggcgagctcccagcgttagactgtagtcggcctaacatcgggaacactcgcacgacagatattgtataaaaaacatgctctagataaacataataaattattgattgaaaatatctgaaaataggtacggtaaattgcatataaaatattgcgtacctttgtaaatacatgtcggatgtatctatgaaattagtagattaatttaaaaaaccaatctaccaattaccttgttgcgcactcgttcgacatcatacgatctaacatcttttggtacgctgcgaagcttgaggcttggatgatctcgatagaccaagttgtcgatgacgacgatagttccgatctcatcggagcatgtactctggtcgggttagatctccacagccgaagtcgtcgagtagcttggagaatccatatcttaaacccatctcgtcaaaatccagaagcaccaaaatctccctacctggtgcgccactgtcgacgtttgatgtcacgattccggtatttgcatagtatggggatcgttggtactaggatatacgcgggactgaggtaaaagagacggacacagggatttttatataggttcgggcccctgaattgtcaggcaataaccctacatcctgttggccaaagccggtattgctcttattcaccataatcacaccagtacaatatttgggatagcctatctaactgttgtcgacatggcggtctgaaggtttgactcgtagtcgacaacagggtagtcttcctcctcgagttcatgcccggcgagatcaaagacagcactagatccctacggctggcctctgtagttaccggatagggtcgatctaggcatatctctgatgtcgatatctgacgtcttatcttgacgtatgttggcttgtattggctcgtggctttgtggcgtctatgttgtctgtatcccctctcctcctagggggccttgtatttatacccataagtgtccccttgtctaagtagaactaggaaaaccaatatagatacaatccgagtagtccttgtcgtt

SEQ ID NO: 52598 - DNA, 579 bp, Oryza sativa
cttgtgctattatatatagagagagtacgagtaggtgtagatggaaaagaaaataaaaggatccaaagtaggtacgtatacacgactttgaatgatcgatacgatgatattttaagtgtgacaatagaagctctctcaggtcgtttcctcctagcatatgattcgatcaagtggttctgttggatggaattgtcaacagtgcttattagcagcagatatactcctagtcctagttaacagtgagtgaagtacagttggagttgatccccatttcgtccatagaagctctcctaaaagagacaacaagagcgagtgagcgagcgaaatacccactgccattcattctaccaaaccaaatcaaattctcgcttcttcttggacgccgggaacaccaaaccaacgaacaaacggcgaatccaagtttcgattcgattcggttcggttccaactccaatccgcggcgccggcggcaacaatggcggcgctccacgcactccagcgatctcagtggagaatgaggactgaggagtagtgatctcgaatcgtgcagagcagggctccgcctccagggcagaggca

SEQ ID NO: 52599 - DNA, 229 bp, Oryza sativa
aagagtaagcaatccaacgcataaatatgcaagattaacattatcaaaaacaaaaatgaacccatgataccatgctaatgcccagttcaagagagtatcaagatggtaataaaacatagaacatgggcttttagctctatcacatttgcattttattccttttcggatttttgaagaaaactatagcacaatcgcgatggtacgcctaatcttatcagtcagcgagtga

SEQ ID NO: 52600 - DNA, 1501 bp, Oryza sativa
acctgaaacgtgtgtagaatcgtctgatacctactcaggatcatcctgttgtgtagaatcgtctgatacctgataggtatcacacctgatacctactcgggatcatcctgttcgaaaacgggattccgttatatagcagcccccttttttacctcaggttaaccgggacgatggaaattgctttatcagatttttctttttgtgcatctcttcaagaaagtaggtaggttttgttatgtaagttttttttattgtacagaagatgcacactcactatgtctggattcaaacgtaggattaggttttttgggacagagggagtacatcacattacactcacacactttttttattacatggtagacgcacacgcgaaacaaactccaccacactcgtaaatacgttccctatcaggtacataatattcgtgggtggatttaaaccctggtggatgaagtcatacatccacgtctccaccctcacgccacttgtgctttcccatcataagttttacaccatcaattacgaggcgattactttttattttgtttcaattttcagttatgtctaaattgtttgaagtaacataaacatcttactaagggtgtgtttagttcacgccaaaattggaagtttgattgaaattgaaacgatgtgatgaaaaagttagaagtttgtgtgtgtaagaaagttttgatgtgatggaaaagttggaaatttgaagaaaaagtttggaactaaactcagcctaagtttaaatgctttcaaataaaaacatttctaaagattgcatcatcatatttgatgatttcagaacgcccaaacccaaagcacggcaggaagaaaacctgaaggcgcagcatgggcacggtcgatggaggttgaatgcacgccacatttctgacatcttgtattgccggacgaaaaagaactgttttgcacgaaaggagagagaaggcagaagtggttagttgggggaaatgggctgggcttgttacttgcacagcccaacaaagtccctcaaaagggcctagcccattaagcccattggacgaaaccctaaactctttcctgaggtctttttatgccgccgagccgtccccttcctcttcctcctcatcagattgtttccgccgccgacgcgccgatctcctccttccagttccaggtgggttcttcctcctttgcgtgctgctgctttaatttggtgcgcacatatcgaaggcttttaggcgtcgagtaatcaaaaggcctaatgagctcaaagcttgtgcaagatcgatcgattttgtcaattctccatccacacctttgccgcctccattaggcatctgggatggatggatgttgtccacacttcacttgttcttctttatcaatctttgtttgcttctacttcactagtaatagcatgttatggagattgtatatatgtaatggagtagtaggagtattcgttcgatttgattaactgaactgaactagcctccaggctaagcca

SEQ ID NO: 52601 - DNA, 1250 bp, Oryza sativa
tcctgcagcccgtgaggctacacgtgggcccgccgcatccgcgtcctccgcgaaccgcgcgcgtgcaccgcgccccacacctcaccctagcgccgcgccacgtgctccctcctcacggtgagccgagcgctgacaagcgggtcccacccgggaccacgcgagatgagcccggtccaccggctccctctctcctcccctcccgcgcgccctactgggccgaatcctcttgggccggccggcccattagctcggccgagccgcgcttcttctctcgggccgcgccctagccgcccgagggaagtctacttctcctctctctttcttttctttttcaaaaaggatttaattaaatcgttttcctttagaccaaaaatccaataatcttagaaattcaatatcttcccaaccgtaaatccgtttgactccgttcaacttccaaaattcctcaaatctcgagatctatctaatggcacgcttagaggtcattaatagggttttattttcgccgtttgttgagttgtcccgtttcgcgtgtagtttcggagcccgaagacccgcagtgcgaggatttcgaggatcaacctccagatctcgagcaaggcaagccacctttgaacatcttgagcctatatttgaatttaattgtgttgcttgaaaaatattatgcattgataggatcgcacttaatctgtttgtcccgtctgcaaggcagattagcggacctacctagtttgttgcatttgatccttcctttgttaattgttatcccatgttcccttgtgaccacccagttgcgcctcggaaaccgtgcactctgcacgagtatcgacggccgccttcaaacataaaatctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaacgtttccttggaatttcatccaacataagacaagtacgaccacatgggtggaatgggacacccctagctgagtaactagtgtatcaggggagccttgatgacgagagacatgtggattcgccggggtggtgtcggggaggacccctgggcttcctggcacagtatggtctgggacctaacctgttgtcggtctgggacccctctcgtcggcatatggtaaacctgtgtcggctttggaaatgccttgtca

SEQ ID NO: 52602 - DNA, 1501 bp, Oryza sativa
aataaaagaaaataaagaaaaagaaagaaaaacaacaacaacaacaaaagtccgtttctcctaagtggcaaaaaaaaaccgtagatccgattcctataaaaggcaaaaaaaaagtggtgaaaaaaatgctagatctaattcctttaaaaaggaaaaaaaaaggtctaattgctataaagatgaaaaaaatcccaaaaaacatctaaaaaagttcgtccgattctctaagaagaaaaaatggttcgtaaaaaataaaaagctggttcatataaaataaataatgcgcgcgagaaaaaaaatgaaaagggcgaaccaaattccgatttctaatcttcgttatgtctaatctaatctaactatttaaaaagagaaaatgcatgacaataaaaacagttcaaagaaacgtgtgagaaaagttagaaaaaagcgcaaaaaaaacacgctaaaaaggttttccatcttccgtaaaaaaaataaaaaaccgcgtgacaataattatttccatcgtcggtaaaaaaattacttaaaaaaaagggaggaaaaaactgtcagaaaaaacacgccatttctaaaaaatggtttaaaaaaaccgtgcaagaaaaaaacatcgtcgattaaaaaataaatcgctctgaaaaatctgtcagaaaaaaaagctaaattgatggacgcttgagccggataggatccatcgattttttgtcatctactacacggttttatttcatcagaaatttgttttaaaaaaaaacatgcgaggaaaaaacgcaccatttctaaaaaatggtttgaaaaaaccgtgcaagaaaaaaatcttctattaaaaacaaattgctctgaaaaatctgtcgaaaaaacgctaaattgatggacgcttgagccggataggatccatcggttttttttgtcatctattacacggtttttatttcgtcatatattctcctgtattggaaaaaaacaaaaaagaacattcgaaaaaaaagtaaaaaacgcacgagaaaataattgttagaaaaaacatgcaaaaaaacacacgagaaaagaaaagcaaaaaagggagaaaaatatggttttcgtcgtcagtaaaaaaacaaaaagaacatgctaggaaaaaactgttagaaagaaatgtgccatttttaaaaaatggtttgagaaaatcgcgcaagaaaaaaaatcgtttatagaaaaacaagtcgttcgttaaaatacaaacattgtcattgacatgattatgtatgaaaaaaatatattatcattagaatttttcacccgttgcaacgcacgggcatttttgctaatatatatatatatatatatatatatatatatatatatatatatatatacacacacacacacacacacacgtgtgttgttagatcagattagattagataggaaaagattgataaattcacattcacccagaggttaagtactccctccgtttcgttttatttgacaccgttgactttttagcacatgtttgaccgct

SEQ ID NO: 52603 - DNA, 1501 bp, Oryza sativa
ggtttttttaagtaggtctaaggactatattaataccacaactaatcttggggatttctttggcaatatgaaccttcaagaactaaatttatcatgaagcgaaagttcaacgatcttattggttattcacccaaaaaaacattcttacgatcagaatagtgaatcaaaaagaaaatccaaatggtgtagcacgggccaatttgaattagtgcacaacaaaaattttggtagtatcaaagcttgagtaagttttgactctatacatatgtttaaggaaaaagtccaaaataacacccctccccgtgatcttttgaggtagttcgatttacatccctcaattttagtatagatattttctactaccaaactcttcaaactagacaaattaccctctctaacctacactaaggtggtattagtcctacatggcgtacatgtggcggtagtttggccacatattaatctagctagcatttgagaaaataaattttaaaaataatttcagccccacttatcatcctctatacatcttatctcttaccctctcatctttctctctcccatgccattgccacatgtcgttgccttacatgtcacatgttcgccttgtgttacttgtggaagagaatggaggggcctacattagctctcccctccaccaccatcaacgagcttactggcagccattctctgtgaatgatgagggaggctgtcacgccccgaactagtaccgaccggaactagcccgtgacgctctaaattaacctgtaaatcgataccagtcccaggaaacagtgctggtatcacaggaagacagattattacagcaacagaggtctctttattatagagtagaggtacagtcatgttgggctgcggacagatcccgagctcacaactgcattacaaaagggaagcggaagccaggacttggaccaaacaacacaggcgcgacttgggaactaggccgaaaccctaaaactcatcgtagccagcttgctcctggaagaactcctcatcagcaggatccgcttcatcttcttcagcaactggggggggaattatttatatagagcaagggtgagtacgggagtactcagcaagccaggggaaataagtgtttaatgcatgcttcaaggaaaggctgttgtttttgcaattgattttatttaaactctttttgaaaacaactaagtgagtgcttctcaaacgacacggataagacagtgcgtcttgtccggtcggagtatgtgcaatgtatcagtctttagaattgttcaagattggcacccggccaacaactttcaaacggccacccgggcctagctgatcccatcagccgcagattttccaaacatcgaacccctttccacaacagcaatttcacaagcagtagtcaaacaaaactacgctaggaatcacctcacatccgcccatgaccgtgggcacgactgttcgaacagtttgttaacctctgcagagggggtacactttacccaca

SEQ ID NO: 52604 - DNA, 1501 bp, Oryza sativa
ggacacttaaaaaacatggtaatttgttgatagatacttatacgtattattttataatttttcgctattacagagagagaattttcacaaaatgacacttttgcccctgagaccaatcttcgtcgacggggatcaaatccggtcgactcagcaccaaaaccggcctcgctgcccgtcgctttgtccacccccgccatcttccacagcagttcgtcacggtgtgttctccccgcgggcgacaactccatccattcattcacaacaaagagcagcagcaagtggaaagtcgtccgtctgcccatcgcgacggcgtccttgccaccgccgctcggcgcctcgtccttcaatcattcgtccgcgacccatcctcgatgtccaatgccacgagccgtcgccagcctgtgaagtaacagcaacaggagtagcatttttgtctctgtttatgaagcaacagcagctgcgaagccaacatcctcgccggcggcaaccccatccgtttgttcaaaggctcgcaacagcagcagcagcaagctaacttcaagctcgcagcaaacaaagagcagcggtaagccatcaaacctcgtcggttctcagccgttgtcctctgccgcgagatccaaccatccgtctcggtcgcggctcgtcgtggatctgcagtcctcgtcgacggtcgtgacgctgcccctcgtcaccgcccgtcgcggttgcccctcatcgttgctcacggctgcttcgcacaacctgtgtaggaggaagaaacggaaaaggaagaagaagacgagggtagaatagacattttatgtgatttctctctcctcaactaattgaatattgtattttaatgctcgtggtgtcccgtggtaaattactatgttttttcagtgtcataggacaaattcacgttttcgagatgacccctaaccaagaccgctttctttgagtgtcatgtagcaaattttgccaaaattaaaagattagcgatcaattaatgatgattagcgattaattatcttattatttaatcactaattaattgttgattagcggcaagtgtgacggtctcgctcattgagcgtgcgagaccaatgctaattttatgcaaataaaattacatcaagtatatttctgagaaataaaaaaaaagtgaatggtatattttaaatttaattcctcgcgaggtgctcccacactgtggaactagcagtaaaacggtaaaagaaaaagaaagaaaaaaaagagttgcgtccgcgccgactggtattcgcagccatccgtccatccgtgtcagcgtcactcatcacgcacgcacccatcaaaaagcttcggaggacgacgcaaggaatcatcaaagcgagacaccttttcttttggcctccttcctcgcgaaaaccaccaaaccaaaacccacacacccacagcttttctccccctcactgctttgctctccagtctccacctcctcctcctcgctgccgcgccgcccatccgccagccatggcga

SEQ ID NO: 52605 - DNA, 211 bp, Oryza sativa
cgcgcgtggtttcgatcgatcgatcgggccgggcgctaggcgctagcacggcttggaccacgcacggcacgggccggcctccatcctccacacctcacacttgccgggatatgatattgcctgcttccttgccgttttctcctgtacgtactctctgtcgtatccgccaccatcggtgcttgctatatctggccctcctttctgtcgcagg

SEQ ID NO: 52606 - DNA, 1501 bp, Oryza sativa
gtcacacttgccgctaatcaacaattaattagtgattaaataataagataattaatcgctaatcatcattaattgatcgctaatcttttaattttggcaaaatttgctacatgacactcaaagaaagcggtcttggttaggggtcatctcgaaaacgtgaatttgtcctatgacactgaaaaaacatagtaatttaccacgggacaccacgagcattaaaatacaatattcaattagttgaggagagagaaatcacataaaatgtctattctaccctcgtcttcttcttccttttccgtttcttcctcctacacaggttgtgcgaagcagccgtgagcaacgatgaggggcaaccgcgacgggcggtgacgaggggcagcgtcacgaccgtcgacgaggactgcagatccacgacgagccgcgaccgagacggatggttggatctcgcggcagaggacaacggctgagaaccgacgaggtttgatggcttaccgctgctctttgtttgctgcgagcttgaagttagcttgctgctgctgctgttgcgagcctttgaacaaacggatggggttgccgccggcgaggatgttggcttcgcagctgctgttgcttcataaacagagacaaaaatgctactcctgttgctgttacttcacaggctggcgacggctcgtggcattggacatcgaggatgggtcgcggacgaatgattgaaggacgaggcgccgagcggcggtggcaaggacgccgtcgcgatgggcagacggacgactttccacttgctgctgctctttgttgtgaatgaatggatggagttgtcgcccgcggggagaacacaccgtgacgaactgctgtggaagatggcgggggtggacaaagcgacgggcagcgaggccggttttggtgctgagtcgaccggatttgatccccgtcgacgaagattggtctcaggggcaaaagtgtcattttgtgaaaattctctctctgtaatagcgaaaaattataaaataatacgtataagtatctatcaacaaattaccatgttttttaagtgtcctcaagcaaatacacgttcttatggtgttcctcagcaaagaccatatttttcgagtgtccaagagcaaattttgcctttaattttcgaaacactttcgtagacttgttgcacgagaatgctcgcggtttgacacgctcgtcgctcgacaccgcgcggtctcacgctgcccctctacaagactgtctgcatcttcatcccacgtcaattttgcacaacggttcagcaagaccaacggtatatttgtgtccaaagatttgcatctaggatatttttaagaaaaaaaagatatgaacggtatattttcaaatttaatttcctcatgagtaccatcacggtgtaaaattttaaacgggaaggctaaaggacagaccctaactcctcgcttgtgtgtaggcacccacattgacgttgcctcactcttgatgcggcagactagcacgtcat

SEQ ID NO: 52607 - DNA, 484 bp, Oryza sativa
tcattagtaaatgtttactgtagcaccacattgtcagatcatggcacaattaggcttaaaaagattggtctggcaaattagcgcaatctgtacaattagttattttttaccctatatttaatacttcatgtaggtgtttaaacattcaatatggcatggtgaaaaattttagggtgggatctaaacagggcctatctctgtctcaaaagacaacgctcccttcgtcttattactccctccgtccaaaaaaaactgatacttacatcatagttatactaatactaatttcatctatcacccacctccatctcaaaatataagaacttatgatcggatgtgatcttacctactccctatctagatatattgtactaagaatattccatttgattcttatatttttgatacaaatgtagtactagattgctatattaacgaggacatagaaatcttttaacattttcttaacgtgtcttccactagc

SEQ ID NO: 52608 - DNA, 1501 bp, Oryza sativa
ttccgccggttcagagttcgccctctccccttcgcgctcccgcggaagaaaacggcggtatcatcttttcgaaaatggatcggtcataaacagatcatagttacttcctccgtttcatattataagactttttagtattgtacatattcatatatatattaatgaatctagatatatatgtgtgcctaggttcgttaacattcatatgaatgtggacaatgatagaaagtcttataagctgaaacggagatagtacatattataagtcattttaattttttagagcaattctacggttgaggagataccataagatataaatatttagtataaaatttggtacctcatagtataaaagaaaaagtggtacctcgtgtagctccttaaggatcgtaaaattatttttaaggttgtaataagtttacagaaatatatagcaatatttttaatacaaaacaaagaaactatcaacatatattcaatatgttagatttaatggaatcaatttagtgttataaatattactatatttttctataaatttggttaaactttttgaagtttaactctaaaaaattcaaaacgatttataatgtaaacaaatgaaataatgtatttttttcaatatcaatagcaatatagttgcgaagtgaacgtaactcaactggttagtttcctcgtggtggaaccaagatatactggcggctcagtttttcgaaggtgcttataggggtcccaggtaggatatgtgtatgtgtttatatgggtgagtctgtgtttgtattgtatttctcaataaaaaattagcaatatactccctctgtttcaaaatatttgacactgttgactttttaatatatgtttgactgttcgtcttatattaaaaaaaattatgaaatatgtaaaactatatgtgtacatgaaagtatatttaacaatgaattaaatgatatgaaaagaataaataattgcttaaattttttaaataagatgaatggtcaaacacgtattaaaaaattaacggtgtgcaatattttaaaacggagggagtagtaatgttgaaaggacttcaatttatgcaggtccagaattatataaacggcagaaaaatgatttcaacctatattccatttccacctatacggcgctcctagctttgggtagctaacaaacgcgtctcccctaccgttagtcccgcgtctcctcccccgcgcccccgcgtcgtgccgtgctcccgcggctaacctttaggctttagcctagcccgaccgaccggtaaacacgcgccccaccacatcgcccctctccccgcctatacacacgccaccaccaccacgcgcgacggacacgctccccctcactttcactccacacacacacttcacggttcgcgcgacgaacaaacgggcagaaaaaccctgccacgacgacccacgactgagccgagcgtacgcacgcacccacgcacgccatgggggcgctgcggcggtggctgccgtgc

SEQ ID NO: 52609 - DNA, 1501 bp, Oryza sativa
attcctgaaaggcaagattctgcgaccaaagtgtacattctgaattttgtttaggtggatgaaacacatagtatatttcatgggaaggagggaaactggaaaacggtgtgctgctgctaggcctgactctttgggcttggacgcttcttctctctcgcttctgcaaccagagcatataccccaatctgccacgcgtgccggccgttactaatccctcatcactaattgtatgcatgatctactgatgcattgcatctctgttctgttcttgaccagaccgtactctcgttttggagaatgagaggtcaggaattgaagcagctagctagagaaagaggctgcaggggagagtccaaattaaaccaaccaccacgttgttatgtgttgcttgcttggtgctagagtgctagtaatgcactagtccaaattaaattcttcatgtattttaggatgtagtatatgatattattaagtttattgatggtgattttctggatggttgaatgcatctgcaaactgaaagagtggccggtgtgaatgcagtgcttaattggaatccgacagtgggtaatggaggagatgggccagtagggttggtgactgttagacgctagcacatccaggcgattaatacgactactgtcatacgtactgtacatgtcatgctacattatatcgatctgtacattctcttggtcatgcatattacagcgccatatcccatatatcgtacctacgaccaaaattaaactaaacgctctctgaaaaaccaatcaacaaaatacatacaacctcatgttcatgtaggggtataaactataattaatgttcatacaaggagtatcactatcgatcaagctgctgctatgctaggtggaggatggcaatattgcattgatgtcgcccgggttcgttgggccagtggctgctaaccgaatttaattccatcctccgctgctgctgcgccagcccggccagcctcccaagaccaaagtgaacatatggccctgtctagttccttaaaaaacttttcgcaaaaacattatatcaaatctctgtacataggtatagaatattaaatatagataaaaagaaaaactaattgcacagtttatatgtaaatcacgaaatgaatcttttaaacctaattaatccatgattagtcataagtgctacaacaacccacatgtgctaataacggcttaattaggctcaaaagattcttctcgcggtttccatacgagttatgaaattagtttttttcattcgtgtccgaaaaccctttccgacatatgatcaaacatccgatgtgacatctaaaattttcatttcatcaactaaacaggcccatatatgtactggagtacgtgccttttatacagacagactactactagtcactcattttacaacctgcacaatggaaatttaccactcaaaatttttcataggcagactgtacatcattttcgtttctaaccaaaatatatataggtgatca

SEQ ID NO: 52610 - DNA, 317 bp, Oryza sativa
atgccattgttatcgttattgatgcaatggtttctcaaggcacgccactctagctagcttgaattttagcgttgtttaatagataatctttgcttctggctacacaacatattcttcaaacaattgaaggacgatgtgacccttacatctagaacattggtcagtgctagtgattgggaatggttctgggattatcttggctcacatgtgttctatatgcctccagtcgctcgactgcatcttatcaaagacctctttgtggctatcaaaacattcaaattgacttgggtgaaacctttctccactgtacttctaga

SEQ ID NO: 52611 - DNA, 1501 bp, Oryza sativa
tcttaagagaactattttcaaaataagaattagagtacatgatcaaaatatatgttttatttattacttttttttgtgtgtgtttccttggctccttgctccttgtaaaaagatgactctttagttatcaggaaaatattacgattcaacaatcttaattcaattattacaaaccacgacaatcagccagcttctccacggaacaaatcaaacaaaccgggaaggtttacttcaacccaacggcgccgtaaccggcaactcagcaaccgtgaccggaccggaccggaggtcagtaggtcaccggaaatttcacccggtaggaaaggaataaattcattttgactctcttaggaccgaatctgatttgtttcctcgaaccgtaatactggatatctccgcttccacctcagttgatgcggcgagatacgaatcagattgcatcgaggggatcgagatatccggtattgcggttcgaggataagaatcagattcggtcactagttaaggggctaaaagtgaacttattccatcaggaaaccgatctcccagtgggccgcgccccttatctcctaagacgcggcccacctcgtccaggcccatggctccaaggcgcagcgcgcgcccgcccgcccgtctccctctccccgaagacaattttgagtctgacagagaaaagaacagcggaaaaagggcaagtggggcagcagcaagcacaagccattcgggaccgattccatccacaagccgccgtacgaattgccattgtgtggcgtccagccaccacgcgggtccaatggcaaccgcggctcaatccggagggtgccgcacctgcgtcactcactgcacccgtgatttcctccgacggcgacgcgcgtttgggccaagataaagagaatattttgtgtgaaaattgtgacttctgcgtgcgagaggaggagagagagagagagagagagagagagagagagaaggtcagggatgcaggctgaggctcggttcgtctcgcctgcgatgaagcgaaccagcgactggtacgtttgccgcccttcgtcctcctcctcaccttcctgctacgagttcatctgttcctcttgtggttgttgcatgtttaatttgcatggtgtttctatctgatatgaactgtaattttgtcaaaaaaaagtttcaattgctcttcatttagttggagactgttttgtttttcaattagaagtgatagtgctgcttcaaagtgagcagcacaaaaacttccctaaatcaacacacagtacagcttggtagcatcctgcttttagttcggagtcacaaatcacaacactgtaaccgaactatgcaagaacacaagtctgaacaaaaatttcacttcattgctacaggatactttcgcaagaactcccaagcgatattaccatcaaagtcgacgatgccgccttcaacctgcacaaggtgattttcatcaacccaaatttgttttttttttcagttttcactgcgtgttcta

SEQ ID NO: 52612 - DNA, 1501 bp, Oryza sativa
acaaaatttttatatgtttattcgctaaaaagaaattacattgaatatcttaaaattaaattcgaaaatttaaattttggcttttgctttagcttattaggctaatcgatggggctcactccaatcagccaaatttccatatgcttatcttttcatttatacttatacttattagccaaaatttattttttttttaaaagaaatatatatttagagttgattttagttcatcgtagcttattttttagtttttttcttttagatcattacgaacagtatataatagttcattcatggattattttttatttgtaaatatctcatttcgcaattttccgttatcagccaagcgatggggctgctagaggccagctgagctgctactggcttgttgccgtgcggaggagctagaacaaactcatggactagttagacgaaggagatagacacctaattaatggtattgcagtccagtagtactagtagattttttttcctaatttttatttttggaagaatcactgtagttttgtaattcctctccctaatctgttcaccgattcacatctggcaccacacggacaccgacatcacataactaaacgttcttgtatgctgtcaaagatcgatcaggttactcgatcttatcatacgagcgtgcagatgcaagccagccagtaattaacacaagaaccttcatgaatgtacagtactccctccgtttaaaattataagactttatagatgtctaaattcattaacatatatatgaatataaacaatattaaaaagtcttataatataaaacggagtaagtagtattggagtactagtacaagtgaaaagcatggacaatcaactagaaaaaaataagaacgtaactatgcttaaaagaagctagttcctttggtccatagaaaaaaaaactaattcctttcattttctgactgaggcacttcggaactgtgtagggtaaaaaagggttttggtggagagatgaagaagaggtatgaagaattgtagcaggtgttttggaagccggcatgcagcggcagctgctgattctgatatatctgatgtttttgggagagatatatgcaagctgtttcgcgggcactgctctttgtttgcatcttgataagatcagatgcgcgctaccgccaccgccgccatggctgctttgctaccatctctttccactattccacgtttccggccgtcgcaacttgagtattacgaatcgagccaaccgttgccatcaagttaattatgttgcccaaatgatcaagctactactcctaattaacttccattccattctaactgtagtgtatactcctcttcccctagctaattaactgtcaggtaattaagctagtactcgatccataataattgttcaataatggtcatcagtgtcaaagatagagattgtttagcattacagcgtaacagtgtcatagtccatcccgtgtctctacgtctatgactctatgtaaac

SEQ ID NO: 52613 - DNA, 1501 bp, Oryza sativa
tagtactccaatactacttactccgttttatattataagactttttaatattgtttatattcatatatatgttaatgaatttagacatctataaagtcttataattttaaacggagggagtactgtacattcatgaaggttcttgtgttaattactggctggcttgcatctgcacgctcgtatgataagatcgagtaacctgatcgatctttgacagcatacaagaacgtttagttatgtgatgtcggtgtccgtgtggtgccagatgtgaatcggtgaacagattagggagaggaattacaaaactacagtgattcttccaaaaataaaaattaggaaaaaaaatctactagtactactggactgcaataccattaattaggtgtctatctccttcgtctaactagtccatgagtttgttctagctcctccgcacggcaacaagccagtagcagctcagctggcctctagcagccccatcgcttggctgataacggaaaattgcgaaatgagatatttacaaataaaaaataatccatgaatgaactattatatactgttcgtaatgatctaaaagaaaaaaactaaaaaataagctacgatgaactaaaatcaactctaaatatatatttcttttaaaaaaaaaataaattttggctaataagtataagtataaatgaaaagataagcatatggaaatttggctgattggagtgagccccatcgattagcctaataagctaaagcaaaagccaaaatttaaattttcgaatttaattttaagatattcaatgtaatttctttttagcgaataaacatataaaaattttgtctataaattaatttttatttcctaataaaccgtgttgacttattgtgaatacgtataaccgatgagtgtcagtactactatctttgagcggctgtatatgtgatcgattgttcattcgattgactctaaagcagggagagtggtaagtggtaacacgagtatgtgtatgcatgcgtccagattgttctagaacacttttataaaaatccatatttcagaggacaggactgcactggttagtacctgctcttccgattccaaaaccaaaagctggaactgaaacctctggatccatccatccatcggacgacgtcgcctcctcatccatcacaagtccggacggccagcagcgcgccacgtgtaaggccacgccagagaccagccaataggcaggctccaccgagtcagccgtcgttcccttaaatgtgcagtcaccgacgggtgggacccgctcgctcgtgctggcccacatatcagtgtatgcacatagagtgggtgggaatctccatccgtttgggaacacacaacacaacaactaccacccccactccgctccttccttccttcccgcatttggatttacccccaaatcttctccaagtccaatcgacctcatttcattcgattcatcgatcgctcggcgcggcttagggtttttggcggcagcga

SEQ ID NO: 52614 - DNA, 1501 bp, Oryza sativa
gcagcatgacgtacttggacctggacaaaactctgaatattctgaaaaaaccacacacatgcatattgacatgcacaccaagaagcactgttcacttggagaaaacctctgaccagtcattactcagatggagctggcatctctcccaaccacaacctagctatataatagactggaaatggctctcttccaatcagtggctgtccaagaaaaatgacaagaaacgaacaaaaggatggaaccaaaaaaaaaaaaaggtatagtacaaccaaatatttggacgatagatgcatggcgatatttttggggtgcattacatggattgagccatatatcttgttgctttcttaatttcacaccatccaaaaaatacaacagacaactctctagctagcttaattgcttttgcgtgtccgtgagagagatgtactgaagtgtgtgtccctctctcaaataataatcaatatatatatatatatatatatatatatatatatatatatatatatatatataggattaattaatcaattaagcacacaattaaacctatacccatctatccctaaaatatcaacttccggaggtacggccaaattcatccttaaaaattaattatttttaggacggaaagtgtgtagctagctacggcagcgtacttgcaatctcattttttcgcttatacttataagccaatatttaaatttttaattttaaatttagagttgattctagggtttttttaattgtagttttatttttcaacctttacttttatatcaccaagaacgcgtatataaaagttttattcataaattatttttcgtttacaaatataccattttacttattccttgaataagccaaaagatggcccgttggactagttgctgaccaaataattactaaagcagtgaaagaaagttacattttgatcaaattaagttaagttcaattttcaccacacgcacaaaaatggctgcctcagtactactagtcagtagtgcttcggctactttttccttacactttataattaggatgagtgatcaaagaacactagctagttaattacccaattgatagcaatggtactaaattaaagccgtcatttgaagttgttgcttaatcaattgccccctgcactgaatatatatgcatgcaggaacctagctgctagctaggagttgtacatatactccctatgtttcacgccgttgactttttatcatatgtttgaccgttcgtcttattaaaaaattaagtaattattaattcttttcctatcatttgattcattattaaatatatttttatgtagacatataattttacgtatctcataaaagtttttaaataagacgaacggtaaaacatgtgctaaaaagtcaacggtgtcaaacatttcgaaacggatggagtatataatgataatatagtaatggttgaggaggaggaggattcaattatggaccattgatggccaaattaacaatgtagt

SEQ ID NO: 52615 - DNA, 1501 bp, Oryza sativa
ggccacggaggccgacctcgtcctcatccgcgtcaccattggccctcgcggcaactgctttaataccaaatgcagcgacttgttcatgtactaggccaccacccacacctcgtcgttgcgcttgatcccgcaccctgctgctgtctgcagcttcttcgaccgcgaggttggcctcctccgctgtggctcggtcaggcgtcgccatgatcccacaagattgggcctgcacgcccataccggccctgacgacggtacctacatcgtcgccgtgctctgtaacacctttcaatcagggaacctggagtatgccctctacctttaccgcgccggcgcagatgcttggacctgccatccactctcccttcatggtttggtcgatccaacatcatttatccatgtcaataccaacaccatcacggttggaggggaagctggcaccatggcctgggtcgacctcaaccgtggtattctcttctgcgaccttcttccctgcccatacacccctctgctcctccgctacttcccgctaccgccaccactcagactcagtgcacacaccaagctgacaggatgtccaaggtttagccacgacattgctcttgtccaaggtcgattcaacttcacccagatgcgaattcatgtcaagccaggctccatcaccaacggcacatacatctctcagggttggactcttgccacttggagtgcaccagccaccaatccttggaagcaagggtggcgccaggattgcaacctctctgcttccgatctctctgttgatgccaacaccatgaattttcagttactgcctaagctctcggatcaccaacagggcacacctcagcaaaccttggagagacttcacgtgggccatccaacgctcagcttgcaatccaatgacattgtttgcctcatggccaaggtcgaccaatgggacgaccatgcttgggtgcttgctgtcgacatgaagaacaggaggctaaaagatgtggctcagtttggcgctgaaagaactcttggcattagcttggtctacatcagcagtatgatatcagaatatcttcgtacggctccaggtaattgtttttcgtttttgttctacttgttccttcctatttccgtggtccgtccactgctaaccatcataatcttgcctgttttcacaaatagcaaacctgcaataagttataattgacaataataccaaacctattaaattgatgcacatgcatatatatatgtgggttaatcaattggaaacatctgtttttgtctttgctcacaagaacaagggacattgctgtagggcatgatgcccctgtttctatggcattgggtgtacatgatactccagttcaggatgctaatatttctctggtgttaacaatttacttgacacacctgacttgggaacaccttttctcagctgataaaacatattacatacatacaacctgagatacatgcaaataaatcattgaagggaatgggatttatgagc

SEQ ID NO: 52616 - DNA, 1501 bp, Oryza sativa
ggtacaggcacctgaaatttctctccttggttttgtgcatagtgctgaaaactacttttattcttgactggagagagtactttactgtgactattcattcttctgcaactatagggtgcattgtcattgactttggtttttttgcagatcacagcagcactgaccttcagtgccgcatgtgcgtcatctggcatcaccgtgttgattgataatgatctagacctatgctcggaaaatcactgcgcaagttttgaaagtgcgacagcaatggcgtttcttagctggtttgctctttcgccatcctttctattgaatttctggtcaatggcttctggatgaatgaaaaccaaagaggaggttagagcttgatttttgaatgtatcatgtgcccaattcaccaattgtggttagtgagaattggatagcgtgacgcagctaattgtattagagttgaaagctgatgtgcggtcttgggatcatatgtttctagtataactctgtaaaaaaagaataggggatggcctgttttgcaagtgttcaatgtggaactcagtaaaagtctcttaagcaaggtgctttccgtataagacttccagctggttgagtttttgtgtgccatcatttatgcatacaacgtgttgattgtgctgatgaatcatacagccacagcaccactacataacaagggttgtgcctaatttccatggtacatttcagttgaaagtcgttctgaaagaaccactgaaattggtggagaaccttctatcgtcggctgacattcttgtgtgcaatacccatccatggctactggccaagagttctgcactcaccagggccaactgtggtgccgtaatctaccacactgacccatccgtagatggcactcttcttttttcccattgaatgttctttcgtagtagtacctttcaattgttccctcggtttcttagttgtttttttccttaatatgtttgtactatatgcaatggacaaaagccatgtcagataatgttctagatgtcagttatcacttgttaggagctggagatgagatgcactcctagccatgaaaacatcatcgttatcgtccggggagagacaggataataccgagatttcattcgcgtcgttacttggacttggctggcacatctcatcttcttagaatgtaaaaataaaacttttttttttggaatttgtaatactgtttgagattcactttggtccatcaaaagtacctcgagataccggtacctcacagtatcaaattgtttttatcattggatctagctgggcaggaaagacattattagatctaatgatcgaaaacgatttgatatctcgaggtaccggtacatcgagatagattggagcaaatctcactgtttatacttcagtgacatatactttacactgagaacgacttcgatcaaatcaattactcatctgtagactacaccagctttgtactaggactataccaaaaccttacattgaaatg

SEQ ID NO: 52617 - DNA, 1501 bp, Oryza sativa
acccacatattttagaaaccctctattaagggaattcgtttcattttttgttccaccaaaaatatttcacctagtgtactcacaatgtttcactatgtatagatctaatgttgcagtgaattgaaatattcttttgcaataaatcacctacatattttggaaaccctctattaagggaattcgttccattttttgtttcaccaaaaatgtttcaatgtttcagtatatatgtatcaaatgttacagtgaactgaatttgctgaaacattgattttatataatgtgaaacaacgcccgaattaaacgattgaaacatttttgatctacttagtgaaacaattccgatatacctagtagaacatcgtgcaatatttaaaaataggcaaaattggttatatagaattgaaagttcacgtttttggttttatagcatcgaaagataccggttcactttaatagcacccaaagttcaccccgttcccatttttaacacatccgtcaatattttcatccgtcttgatcgctattgacccagccacgcacacaatatgatgtttctacccctcattgacatgcattctacttgtacttgtgaggggtagaaacgtcatatcgtgtgtgtggctagatcaagacagacagaaaacgatcgaaaattgacataagcgttaaaaataggaacatggtgaacatggtgaactttgggtgctataaaacaaaaaacgtgaactatcaatgctatataaccaattttgccttaaaaataattcaataataagctaaaagaatttttcgttggaatatatccatgtgtggttttgttttgaagatttaattgcaacgaatttaatagtggaatcggatcatgatttggataaataagttaagagaaaaaaatagtttaaagtgttttttcacgcatacgtcatgctgacatcaacgcccaattttttccccaaaccatcgggcacccgattctaagttttctcttgaaaataattccgagcagttctagctagcagcctcatctgttactgttgcctgtttggggtaggagtatcagtagtgacgtgtccatgacatcagcagatgcaattgcaataacatctactccctccgtccaaaaaaagaaacaattcttctaggttggtttttttagacggaggaagtaggcacgtatctagtctcttgatgatatgtatgcttacatttatgaggtgggaagaaaatagaggagataaacgaatgagatatctacagaaaatttaaaagagatgaaagaaatagatgaatagattataatcaaacaaataaattaaaactattacggggtgttgggacaagtgcactgatcatattttagaaagagtacttataaatcatacgatcattagcgaacaaaggagtagatgatatgaataaaattataaacgactatcatctctaatactgtaaaacttgctatatgttgctattatcttcgtatcataatagagatttt

SEQ ID NO: 52618 - DNA, 1501 bp, Oryza sativa
ggtgagtgcaagctgtctgttatcctctttctactgcttgtgaaatccattcagtcagtataccttcatttattttctgtaagtaatggatatgtgttgttgataaattcattacaagtccttctagcagtcaacttgttcatgataacactagcatactatactccctttggtcactagaaaagagtgccctttgcggctgattccaaaagttcaagaatacaagtcgttttggttaaacgagtctcctacctgctataccttcaattaaagtcctacatgcatgcacatgcacttttactacaaaccaagagaagttgagaggcaacaacggaaaaaaacatggagagagaatgatgcataaacgggttgatggaccttaataggggtacaggcacctgaaatttctctccttggttttgtgcatagtgctgaaaactacttttattcttgactggagagagtactttactgtgactattcattcttctgcaactatagggtgcattgtcattgactttggtttttttgcagatcacagcagcactgaccttcagtgccgcatgtgcgtcatctggcatcaccgtgttgattgataatgatctagacctatgctcggaaaatcactgcgcaagttttgaaagtgcgacagcaatggcgtttcttagctggtttgctctttcgccatcctttctattgaatttctggtcaatggcttctggatgaatgaaaaccaaagaggaggttagagcttgatttttgaatgtatcatgtgcccaattcaccaattgtggttagtgagaattggatagcgtgacgcagctaattgtattagagttgaaagctgatgtgcggtcttgggatcatatgtttctagtataactctgtaaaaaaagaataggggatggcctgttttgcaagtgttcaatgtggaactcagtaaaagtctcttaagcaaggtgctttccgtataagacttccagctggttgagtttttgtgtgccatcatttatgcatacaacgtgttgattgtgctgatgaatcatacagccacagcaccactacataacaagggttgtgcctaatttccatggtacatttcagttgaaagtcgttctgaaagaaccactgaaattggtggagaaccttctatcgtcggctgacattcttgtgtgcaatacccatccatggctactggccaagagttctgcactcaccagggccaactgtggtgccgtaatctaccacactgacccatccgtagatggcactcttcttttttcccattgaatgttctttcgtagtagtacctttcaattgttccctcggtttcttagttgtttttttccttaatatgtttgtactatatgcaatggacaaaagccatgtcagataatgttctagatgtcagttatcacttgttaggagctggagatgagatgcactcctagccatgaaaacatcatcgttatcgtccggggagagacaggataataccgag

SEQ ID NO: 52619 - DNA, 1501 bp, Oryza sativa
ttgcataattatgtatctacaaaatatgcatattgtttattaaatgcccaatccaccttaagatcaatcccatataaaaattctgcagatattttgcatgtacaatgaaattttgcattaatttatttgattccaaaactcacttagcaagtatatacgtaccaattaatttattatatatagtacttgaagtacgtacgtagctttcgcgatactggagtatatggaactaattaaccctaactactccatgcaaatggcggcgccctcttgccctaaacaaagaaagcaatgtatgcaagagtcttgtctctgtgcagccgttgcagagctgtggttggacgacgtcttgaattcttgtctgcttttagtattggtaggtacgacggctaaatataagatcatggcttctctaatagtataatcgagtaaattaattaaccggttaatatcagatatatatttaattgctttgcccaaaagtagggcacaagaaacagcatccgattcgatcggcgcattgacattattcttaatcgcagattcgatatcgagtcattgattaattttcgattaaacaagaggggcgttgtcacgatgactcatcatcattagaacgaagaaaagtcagatatatagcagctcagcgctagcactgtttatttttctgttctatcatcatcatatcatcatctctttttttaattcagaggagatcaggagggagcagtgtactagtcattgcgtggacatatcacaagacagttatacgttgcaatgcgataatgacggcgcaactagtagctaggattatcgattttgttctccacaaatttcaccaaatcttgcatgaattttaattacaggactgggattaattgcatagtttgatctagagctacaccgcacgaggaagaagacaaagaagctaagaacgacgacatgcctgcagagacctagatcttttgctcctctttatggctgcacgaattatatatagccatcatgcagcaaagttactttccttttggttgatatgttcctcttttcttttttttctttttttttgtcaaaaggagtaattagtgccgattaatatttgctgaccatacttttagcttgatgatttatttcacaaatatcgtatttttaagttgtagctaggtttgacggctagccctcttaattagaatgctcgacgttttctgatcatttcatcatctcttctgtcagatctgaaaacgagccactccgtagtccccactcgagtcttgtttactgagcatgcattgcatgggtttaattaccagatatagcttaattaatggcatatgagttctttctttgcaatactaatatatgtcttcgacttccgataaaaatatgacctctataaagaagcatgtgtatatacgtcacactattgatatccatattttagatttgatgatataaattttagacaattaatttatgattcataaaaaatgtacagttgtat

SEQ ID NO: 52620 - DNA, 1501 bp, Oryza sativa
caaatacataatggagaaaacaaatcagtgccagcagtacgtttgtgaggatcactagaataacatcaggccagctactgcagtgcttcaaaagagtataattgagcaaccggcatagaagatcacagatatagataattaaaacaagaacagcttgactattgtacaaaatgttgaatgagtaatatttgaacgatcttttttataaaaccaggagaacaaccctgctctgcttctcatgaagaaaaaaaaaacccacataaaactgaccttaaaccaattgttttaagctatttgttaagttcatttctcaaaatatttaatttgtccctataatcaagtagataatcggtggcaacaatctactcaataatgtaaatcaaacagggtatgttcaagtagcaagcaagaatctgtctcaattaggccaaaaaaaatgcaagaataatctaacaggaaagaattttgatgcaacattgcaaccgcaatagcatatgtgaagcaaggcacagggtgaacatatatcagtcataaattgctgtgctaatggatgagggacgcaggcaggacgacagccaactcaactgtattccagatcagtaaacaggcagacgtataatatattcctaggcgtgcactgcaacaatgcaggccgaaaatatttggggatcccagagctgagtgcggtgcgggcagggggactcgtacaggaaagaaagagagaccgcgtcgcgactctctctctctcaagtcccagatttgcggaactaggtgaaatccacacaccgctcaacccgagcccacagatcacagcgcatacgcatctcagacaggaatcgcgcgcccgcacccgagagggagagagatggaaggaagataccttgatgtagacgttctcggcggccttctcctcctcgccgagcaccttgccgccggaggaaaagagcctgcgctgcacgaacctcgccgccgccctggatggagccctagccgccgcctccatcgccgcgagaaaccctagaacacgagacgagaggatcttcgcttcgttggctccgtgaaactgtctctctctcccaactcccccactgatgatgatgatgactcgattctattccaccgctgctatgactccctgtgctactttgtaatttggccctttcaaatatgcttatttgaaaacattctacgtagtcctcccctcagggatggttaacgagtattagaggtttgtgtgggacttggatgaataatactccggatcagatcaaatccgacggccagaaacgcatcggagcgctgaaaccctagcctccccacctcccaagtcatatacctgcagcctcagcctgctcctcctcgtcgccgccatccttgccttcgcctgcgccttcttccgccgccgcatcgcgtcgtcgaaatggtacgcctcgtttgtctctcccaccatttttgctcgatcgccggctgcgtgctgaccctctcgcttgcttgctgtctc

SEQ ID NO: 52621 - DNA, 1501 bp, Oryza sativa
gtgcccaattcaccaattgtggttagtgagaattggatagcgtgacgcagctaattgtattagagttgaaagctgatgtgcggtcttgggatcatatgtttctagtataactctgtaaaaaaagaataggggatggcctgttttgcaagtgttcaatgtggaactcagtaaaagtctcttaagcaaggtgctttccgtataagacttccagctggttgagtttttgtgtgccatcatttatgcatacaacgtgttgattgtgctgatgaatcatacagccacagcaccactacataacaagggttgtgcctaatttccatggtacatttcagttgaaagtcgttctgaaagaaccactgaaattggtggagaaccttctatcgtcggctgacattcttgtgtgcaatacccatccatggctactggccaagagttctgcactcaccagggccaactgtggtgccgtaatctaccacactgacccatccgtagatggcactcttcttttttcccattgaatgttctttcgtagtagtacctttcaattgttccctcggtttcttagttgtttttttccttaatatgtttgtactatatgcaatggacaaaagccatgtcagataatgttctagatgtcagttatcacttgttaggagctggagatgagatgcactcctagccatgaaaacatcatcgttatcgtccggggagagacaggataataccgagatttcattcgcgtcgttacttggacttggctggcacatctcatcttcttagaatgtaaaaataaaacttttttttttggaatttgtaatactgtttgagattcactttggtccatcaaaagtacctcgagataccggtacctcacagtatcaaattgtttttatcattggatctagctgggcaggaaagacattattagatctaatgatcgaaaacgatttgatatctcgaggtaccggtacatcgagatagattggagcaaatctcactgtttatacttcagtgacatatactttacactgagaacgacttcgatcaaatcaattactcatctgtagactacaccagctttgtactaggactataccaaaaccttacattgaaatgagttcaaaatttgtgttgtaagttgtaacacaaatgatacatttacaaggttacatactaaaatactacacacctgaaatagtactacctccatactatcatgcttatttatgttcattgctacatagcgatcatgaaaaatcaaaagcaccatgaagacaccagtcatgcatgatcactttgatcaaggtctggttggtcaagaaatggagtgcctccgatccttgggcggcttcgtccgcaccctgccgccgccgagcacgtccgatcgcaagaacgggttgagcctcccgagcttcttggacatgctgttcatgaatccgccgctgcttccgccgccgccgccgcccggcttcttcggcagcggcggcctaccggacggcgg

SEQ ID NO: 52622 - DNA, 1501 bp, Oryza sativa
agtcgtataagaaatctctttaaaaaaactcgcatgctaacttgagacgatcagactcctaattgccgctcatgattctgtaaaactaaacaaatccaagcgaattctcacggtgaattttaccttaactaaaccatataataataatcaaaagaaacctcacgcgttgcaatgcacgggcattttttctagtctgattaaatatttaaattgccacatgaatgcatcaagagcatgaacttggtataaacagaaactaaatccgaagttccgaaccaaaccaaatttggcctattatttttagaacctcacttatgaaatatttcccttgcaattatgtacgcgttcctaaaatccttgcgttccaaattaaggaaatcgctgtgtacacaaaaattaaatccaaaattagttgcttaattattacaggtgatcaaaagtactcccttcatctcaaattacttgttctagatttgtccttaattggtcaatgatattaatctttgaatatgaatttatataattaaacttatatagtttgacacatcacaagatttatatatttagatttatcatgagaaatcctatcataatgttgccaaaccatgcagattttcaaaaattaatagtcaaagttagctagctagacacatttgatttataataactaatccgaaacgactagtaattaagaccacgtttgattcagtttaggattatgataatctgaattattaggagtaagctgaaacaaacagatagcttattatgattgattattataatctataagccggattattataatatgataatccactctaaaggtgctttttctaaattattgggtgaataacagctaataatccagagaatcaaaaggctaacagcttattctatgtcagtttattataatccagcttatagtaatctgatttaataatctatattataataatcttaagctgaaataaacaggcctaagttgaaacggagagagtacgtagcaaaatcaatcagagctgggtgcatatgcaacgaattaaatcggagatcgaacggtcgatcgaaactaaagcagtgtactgcatgcaacggcttgcaatgtgtgtaccagtctaaccacttaggtacttaaaccaaccaaaaaagtgtaagcaacccaacgaatccttgcatggttcgtcaaccgtacgtacatcaactccaaatcgggtccccgtaactatacggcattatggcggcgctatatatttcttctatctatctactctctccttctccagatattttgacgccgttgattttttaaaacatatttaaccgtttatcttatttaaaaattttaattaattaataattcttttcatatcatttgattcattgttaaatatgctactaccacttaagtttttaaataagacgaacggtcaaacatgtttaaaaaagtcaacggcgttaaatatttagggataaagggactaattaactatagattata

SEQ ID NO: 52623 - DNA, 1501 bp, Oryza sativa
tagattcattaacatcaatatgaatgtggaaaatgctagaatgacttacattgtgaaacggagggagtagccaataacaaatcacgacattatatgttgattatatatatggatgcatgtatcaatattcatttactctcatgcataaataacgaatagccttagaaaataaatacaaatatgattgtcatttgagaataacctcaagatatatgtatgataattaattggaaatggatgaagtagtgtataatataataattttacacctacagttatatagacaaaatctctattatgatacgaagataatagcaacatatagcaagttttacagtattagagatgatagtcgtttataattttattcatatcatctactcctttgttcgctaatgatcgtatgatttataagtactctttctaaaatatgatcagtgcacttgtcccaacaccccgtaatagttttaatttatttgtttgattataatctattcatctatttctttcatctcttttaaattttctgtagatatctcattcgtttatctcctctattttcttcccacctcataaatgtaagcatacatatcatcaagagactagatacgtgcctacttcctccgtctaaaaaaaccaacctagaagaattgtttctttttttggacggagggagtagatgttattgcaattgcatctgctgatgtcatggacacgtcactactgatactcctaccccaaacaggcaacagtaacagatgaggctgctagctagaactgctcggaattattttcaagagaaaacttagaatcgggtgcccgatggtttggggaaaaaattgggcgttgatgtcagcatgacgtatgcgtgaaaaaacactttaaactatttttttctcttaacttatttatccaaatcatgatccgattccactattaaattcgttgcaattaaatcttcaaaacaaaaccacacatggatatattccaacgaaaaattcttttagcttattattgaattatttttaaggcaaaattggttatatagcattgatagttcacgttttttgttttatagcacccaaagttcaccatgttcaccatgttcctatttttaacgcttatgtcaattttcgatcgttttctgtctgtcttgatctagccacacacacgatatgacgtttctacccctcacaagtacaagtagaatgcatgtcaatgaggggtagaaacatcatattgtgtgcgtggctgggtcaatagcgatcaagacggatgaaaatattgacggatgtgttaaaaatgggaacggggtgaactttgggtgctattaaagtgaaccggtatctttcgatgctataaaaccaaaaacgtgaactttcaattctatataaccaattttgcctatttttaaatattgcacgatgttctactaggtatatcggaattgtttcactaagtagatcaaaaatgtttcaatcgtttaattcgggcgttgttt

SEQ ID NO: 52624 - DNA, 1264 bp, Oryza sativa
caattttcagcatggttagctgtagtaggatttgtgaaatgcctccgctaccttccaagatccaagatataacgtcacatttaactttgaccacgaatctcagttgcaatccaaatgccagcatcagcagataatatgtactggttgcatgggcctggcaggctgtcagttaccttccttttggcatcccaggcttttctctcttcacacatcgcatgcaattgacacacacaatcaacaggcagcttgtgcttccatcactactgcaccacttcaccagtgccaatacaaaatgctgctgaccagtcaagccagtgactgggcatgttactgcccactataaaattccaacagcgtcggccaccagtagccatgcccctgtgaaccgcggtgaacccatttttttaccttgctgccaggcacaagacagcccaacacaacagatcagtacatgaaaaaaaaaattttaccatgtctctctctttctcatgtcatgcttgtgcagcgcttttgggttttgaccgcaatgccagttgctaccgcccacgacgagtcaccaggggctagaggaatccagtgcaagggttggtcatccacagccatctgaatcagattcagatcattcatggggagttgtttctttgcgtggtgtttagttggagggactaaattggggctaaactttagtccctctaaaaaaacataagtccctccctgtggtagggacttatgtttgagggacttatgtttttttgagagggactaaatttagtccctagttcccaaacacccccttggtcaaaaacttcaaagatccagaccacacaaaacacagcagctcttgtactccactttcatcagaggttttcacagtgctacactacacgcactgtcttcttggaggcagttaaaaaattggagggaaaggggaaagaagcagatccactcacatgctccccaagatgagcaattcatcagaacctcggcagctggtgagaggaagctgaagagtgaagaagagtctttcttttggcctgttccacgtgtcctagtggagtgtactactactggagtagtgatttgcattgcatgatgcacaattcagagagagctaaagaaggcagcgttacagctgctttcatgcgagagagacaaaccaacagtggcagtcacctccaagaaggcaaagaacagcaaagccattgctgagaaatagcaaggcagggtgatttgatgacacggcacaaaggcaacatcagaaagg

SEQ ID NO: 52625 - DNA, 1501 bp, Oryza sativa
tgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagtcaatgaggacttggaggaagagatagcccttcttgatagaaggttcaatgatctcttgggaaggagaaaggagagaggaaggggctccaactcaaataggagaagaaataaaagacccaacaagactctctccaacttgaagtgctttgagtgtggtgagaagggacactttgcttccaagtgctcttccaaggatgatgatggagacaagtcatccaagaaaaagagtggaggctacaagctcatgaagaagctcaagaaggaaggcaagaagattgaggcattcatcggggaatgggactcaaatgaggagagctccgcttcatccgggtccgaggaagaaggtggtgatgatgcaagctccaagaagaagaagatggccgttgttgccatcaaggaggctccatcattgttcgctccaatttgtctcatggcaaagggctcctctaaggtaacatctcttagtgatagtgagagtgatgatgattgtgatgatgtttcctatgatgagcttgtgagtatgtttgaggagttccatgcttatagtgaaaaggagattgtcaacttcaaggccctaaagaaggatcatgcttctttagagatcttgtatgaggagctaaagacctctcatgagagactcaccatttctcatgagaagcttaagaaagctcatgaaaacctccttttcactactcaacatggagctctcattgatgttggcatatcttgtgatttgcttgatgatagtgctacttgccatattgctcatgttgcatcatctagcatttctacctcttgtgatgatcctgtggatatgcctagctctagctctagctcttgtatttctatttatgatgcctcacttgttgttgagaacaatgagcttaaggagcaagtggccaagctcaacaagagtttggagaggtgcttcaagggtaagaacactcttgacaagattttgagtgagcaacggtgcatccttaacaaggagtgacttggattcattccaaagaagggtaagaaaccttctcaccgtgccattcgttttgtcaagtgccgtaaggttgggcatttggtgaatgattgccccggtggtaagccttctaaaacatgcatgtttgattctcattatatgcttaggacggctcataatggtagcattgttgctagatatgtgggttcccctatactcagtggtaaaaagaatgtcatttgggtgcccaaagctttggtctctaacctccaaggacccaaacaagtttgggtacctaaaagagcttgatcttcttttgtaggtgaactaccgcactggtggaagccattgggtgcttgatagtggatgcactcaacaca

SEQ ID NO: 52626 - DNA, 323 bp, Oryza sativa
ggggggggggggggtctagctgctagctatccctggcagtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaagg

SEQ ID NO: 52627 - DNA, 1501 bp, Oryza sativa
gcaatcttactcaccttcttatatgctaaatctgcatatatccacatatatactcagtcagacagtcaccctcttatatgccagtctgcatatatccacaagacagaaatattgatgatggtcagatggataacatggatctcaatataaacaactgcaatatgcatcaccaactaaaactaagaatttaacatctgttatgtttctcctgaatcctaacatataagccctcaagagtcaagagcaccattctagcaacccatattcagagcagttctgttaaattacagtgggctctcaagttgaattctcttatagtatcaaacaaagttaatttatactagtaatatacatcattgcattgttacatctgtctgaacaatgctcaacaccgagtgtacctaccaacgacgtccatttccattatcaaagcttatccattgtttgtctcagttgtagcatgccttttcccgtttgtggtttctacagttcactgattgcattttacctgttcatctcacatgctttgaatttccactctactacagtagctaaaaagggaaacttccaccatcctcactgccaaacagtagctaaaaagggaaacttccaccatcctcactgccaattggtccatgtatttaccattatgacaaacaacttcaaatcttcttttgaaaccgacgggaggagcactactggatatattaaggaggagcacagaagcctaccagaaggcagtacagacacaaacaacttcaaatcaaaacactgaggacaagcacgcaaaaaacaacaagtcttggtgtgtaagagttaatagacctgcattgtttgataattcagttgaactagaaaggcaactggaccgcacagctgagctgagttatcaatggaagatatgtcattcctgacgaagcagtagtgaattggcaatgagatattcttgcagtgcagctgtaggtgggtaggactttgatgccttgggatgacatttgctttctcccttggtttctcatcatgcatcttccttgctattattcatagtaaacaaccaggggaatgcagaatacgtccaagataactgatggagttaacaatctgacttcctaatttaacaagctaagtagcatggcatcagatacgtattcattctcggaggccagaaatctaatctgttctgttctgttctggacgggcataagttttaacaggaacctctagctggctagtttctttatcttgatgcaccgatctttcggtcgtccaacaacggaagatgaatgattaatttacgcatagtatatgtcaatttcaacctcgatttctccggcttatcgtcagacgcttcttctgcataaatagccaaatcctactgctcactgtctccataacacaagtagattgaagactagaccacatcagtcaaattaaacttcgtcttaactcattacttactgacagtttagcagctgatcgaacgattaaaatagattcaatg

SEQ ID NO: 52628 - DNA, 1501 bp, Oryza sativa
aaaaaaaaaggtgaaggccaaactacatgtccttgttctaactaaactttattaataatacaccgcatgtattccaatgactctacacactaccggtgctttccccttgacaagctaatttctgaaacaatgagataagggtttcgggatctcgtgaaatttggtcatatgattcaggaaaaaaaaagttgtttcccacaagaaactttaacatgaattttgatttttgagttctacagtccaaaagctattcgcatgtaaattttctataggaacttgttggagaatatgtgacacaacccagccttagcaaaagttggtacgtgattccattttaatcacgcctaaagtacttgtacataaagtttgataataagaataatcactaccttggaacccttatatcctcttaatgagatttttaaaaatcacacctacgtcgaaattatttgattaataccaatataatggttcattgcaaattaaacaatcgatttacctattaactattaaggtttaaatcgatggacaagattcacgcatttattcttagtctttgtctctttgtcatataaacgtgtattaaagagtgtgtatttgtggacatgtggccaccatgatatgcacatatatgtgttttgtccgattgaccaaataggtaaaaaacttttatgtatgtagtttgcatgaccttggtcatgtatatatcacacgttggtagtatggctatatctacgaattagaggcccggccggtgccttaaatattgtaaaaataaaattaaaagtacagttcaccgctgtacgttgctctttatactcgatgcctattatgggtggtgtgccatgtatccgcatcagaaaagtagctagcgattaatctaatgttcttctctttagctataccttgttattagacgaacatatttcaggcttttagcataatcgccgaaggagaaaggacagcttaaaagaaattgagtgaggaagttctaaaacttgaacaaattggtttggtgtggacctaaacaaaaattttagaagccctcactcattctgcacaccatactgtacaggcttgtttggtagcaacagacgcgcgtcgtggattacttgactagcgaagctagcagcatcagggacaaggttacaatacaagcgtcaaggttaagcaaacccgagaattttttttaataaaccttatgactaagctactcgacataatagaagataacatcataattcaaagtatatgtatcaattttaaacttctaaacttctcacatatgacggttgatctcagagtagagtggaactatggaccgaaacacagaagacacgtgcatacgtacaaagtaagacgagaggagagaagagcgagacctagcttgtcacacagcacgagcactaccaccagtagtatgctattacgcacgggagcatgcaactaggccagcggagcagcgcagagacgctactcgtgtgttactaaaataccttag

SEQ ID NO: 52629 - DNA, 864 bp, Oryza sativa
tttggcgccgaacaaaagggtcatttctgaaataagttttggccgcggttcatttgtaaaattagttttcagaaagggtcaaattgtcaaaatttgtgacttaaacagtacaaagccacggaacaatgcataatgagtgagctagagaacctatcaagcagtggataaaaggaagtttggtattgcaattctcatttgcttagagagtaaaaaaactaaaatgttggcacaaaagcctcatgtttgatggtagcagcctcccagaactccatatttatcctcgttagcaagtgaagtgagacattcataaattatttctctccacacatagctaccagcataggccatggccatgacattaactttgagtcattgagctatcaaacatgccatttctttccctcaagtgcccaatttcttgtagcgcatatatgcacagtaggccatggctttgcacaactcacccatcagctcaagcccatgactcattgcgctctagcaactaaacctccgaaaaattgcaagcgcggagcattgtgcactgccattctccggttcatcattccttgcaagaggaaggctttgcgaaaccatcgctgttaccaactcaatacaatcaccaggcaacatattgtcgtaatgtcatgagatgcatacaacacattgtcaccatggtttgtattgcacataaagccaagccaaagcagccaacgtctcctgccagcgcaccgagccaactttggcactcctaggaagttgcccggcgtgcaccctgggtactcagcaatttcatcaaacagttggcgtgcagcacccattggactagatcaatctgttcaccactgcatatgcctaacccgcagc

SEQ ID NO: 52630 - DNA, 177 bp, Oryza sativa
aattactgccttgtcacttactgatgttctaggactttgtaaagttgaattggcttcatctgcaattaccttaactggttaatttcttctgtatttttttccttattctgcttgcaatcttatactctcgacttggtaatacattagcggatgcatcatactgttgtatcttcatga

SEQ ID NO: 52631 - DNA, 311 bp, Oryza sativa
tttcttcacacaagggaacactgtagtgcagtcattatggtgagatataaattgaacctggtccttagtttaattgaacaaaattgtagcagtttactcatttcatatatatgtataatataaatgcacagttgggaaaccatgttattcaaagaaaactacaggtcatcatatgcaaagttgcaaactagaataacttgaaagtattggcaataaatgacaatgtatttctaggcagaaagaggatcttgtttcaagtattcattcaagataattccaccgtcaattatactgctattttctctgaaaca

SEQ ID NO: 52632 - DNA, 417 bp, Oryza sativa
aagcacctgttccgtgtagtaattgtgttctacttgcccaagtgctacaatcaatatcatattttggttgctggctttgatcatttgatccatcgtattagaggaatcccaagaactattaggattatattctatcctttccacaatacttgaaatttgattgattaatctggaaagttatttggcaaaaatatcaagcaggctataactagcactcttcgaggattgatggtgtcacatttttgttaactaccctgtgttatcttccaaaccttttcctaatggaacaaaaaactacaataattattttctgttcgtgaagtaggattctgaacaacatggttatctgtgtgcaactgcaataacactttgataaatccaatacacctttgtgatggtttctgatgccatgtcagg

SEQ ID NO: 52633 - DNA, 1501 bp, Oryza sativa
ttggcacactttgtcctcactcgtgcacacccaggagttctttggagatcggcttccggaaaagaagttgcaacttgttgatatgagtattctattaatcctattaagccctgggccgggatgtcacaacacgtttaacatatcatctctaattcataaaccataatattatggtataattttatttattttgtttgctctcacactggctgtatttgagaggaggggaaaagagaagagtgagaagatacacacaaaacgagatgagccattaacacatgattaattaagtattaattattttcaacttaaaaaatgaattaatattatttttttcaaacaactttcgtatagaatgttgtttgcaaaaaaagtaacatttagcattttgggaaacatgcacacggaaaatgataaatctctttagcactttgtttttcacttttttaaagattaatagatgttgtatttgcataagaaacagcttatcctctctgccttatcagttcccttctccaccacaacctaatcggtacttttagaagaagcagccaaatcttattgcacttgttctaactgcggagaacaaacggtaaagtaagcaataaggatggcaaggtgcttgtggtgatgtgtggtggctgacatggcacaaatcacatctgtttataacaggtgaaggatgaaagtgaactttttaaagatgtaaaatatgctttttccttataaacttttgattccaaggacacattttctccatttacatgttcgtgttttttcaagataaagtgccttacagaaaatttcaggggacaatgaaatgcagaggaaaagattttgtgattaactccatcgtactgatgagtgatgacgaaatgtatttggatctaaatacaggtgttgttagtctccttgtggatagcacctaaatctagttgcaatcacatgagatggtcctctatggctccatctttgttgacatcgaagctatgataggaccgtaggagtggttagctgttgctacccagattgtttatcgcccaatatataagatatctaagtccgttgtgtacagaataatagctaagatttttcacgaatctagatacaattaaaaattgactaattatggtattaaatttatttgatatgcgcgatatgctgcttacatctattgatgcctcgcccacctataataatataggccagcctcgtaacgagtataatatatggatatacattaagctcggggcaagtcatagatttaatgaaaaaatgtactagaacattgagctataaaatatcgagaaaatgaaaacacaattaaccttatcaccctctgtagcttcaatatccaaaccaaattgcactatgggactcgataccaatctggcatttctctgcatgctcaattttctcaactaccaatactgttgtctaggaccagtgccatcatttgtttgtttcttccctccttccctacaaaaaaaaaaaaactgtg

SEQ ID NO: 52634 - DNA, 1501 bp, Oryza sativa
acattactagagttaagaaagtttatgaacaaatgcagatcgtggatcacctgcaccatcaaatgtcaataatttttttcccaaagtaatgtcaagcaattctggccatgagcataaattcacttagctttacccagcgaaataaataaattcactaatagctttctcccccaaacccctagagattaaacagaaacatgaaatccatgaccaaaaacgtgaaagttatactatatcagtatgagtatctatattcatagtccatatccatagatagaaggaagaataaggcgaaggggggatggggtacggacgtggcggagaggtagtggatgaagatgcgggcgctctcggcgaaggcggacatggcgtccttgttgacgatgacctcggcccctccggcggcgacctgggcgagcttctccttcactaggcgccgcacgatggccttgggcagctcctccacctccgcctccgccatggacgccgccgccgccgcttggcccggctgcttctcaggttgggaatgggatcccccaccttcccccgtctccccagccatctccctctctctctctttctcaggttgggaacggtggtgcagcggcgattcgacaaggcaaaccctagcctagtgaaaaattgacgagtcgcgcgcgctttgtctcttcttcccccctcccttcccgcgctttgcttctgcttgagttcgcactaccaaaacaagcaactgtccattccattttcatttcgagcactaaagaatttcagttccatttttcactctaaaaacacactccaacaaatctaaatctaaaccacaattgtgaaagcaagatggtgtctacttccggttccgggtcgagattatgcacacatcactttgaccagtcaccaggactacatgtacagttgagtcggggacacagaaaaagggagaggaatcagatgggccaggaaagaggagagggccatgaacacaaagcccatgtcagaccaattcctattttttaaaaaaaattagacaaaacatggggtgttgcgagaatcgaactcgcgacctctcgcacccgaagcgagaatcataccactagaccaaacacccgattcgaacttttgtctctggaacatttaactgacccaagcattttacaaacagtaagaacagctactacgaagaacaaaatgtgtttccccttccacaggtagtaagaggtaactagtcaacttggaagtaactcagatggattcgcggtcaaaaagtgggtgagtgttactgatgccagcaacgggccggtttcagcccacgcaaatgtttaaagcaaaagcaaagcccggcccaccataaaccctagctctctttctagcatggacaggaggacaggacccgattcctcctccctcgccggcatataagtagccgcagccgccgcctccatttcccgaccttgctccacacccgcagcagcagcagcagcaaggagaagaagaagagccaaga

SEQ ID NO: 52635 - DNA, 1501 bp, Oryza sativa
cggttagcagccactggcccaacgaacccgggcgacatcaatgcaatattgccatcctccacctagcatagcagcagcttgatcgataacatgatagtgatactccttgtatgaacattaattatagtttatacccctacatgaacatgaggttgtatgtattttgttgattggtttttcagagagcgtttagtttaattttggtcgtaggtacgatatataggatatggcgctgtaatatgcatgaccaagagaatgtacagatcgatataatgtagcatgacatgtacagtacgtatgacagtagtcgtattaatcgcctggatgtgctagcgtctaacagtcaccaaccctactggcccatctcctccattacccactgtcggattccaattaagcactgcattcacaccggccactctttcagtttgcagatgcattcaaccatccagaaaatcaccatcaataaacttaataatatcatatactacatcctaaaatacatgaagaatttaatttggactagtgcattactagcactctagcaccaagcaagcaacacataacaacgtggtggttggtttaatttggactctcccctgcagcctctttctctagctagctgcttcaattcctgacctctcattctccaaaacgagagtacggtctggtcaagaacagaacagagatgcaatgcatcagtagatcatgcatacaattagtgatgagggattagtaacggccggcacgcgtggcagattggggtatatgctctggttgcagaagcgagagagaagaagcgtccaagcccaaagagtcaggcctagcagcagcacaccgttttccagtttccctccttcccatgaaatatactatgtgtttcatccacctaaacaaaattcagaatgtacactttggtcgcagaatcttgcctttcaggaatgcatgctcgccatatgcatttgctcatgcgttccactcataataaagcggcttaattccccatctttgctcctactaaccttgctgcttctagctagtgttgttatcaggcgcccatgcttcattcttgagctacttgtagatagcatctccagcaaataaatgatgtctagctaaatcgatcagtgtgtgatgctacatatttatatataattcggaacttaatttgaaagctatatttcgagccggacgcttctaggatgtttctaatatccaacgaatgaatggcaaattactctgcctgcatggccactttgctgcgccttcccagggtaaaaccaaaaggatattagtactagtagtcggcccaatgcagaaacttgtaaaattacactgccaattcctgctgtaaagctggtgcatgtatgttcagaatctgtgagttatgagtatttgtttgttttgcaatattcatgcgctaggcatattggtacactccaagtctgtttggtgcgcaaataattcagtaaaggctgcctagtgcttactgttctttttg

SEQ ID NO: 52636 - DNA, 1501 bp, Oryza sativa
gtggtgtataagctgtgtgtttgtcacggccacatgggaactcacaatatagtatccatggcggctcttgccattggcctcctaagcagtttgttctgctcgagtaacttgcccacaggatagtttaatcagcttgccatgtactatctgaattcctgctagtacagtagcttgggcctaaagttcatcttttttggggcctctttttcgaatttctttccccttttttttcctccgtagggcagccggcaacatggatgcaggatgcagaattaaaacatttaaactgtactcctcacttgaaggaccacaaattgcttttgctaattgcaatgtatcactcttcactttgtgagtgggaatggcactttcagaaagacagagaaaaagattggtttgcagaaacataaatcagagtttcagacttcagcaggttaattcagaaaataaaaaggattagtcttgactgctggataattttcagtttaacattttagcatcagaagtcgaaaattcgtgtgagctacttactataatgcagggacttcgttgaaagctgaagctagcaatggtagctagcttctaagctagttaattagccaaaactagtttaattagcagagtgaaatctgacgggtaggtttgtttagtgttttgccgggtagaaaggcttcaggttgggttaaattaggctgtttgttgggggattaacacttaacagccgcaactttagaccttagacacgccacccggcgaattatcagcgctaatgacatgccattagcgtttgcagagcgtggttaagtgcatgcatggacacaattatccagcgaaagcaactgatgccaaatctttgtcgacgcacgcctagccctagttcatgccactgataatcaaccttctgtcaattaagttacacaatattgtataagaaccagacaagcagaggaagcaggcagtactgattactgaatcctgaactgatgacagagtgacttgtctgattcagagagattctgctgttaattaggatctctgacactgttgccatctgctgaaacattcccaaaaattttagctacctcgtactgaatgaactggagtatgtgtttctgtaattctgtctttacatgcaggttataagtacagtttcaggttaacttcgagcatcagtaacgggaagagaagagagaagcaaatttgttcaggctgctgaacatatataaaaggacactctagctctgcactttcatgaaaagaagttaagaacatcatatatataatcctttgcctaattgactaattatatatcagcataacacctgtcccactacttgtacaaaaccctactcttctcttctacctcttgcacaagcacaagaacacaagaactcggaaatggagctgaacaccagaagcttgcagcaatctggtagcagcaagagcaagggcaagatcatggcgaagatcgtcgaggaggatgaagagggggaggaggagg

SEQ ID NO: 52637 - DNA, 1501 bp, Oryza sativa
aactcggaaacctcagaccttacatgatatagtataatcctaacccttttctatccgtgaggattatttctataatctcttgtcgattttcttatcgtatacggaaatctatcacgcatatgaaggtgtgacgtatctgtatatttcataaatcgtagaattaatataaggtaccttatccgtaaccatgacaccttcctacactgttttcgcctttcagacaaggaggatcctttttaacacggctttcgaaacttctaagatgtattcgctactcctctttcttatcttttactctctcatttttcgcgcactacttcccaaaataccaagcaatattatttttttaaaaaaaattctataaaatattgtttcaaaaatcataataataatattagagtcaattgcattggtggtacgcaaacttgttagatgtgtgtaatttagtatataaacttgtgaaatatccgtttcagtacatgaacttgtctagttcgtgcaaacgaggaccaaaatatcgttggcattgcttggtttttcttcatctttttctactatcactatatcatattctattttttttattgaagatgtgcatgtctaattgcaaccttctcagatatatgtttaatcaacctctaaatcaataagattagtcatgtagcgtccttttcgccttcctccgcacgcaccagacaagtttatgcaccaaaacaagcattttacaagttcgtgcactagattgcacctactgacaaattcgtgtactgatgatgcaatttactttatatttatcaagcattttaacaagtactccctccggaaaaaaaacttctaatataatgaatctgcacatactagacgggtacatcctttcgtaggttacctttttttggattgagggattacgtacttaattgtgcgataactcgtttttcgcacgggaggaaatgagttagtacgaacaaagtacgttcgaactaaacctatgcctagagtaacggaaagctacaaataatcttcagggcataatatccaatttccaaattcctaaaggggtaaaccagaaaaaaaggaaaagatgacggaattctcaatccccgcatgggagattccaagcgccagactgacagattgaccttgtccccccctcacaaacttacacaaaacccttaaaacattcaaaattcacaaatagctccctataggggctgaaatgtaagacctcgcttcggacaagccgaccccgcctgctatttcccgaaactccaagcccttgtatgaaaaaacgccgtcttcctgtagtgggtggtggaagaagggaataaaaaaacaaagaggaaaaaaaaggaaggtctcatctcatggtcgcctagccaagccaagccaagccaacctcctcgccgaggagagagaagagaggagaggagacgagaggagagagaagccgaggaggaggagagagagagagaggaggccgctccatttgccccccccccca

SEQ ID NO: 52638 - DNA, 1501 bp, Oryza sativa
taactcaaaatcccaagttttataatttgcttcatgcaatcttacgttttagggcaaaatatttcttataacctttaggtccaagcctaaatcatccactttggctaatatttttcttttaaaactgtaaacaattgtatgagatattttgtcttcctccgtttcataatgtaagactttctagcattgcccatatacatatagatattaatgaatatgagcaatgctagaaagtcttacattgtgaaacggagggagtatataatataaatgtcagttgctttgcaactagcgttgatcatcgatggtttgataatttatgtgtatatttagcttattctcatgtcatgaattacgttaagttttttaataccacagtgcagaattgaggaaaagaagataaaatacacgagagggatgcatattttgagtcaactagtatgaatttatgtaaaaaataatcatatagtacctctattttttaatagatgacacggttaactttagaataatgtttgaccattcatcatcgggctaattcgatccatgccaccgcaactttgccaaattaaaaaaatactactactattcatcgtatcggctgggcgccactgcaattttgggaaattggatccataccactccgtcgcgttttccatccactcccgttgacgccgtctttccccgtccgaggactgagccagaggacaccaccactgactccggcttcggcgacgacaccgacgcaggcgcaagcggcggcggcggcggcggcggcttagggttctcgtggtggcgcaggcgcgagtgaaggccggaatcccgtgcggagcagcccccatgccatgacggcggttgaggacaccgcagggagcgatgcggctgctcctcgtcgcctcgccggtcgttcgctgcgaaaaggacctcgtcgtgcgcgtccttggccagggacgctgacgctgctggccggagacggtggcgcagccgcggcccactctgccgccttctccttggatgcctcggcttcctcaccacatgccccgacagcacgatggtcgccgagtcgacccgtgaggtggctttcgttgtcagcgtcgtcaacggcaaggccgacctgggtggcggcgaaggagctcggcggtggcgaaggagctcggtggcggtggcgagggagctcggcaccggagaccgcgccggagagaccccaccagggccggccgtgaccgcgccagcttgtcttccgctcgtgccggccgtcgcgcggtgtggaggggatgaggatgagacggtgtgagagatgagatggaaaaagtgacgggagtggcatggatccaattttctaaaattacagtggcacccagccgatatgatgaatagtagtggctttttttaatttggtaaagttgcagtggcatcgatccaattaacccatcatcttattagattaaaaaaataatgtaaatatgataaattataagtcatacttaaagttttttaatta

SEQ ID NO: 52639 - DNA, 1501 bp, Oryza sativa
cctgcagcaaaacaaaactgcaaaaggagactgcatatgcgcaagggtgaggagccaattttgcgggcggaccattcaacgcgtacgtcgtgcacgcgcgccgcctgccctgccagaccaggccagtgagcgcgcgcgtgtggtccccctcttctctccaccacacatgcttcaagtggctaggagggcatccttccttttaaggaggtcccctctcctagaataagcaaggtgctactaaactccatatgcatgccatctcatgaggtgggcttttgtgattttccaaagaattaatcttcgaatgggccttagcccatctattaattccaacataaaatatacggaagaatctcctctgacataaagttagatggacatgtaaagttaaaaagatttgggtccggggcccaaacatttgttaagaaaaaattgtgagtgttagggattgaatattggaccatcaagtgcactttgaaaccatacaccatttgccactgcactatcaagtgcatctccacatatcattatattacaaagcaaaccatttatcttttgtagttccattttttttgtgaagtatattattgtcgatggaattttaggtgcataactcatgtttccctgtgtgcatgcataggtgatttacagtttttgcttacattcttacgtaactatttacatggaattgcctgttcgggcccatggtagaaaaaacacagtaatgcatgtaatgcatatgctaagcttaggattgcgaaatgcatgagcaacacaagaatttggccttggattggatgaaaacccagaaatgttttaaatgttatatttgtatgacacagaaagattgacattaccctgaatcctggatctttggaacgaaatttcctacaaaaatatataaattcatagcaatttttcaaaggaatgggtaaggtgaatccaacagtccagttcctctgcaattccccggttcttcttttggttcattagaaaaatgttggaatttcacatgagtaataaaatcctccaatacagtacagataggaacttttttttaaaaaaagaaggaaattccaaggtaagaacaggcctgacttgagtactcagttttccacgctagtaaacagtaaactgtaaactatagttttccacccagatagtagctactaagagaaggaaaaccaaaaccaaccaccgcatgcactataatatgatgttgacccactgatggtgatgctcgtttacctgctaatttgtttcttttaagttagtgattgtcattctataacactcatctctattatactatctgctaatctgctatatccaaagtctccgttgtcctcaagtccacctcggcgggcttcatgcaagctgcaagcattggcatctaaatttcacccaaaaaaagaaaaaaaaggaaaaaaagcagagaagttagcctggcaagtgacaagctggaaaaagagcaatcaatttcagttgaattccgttaccg

SEQ ID NO: 52640 - DNA, 202 bp, Oryza sativa
ggcggctgccaggctgggcctcggcctgcggccggcccagcaaggaggagggggaggaaggaggggaatgggccggcggcccatccgaaaaggaaaaaggagggaaaaagggagggaaaagaaaaagaaaaaggaaaagaattttccctggaattaacaattgcactttagtgatttttaattggttaaaattatttctagg

SEQ ID NO: 52641 - DNA, 1501 bp, Oryza sativa
cctccactatgaccatgatcttggcattgacttcttcttcaaacatgtggatataaaatcatggtcccaccgggcgtgccaaaagcgtgttgatgcgaaaaacacgaggcctgggagatctgcttaactccagtgcaggtccaaaaatcttgatgagatgcgggtgtgccagtcagtttgaccctgcaactgacaagatatataaacagtagatcaaacggctgatcggctgacaagccgatggagtagttccagccgatgccgataccagccgatagccgatgccagccgataacgatagggttctaagctatcggctttatgtccaatgtagagtctgacacttgacttaaataatgatataaaggcaatcgactgatgataatatagtataacaataatataatacagtataaaccaatcggctagcaatgagatgatagaataaacactgatccgaaggttaaagcatacatcggctggaggtccaatgttataaaatccacaatattagataaacagtaaaacctttgttgtgatcggctaagtccaacttatatgtatatgcagtccttgtaagcccatgcaacgtccagataactcatcggctgaaaccccgatgaaacccttattggcaatcaagaagcaggctagagattatggttctaaacatgacttagtagatcaaactcaactgatgcagtactaagtatgaaaagaaacataatatctagacaatcaagccgttgactgatttttagggtggtaaatgtctaagctaatctaatctagcaacacgatttagccgataccggcagaaaccctaaagcgagaagcggccgatagaggtaaactgatatgctaagactagattaacagagacatatgataaataggtagacaaatatatcatccaaaccggagcaatccaagaggtcgaatgtactgatgcagccttgaacaacgctgatgtagatgagacaattgcctgggccgacggaacgtaggacttaccccttcgctgaagatcgaaagccgatgcagccccgcgtcaggtgccaagttccatcgaatgataagtaaaaacctcggtaaagagggtggcgatgcgccgagagtagttgtattgatcgatagattgatagattacaatgacccagggtgtacatatttatacccatagggagatactagtccttgtcggacaggaaagaaactaaagataaaaggaaaagataaaatccttatcggacactaaacacactttctaaagataaaaggaaactaacaaactattcataattaatagataaactgccatgccgcatccttcttgaactcggactcttctggataaattccctttagttgatccaactccatcgagaacacggttgctggtgatttgacgactcccatcggctgattccataactctgaagccgatactgactctaagccgatgatgactttgggcttaccaaatttcgtcgttaacagc

SEQ ID NO: 52642 - DNA, 1501 bp, Oryza sativa
gaagcacctctgctggttggccattggtgtagccgtaggagtacagcatggattgcagccagttcatctccctgcaatcggttggtttgatgccgagttcgggcaaatggtggtcgatttgggtgatcatgtcgctgcaatttccaagaaacaatgatttgaacgtcaccaatggatgacgagttgagtcgtcgccgtcgttgatggtcttggcctccatggacattttgacgaacaggttgtcggggagagcgtgcgccacggcttgccatttggtgaggaggcggaggagagattgctcgtcgtggccacctcgccggagtaggaggcggtggacggtgaaggcggagacgacggccgggacggggacgaggttgacggtccaggagacgacgatgccgacgctgccgccgccgccgcccctgatcgcccagaagaggccctcccccatggccgccctgtccaggagcctcccctcggcgtccaccacctccgcgtccaccacgttgtcggcggcgaggccgtacttgcgcatcatcgggccgaacccgccgccgctgaggtgcccgccgacgcagaccgtcgggcagattccggcggggaacccgagccgcccgccgctcccctcgccaccgcgtagtagagctccccgagcgtggcccccgcctcggcgcgcgccacgcccctcgccgcgtccacccgcaccgcccggagcgccgcgacgtcgacgacggcgaacctcggggaccggccgagcgagcggtacgagaggccctcgtagtcgtgcccgccgctgcgcgcgcggacggtgaggccgtgggcgcggcagcagacgacgcaggcgcgcacctcgtcggcggtcacgggcgtgagcaccagcgccgggcggggcgtccgcggcgaggcgaagcggaggttctggatggtggagtcgagcagcgacgggtaggaggcgtcgcccggcgcgtgcacgagccgcgacgggtcggcggcggtcgccggcgaccgccgcgcgacgcaccggaggaagctctcgcgcagatcgccaacgccgcagccgtctcgccaccgcgcggaacacggcgaggcgagcagcgagaagtggaggaggaggaggaggaggagagggaggcgcgggcggcttggctccatcgtcgtcttgctcgaggtcgcggccggagctttgctcagctccgctcccactgcgtcgaacgggtcacctacctgctcgatctttgggtttggtggctacacgtaatgaggcatccataaccagaaagaacctcaattattgtgatttatttttaaggaacctccgattttaagataaaatatttcaaaaagccttatacttttcaaaaaaaacctcatattttactattatactcccttcatttcttaacaaattacgccgttgatttttagcataacgtttgactaattgtcttactgaaaaattatataaatgtcattttttttgttgcaacatattttataatta

SEQ ID NO: 52643 - DNA, 1501 bp, Oryza sativa
gtattaaaaaacttaacgtaattcatgacatgagaataagctaaatatacacataaattatcaaaccatcgatgatcaacgctagttgcaaagcaactgacatttatattatatactccctccgtttcacaatgtaagactttctagcattgctcatattcattaatatctatatgtatatgggcaatgctagaaagtcttacattatgaaacggaggaagacaaaatatctcatacaattgtttacagttttaaaagaaaaatattagccaaagtggatgatttaggcttggacctaaaggttataagaaatattttgccctaaaacgtaagattgcatgaagcaaattataaaacttgggattttgagttaagaatgcccccaaaaccagaacatgatgtggtattttttttaaaaaaaaatactcctaattattcagctagtaggtgatggtaattgatgaaagataactagccaaattttcctgttaagcccacagctaaatttcaaggctttttttaaaaaaaacattatagagtttttttttttagtctcagggcagacccaaccaaacgttttcagtcccagtggaaagaaagtggagctggttgtgatgatcaaaaaatgaataaagaggtgaagtggggtttgggccaatccataacttgaaattagatttatgagtttgagagccctactaaataggtccttggtctctcaaagtttaaattttgtgaacataattagatttaattttagggttttttttaagtctgtttttttatcgttggcttttaaaccgtaataacacaaatatttatgttttatttgtgaattattactttttttgctttgttcatttttcttaaatgatcagagcatatgttttaaaactagtgaggatcaccttaaaatcatttttcatcgcttggaccacgagcatttattttataaaccgcatgggaagaagaggaaaaggggcccgattcattcttgagacacagctcgatgtctctgtcggatgcatcaagcatttcgactgaccaactggaagcaggagacaaaagcggtatatcagaaaacgccaatctcttgcagccggtgaccggccagaaaacaactccgtctcgccaccgcgcagaacacaagcttttgagctgtgctactccgcttgaaattaaaacataaaattaacagagagcgatgtaaaaccattggattatcataaaaaaaaagaaaaaaagaggcagctcgacgtctctgtcggacggcatcaagctttcaacgataactcaggtcacgaatgatttcgacaggccagctagagcagtagggaaaaagaatggtagtatttgaaaaaaaaaacgccaatctcttgaaaatatctaatctagaagggactaccttcctgaacttgcaattgtaagtaggtgatcagattcagaggtagctacatgtttccatgcaaaagcacaagtgtgacattggacaagatgatgt

SEQ ID NO: 52644 - DNA, 487 bp, Oryza sativa
cgcgctcggcccaatggccggccaagccttgagaatccctcgggccgcgcctaagtcgcccgaggaagtctaaatccgatccctccttccttttcttttccaagggaattaataattccttttccttgtccaggaaatccatttagacctccaaaattcatatccctcgatccgtagctccgatcgcctccgttccacttccagtaattccgtaaaattgagatctatttaatggcactactaataggtctaaataggatatttcttttggtcttttgtttaggttttcgattgtttgcgtatagttgcggttatcggttttcgttgatcgcgggttctctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 52645 - DNA, 1501 bp, Oryza sativa
aacgaagaggaattattttattatttcctgaagaattacatttttctgcatctcattattccttttgcttggttacttggttcatgcaaggtcacatttctgctgctttttatgttcagatggctataatatctagactctatccttgcaaagaatgtgcggaacacttcaaagaagttttaaagtaagaaatgctctccaaccactagcataaattatagtatccattttgatagtttgattcctcgagatgtgtttctgtgtgacaggactatgttttgttgaaatgttggtatgtaatacattatcaacctttatccattcattgttttagggcgagatataacatcatgtaggaactataaattctttgtacttttgcattatgaaactgtgcttctggatcttttatattctaaagctatgcatccacaaactcgtttaaaaactttttagttattttacaccatctgtaccttttgggaatatgatttacagaagctatggtgataatgggatgtgggaattggatgtaacaatccatttataagctcatttctcttatagctatttttcatttacttttatggttataatgtcgtttttgctgtcatagtttattatgttccagttatatccagctgccaatttctgttgttctgtttttttcttgtgctgcccttaaattttcatgtttgtgctcaatgtagcaacaataaactgtctcggcacaatattgaactgacttctttatgttctttttgcttagagcaaatcctgtgcaggcaggatctcaggctgaattctctcagtggttatgctacgtgcacaatgtggtcaatcgaaggtaagtccatattgtcaagtttgaactgttgacttgccattccgaaaggaactttcttaaggtattgcattgttaatttgttcgtatagagttgctgcaaaaataaggtctcaaagccaaaaagaggaaaattaaggcacccttttaccataaagggggtatgtgttttgaagtatagatgttttcattcacaacatcatgattttgctgaatctcatggcctcctgccctcccatgatgagattattcacaatatctgagcgttttgtggttgtcttttgcagccttggaaaacctatatttccttgccagagagtaaatgcacggtggggtaagctggattgtcctgaacgctcttgtgatctagaaggctccaacgacatcatcccgaatagatgacattagatagggatcgtttagaaattctggaacagtgacaaagtttaaaccatcactggatgggcagcatgaagagcatatgggaaaagaattataacgccgtgccggcattcttcctatacccttgtaatactagtgtatcaaatgtgatttcattttgttatttacaagcttcagctctgaagatttttgctgaggttgtcatttttgtggatttatatacttcgttctgatgctttgattcaactccctgta

SEQ ID NO: 52646 - DNA, 1501 bp, Oryza sativa
cgccccgacgtaaacaaaccgttatggcttataatcaacataagtgaaacgatgtctgtctttgttccgctatacagacatgtgctgattaaattttgcacgacaacctaccaatctaccatacccttatacgtattttatgacatcgtatttagcacatgttggattcttatattctttgtttggcttagacactacgaatgatgatttaatcagaaaacaaagtgtacacctttctaccgtcttcaggtcttttcattgagaactacttggaaaattgttgcatgtgacaatacaatacctccaagctgcatttcaatatttgatgtaactgcaacaaaacttagtttgtcaagtcaagttttgatttgactccatatattctaattccattgacgaacttgagtagtattctgacgacattgaataaaggaagaaataaagcacggttagcttctttcttaaataatcgtgtcgaaataaagcaagtggttggtaaaaagggggaacaacaagacaggccgtggacaacagttccaatagatcagtcgaaagacttgcaagacctctacctcgcaggaacgagacaagtgttgggtgatgggaagaacaccaaattttggttggcggactggttgccggtggggagcataaagtcgagattccccttgaacttcagccatgtcgagcgctcgggcttgacggtggcacgagggcttctgaaccacaggtgggtacgagacatcaagggggcatcctccaatcgcgcaattggggaatactttcagatttgggacgcggtccagggggtgcaacttcaagatggggaggaagatgagacaatctggaagtgggcaccaaatggataatacactccctgctcggcctacagcatattcttcatgacaaacacggtggcgcgatgtggtactctgatttggcaaacaagagcgccgtcaaaggtgaaattctttatgtggttggcagaaaaagggcgatgcctcacggcggataatctaagtaagcgtggctggccgcaccagcaggtttgccaactttgcttggtgggtgatgaagattttgaacacctatttgtgtcttgcacctacacgaccagggtgtggagaatgatcaagggctggattggggttggctttctgctgccatctgagtcaggcttggacttgggcgaatggtggttagcgatgcggcaaaattttcggaacaactacagggacgccattgacagccttgtgctgcttgtttgttggatggtttagaaggaaagaaatgcgcgtgtgtttcaaaaccagcggcgctcagccggtttcctgtttggttcaatcaaataggaagtggcgatttggaaggaagctggggttttcaaaaatataggagagtagtctcttagtgtaatcttttgcttttgggaagttgctccggtgacaacttccattacttcgacagctttttgttgaagttataactttgtatatttgta

SEQ ID NO: 52647 - DNA, 1501 bp, Oryza sativa
acgctccatttaggatagaacagaaaaatagggaaatgtttccccacttggctcccttcatccgacaagttgtatcgcctaactaataaccgtgtttgtatcggcacaaattgacgcagaaaaggatagattaatcccatgcaaaatggatggatcgatccacaagttgagaagaacgctagctcgaacagtttgctaaaatgctgttactgtattctaactttgccggataagcttaactattggagagttgggcgcctgggtgggccctatctcccctaggagagagatcgcactgccgcttttgatttttgactgactcggaaatccattccctctgcaacggaaacgtcatggtaaaaccgaccacggttagtgttgcaaatctttgtaacgccaccagtggccgaccttttgtctgatcaccgcatacaattatcgatctttttcacaggtggattcacaaacccaatcatgttaacagggtaattaaaagctaagcaaaagagcttcatcgtggcaggatttttaagcctcaatccacagcaaaagaaaagatccagtggtgctgtggtgcatgcatgcacgcagttaatttctccccaccactccaatcatacgctccactcccagccgacgcaagttaattcatcgcacaacccataattaaattgaaccaataataactgtttttttgatggagtcgtggatggataacgccacgcagataaaatcttttttttttaacttcatcgatgcctttttattcacccagcaggtttagtgatatcacgaaccacaaaggcatttacaaattctggaaggagtcgatccaaacgatggattgacccgggtcccaactagcgcctattttggcaagatcataggcaacactattacagcaacggagaacataagcgatatcgacatggataaaattcagctgaataacgccacgcagataaaatcttgagaaggaatcacaaagccaaacggccgccgaattaacggttggatcgatctcggcctctcctttttctgctgccacctctgctcttcatatgcttcttgccaattgaatgaattgatcgatcgatcgatgttgctgcaacttgcatacatggccgatcatatgcgcccgcgcgtatatgcgcgcactttccctctcccgtcaaccgcgcccacatgattcaggggagagagagagagggctcagagaaggaagtgcattcgcgcgatatctgcgtgattacgtccgtgcgttacaactttttaaaaaaatctcacagttttattgttatccctgcgagaaaatagaaggccggaaccccactgcagccgggtgcctgtatatatatatgctacattcctatgcagagcagcagagtcgagagagagagagagagagagagagagatcgatacggttgcgagattgatcgatcgatcgatcgatcggatatatgccatgatgagagatgaagaggaggaggaaggggtgg

SEQ ID NO: 52648 - DNA, 1501 bp, Oryza sativa
atcatattgactaaaagcctatgaaatgtcctagtccactataagaatcaaaagcatctcaaaacttaaaaggggcaattgctcattttatcctatttcgaagcttaacttattaatatgactatactttttttagttcgcttatttaaccatgcttttcaaaattgaagatgaatgcttacccaattccgttaaagcgagttaacggtgttaactaaagggcaaatggccccttttgctctacttatttgaccctgttacatcaaaacgtgcatatatttggatcttttgacatatttgtaacgaattctgtatatctaccagattagagataagtttgacagatttggcttcaatttataaatttgaaaattttgaatcaatttaacaaatttgacttaaatttgacggatttttgacaaaataaggcaaataaaatttggcagaatttttaacaaaattttgacagcatattgtcttattttgtggatcccaacactactggagaaaccatctttactcggtcgagcaaaaaccacaatagtcccagttgcaataaaaatcgggattaaagattatctttagtctcggttcgaaagattagagctacttttttataccaaccgggactaaagatcatttttagtcctggttaaaagaacaacatgcaatgtcagacctctctattatctttagtcctggttggtgttaccaaccgggactaaagatatatttctagtcccggttagttacaccaaccggaaaaaaagattggcatgcgcggcggagaggctgaggcatgcgtgagatcgaggaggaggagacggatcagttaataagttctatctcctccaccctcaccttatctcttcctcctcttcaccccatctcttcctcttcctcctcctctcctcattctcttcctcccctaggcggcagcggcggcggcggcctcgcaccgcggcggccgggcggctgcgcatctgggaggggaggcagccggccaccgccggatccgaagggggaggcggccggtgcgaaggctagtgcagcggtaggcggtggaggccggcgctgcttttggatttttttttcttttgtccttaccgtgtgattcaatatgtgttgttgtgaatgatttgggatgaactatattaccgtgaatgatgaatgtttgatctgagatgatttgggcaaatagcaaaagaacagtgaaaaagagagagaagaaaaaaaagaaggaaaaaaccctctagccgggaccacatcacaccaaccgggactaaagatcgattgaaccgggactaaagatagcgatatttattccgaattcaccgttccggttgtataactgggacaacagatggttgccaaccagtggtaaagattggttgtgcagccgtgcaaattgcatacaatgatgtagaaacacaaattatagtcaaatccaacagagatgataaccaaacaacaaattcacggcaagtgccataacagtagt

SEQ ID NO: 52649 - DNA, 1501 bp, Oryza sativa
atccttttcggagaaactgctcatgtcaatttttatacgtcgagccatttacactgaacttttctactaaagagttgttctggtggggcatccatattgttgctattattttttaggtttaatcagaggtgtgataaaaatcaataattgtgacgtttaactgaagaaaactaaatcagtcccaacaacgaagatcataagtagccatcacacgagttcacaaccgggccacataacatgcggttcaagccttgaagtgaactcgtgttatctcctccatcaaaattaattcaagcgtaaatatctctagttgaaaaaaatctatatgtccactacttttacttttgattagctgatgatcttagtcaaactcataaggtgcgtaaccatcgtggctcaaagctttcaggtgtttctcactttctctttcagcaaccaaaaaaagaaaaaaaaattaacaaaacaatgcagagcattttgataattttttttctttggtgtgattggtgtccgcgtttataacaacgttgccttcctgtttgcatcaatatcgccctgtcacgcattcaattaactttttgttacctagaaaaaacactattatgttttcttattttctttttttttttttgcatgtagcaatcaaacaaagcaggatggctatttgtttgtagatacgaggtaggaaatcaagtcaagcatatatagccaatacagtaaaaatgtttattaattccataatggagaattatgtatcttaacttttctacaaaatttgagatctaggtcatgtattattatccatattaaatgaaggcagcacggattgtactatagcattttgggcaactcaacttctttaagcttggaaatgaattaggagtacatcatttcattgaagaacaagataaagttaaaaaagcaaaaaacaatccggtacgtgtgcctaatcctcccgcaagttacacgcacaaacacccaattactaaacaatataaacaggacaaaatgtccttcgattcgttcgctaacatcctaaactaaaggaagtactactagacatattcagtctagctaacctacccaaatcttctcagccagtacttggctttccaacaccaaaatttgtcccttattgatcgttttcttcttcacgtttgatttatctatttcaaatacaatatatattttataagttgagaaaacatgtattccaatttcctattatttatcacccttgcacttcactcctggctcccatttctcatcacgctattgcatttaccaagtttttttttcaagtaaaaacgctaccattgaatcatcatcatatatggaatcttatactggccaccttgcttcaaccgtccgcacaaatgtcattgtccaacccaagtaacaaattgacacgaccaatcaccttttacttcttgagaaaatttaatttcccatatttgtttttttccattaaaccttagctaccaacgggaatacataaaac

SEQ ID NO: 52650 - DNA, 169 bp, Oryza sativa
ctctcccgattcgtagccgccaccgcgtcgccgggccccggatctcctctcccgcctcgcagccgttgccgccgccgcctcgtcgcccggcgccgcgtcgcccaccgccggatctcctttcccacctaggcacggcgacctcctcccctcccaccggccaccgtgcaga

SEQ ID NO: 52651 - DNA, 1501 bp, Oryza sativa
gccaatttgtttacttatatatcttaggcaatccagttctcactgctacgggtgttaatcctattcctatcaatgaatttacagctacatctcgtcatctcctgctccgtttataaaagctaaccacatgaataatgttaatcacattgctctatttgcaattgagattagtgatggtccttttctttctgcttctacgtatctctactaatactgcaaaatctattaaaatcagatagtcgtctacatcttctcgcacatcttcatccgccacatgaaaaaaccatattgcctaaaagacaaaataaaagagtgtttctgcacgagaatcaacccataaaaaagtggatagataaaattcaaccccatcaaactaattgttagtatttcttttagtcctgttgaaaagcaggagcatagtaccagttggtgtaaaagataagttttgtaaaaattaattaatataaatatatagatatactcttttgagaaggaaacaacggtggtgactactgtgaatcactgaatctactgagccaaatttgctaattaggaaaacaagttaccacgaatttgtttttgttgatttcaaaggaaaaaaattataagtgtatatgtggaacgtttcgatggataactactgtaaactataatttactctgagcatctatacaaaaggaaaagcgtgtgacaaatccatttcgtagcttagctaatccaaccaatttccagttaaccgccgtctgaattcatttatccaagtcccaaacctggtgcaaccgtgcaaagtgtgcatgcagcgaatttggtggtgattcctctcgctccgagcctccgacgttaaccacaacctcccgtgggacagaaagtccgacaaatatacggtgcaaatcatatatattagaaactcaaaaattaccattaaattgaaaattaaatgtacgagaatcgtccatgtcaatataagtctcaataaaatttttactcataagtaaacttacgagtaaaatttttacccgtgataacgtagatgaatcttagacgtttatttttcgatttaatggtaggttttaagttttcaccgtatacatagttttcaccgtatattttcccatttctcaatcctgatcgacgacgtcggtatttgggcctcgtaactcaggttggaacacctactcatggttagagcacctaaccatggttaactcgctgcccctttaaaagcgcacccggactccgcccaatacgccccacacctctccactcctgtcctgtcatcttgtacactatcgcgttgctgatctcctcctcgactgcctcgtacgtgttcatcatctcttttaatttctccgtggtttttgcaccggcatttggatgctgcaagcatcaatggcagaaccgggtcgtaaatcgtaactagcgctgttatgttggcgttgctaattaacgtgactgtttacttttttttttgaaggtttcgcgcgaccggagacggccatgg

SEQ ID NO: 52652 - DNA, 1501 bp, Oryza sativa
tgttaagacccacaagtttatgtgggcctggtaattatctggcggcccatccagaattccagacaaggctagtcaactcggcaagggtttcctcgccgttgccgtcgccgtcgccgtcgccgctgccgcttccgcttgcgtgccctcgtcgccgtcgaatcgctcgcccgtcggtcgggtccggtgacctcgctgcctccgagatcctcctctcctcgcctgcgcgctcttcccgtcggctagaagggctgcttcttccgtcccggctccgtcgccatccccccgccggcggcgacttgggcggcctcggctacttcgcccttgttttccggccaagttgaaggttccggttccgtttccgatcctcaggtaaaagagcacatacttctccaatcatttgaatagctaacagcaatccattgtgcatttgtgcttcatgcggctacggatgtatccatcaattagttgagagataggatcgattcactgtgtgttctactgatgtgtaaatgccgctatgttctgcatcatctgtgctgtgggatttgctatttctgttactttgatgcggccgcggtaatgtataggagtaggaaggatttattggcatttcaccaatcgtccttagttaggtagctgatgcgacgctgaagttggctgcactgcctcaacagtataactgagggcctttccttgaatcattcgtgtgacttctttcacattcctctgttgtttggaggaataccaagggggatgggctcatctgtagagtattttttaaaatatagacagtagcatgtgttctggatcataaactatgcgaaattgcgagccaaaattttgatgcaaggttgctttgttacaaatatgatctgtatttccttgatttaaaattaagttgttgtgtaatttgttcaactacaaagaatgtaaaatcttgggactcggattgttggcctgtatttcacgcataaaactacaaatattgttatgcttttgtttaactcctcaggggttttgcagccagcactcgaattttcatcattgttttaggcatttgatattcttatcagttcatcattctaaaattaatctactcggattctaatagattttgagaaaatggatcctgaagatcttactgactctgaggaagatgaagatgatgacatgatgttttttatcttgcctacactatatcttgtttctactggaagcgaagagccatgtcatacatcgaagttcagtggtgcagagtggatttgtgaagtgcttgaagatgaccgtggtgaaggctatgccaaatttcgaatggagcctcaaattcttcagaaattttcagaccttcttaggtcaaagaatcttttgcggaatacaagaggcgtttctgtggaagagcaaattggcatgtttatttatatgctctctcgaaatgccagctttcagaaaatgagtgatagatttgagcacagtagggagactatccatagacatatcaagg

SEQ ID NO: 52653 - DNA, 170 bp, Oryza sativa
ttcccattttcatttgtcattcccttgttagttttcttaacaaatgcattggccagtggccatttccaattcagattgctcgttaggaagcaaaaggcaaagcctattattatacgagcgttctcaaaaaaaaagagagagagagagagagaggccggggagtcacctga

SEQ ID NO: 52654 - DNA, 1501 bp, Oryza sativa
gagagagagacatgcacatgtgcaagcacacggcggatggatggatggatgcgcacacttgcgtggctgcatccgggaggaggaggaggctggaggcgccactcgtcttcctgaccagttcttgggttgagattgaggaggaagagtagaggagaggggtgggtctcactgttcctctttccccggtcatggctgatgctgccctttagctttgcctttgttcgtgtgcgccttgttgcgtaccctgttttgttgccttccccgtgttagctataaaatctcgatgcctcctcctcccacatgcctcctctccctcatggctgtcacattgtggccgcgcttgctgtgtgctcttcgtttttaattctccccctctttcttttcttttcttttttaaatttctctagatcatcacatctcaccgtatatactttctattacgcatcctctcgtgtcatcgcgatctcaggctccggcacaaaaactgtgagatcttggcacattggtagtaaaagattccccacacaagcacgcacgcacggagccagagcttgagagagagcaagtggccgttcttggtctctccattgcctcccacaccttgcattataaaagatgctcggtgtctcctgctccaatgcgtgataaagaaaaaaatatatactgacccttgtgttttgccgttgttgttgctgcagagatttgtagtagagagatcacctgcttggggaacagtgttggtggagaggaatgtggactcgttgtttatgagagagcggtgctgcattggacacaagatcttgcgtgattcttggttaattaaaacaaagttgggcgaggtggaagaagggaattatactaatcgcctctcagatcagcaaggacaggcagcaattaacaggtagcagcaggaggaggtggggttgtgtcagctttgtgctttgtgggtgttgtccctcctggctccttgcctccctctctctctctctctctctcttcatataggagtagtttacttccattgaggtgcttgtgctcctcaccattcttgcctcattgcctacgatagcagcagcatcagcccgcataagtaggttcaacttggagtgtgcttgaagcagcagtttgagtgctgtgctgctgttgctgttactggcttgctgctagccgcatcagggcctgctactatctcgtagtctgttcttgttttccgttgtacgaacgatctcccgggcacgttgcaatattcggtcgccgtctcagccgcagccaccagcagggtgcagcaagttgttctgctccttgtacttgtttgctcctgggtactagttgctgttcatcttgtgtagataaatatgggctagtagtggagttgttgcattggttgcagcgttgttgttgtgttagtggtggtggtggtggtttgtgtgtttgggcgtcgatcaggagagataagatttaagatcagcgcgtgtgcgtctgttctttgcctgtttcaaga

SEQ ID NO: 52655 - DNA, 1501 bp, Oryza sativa; identical to SEQ ID NO: 52628

SEQ ID NO: 52656 - DNA, 1130 bp, Oryza sativa
ttatatgaccacatttcacggtttaagaatttcacagacgaaggtccaattcgtgtgcaataattagggaaaaatcgcttgtttttttttgacaattcctaatatcacttttgctttcatttgaatggtctcaccaaaactcctgcaagctgaaatatagacaatagatatggttgcaaatggttccttccatgctaacatctccattcttgaaagctagaattttctcaaataaattttctcaatttttttctcaagctagtttagtttcttgaagctgaagctcaattttgatactgcaatataaagcgtgcgggatgatgtcgagcaccacaacgtttacctggtgtcgttcatttctttgaaaaacagcccccttcttcattactcttttatgcggttatgcctgaataatcctaatcaaagagaaaatgtcaggaagaagccatggtagtttgccactcgtgcacgatccggcactatgttgaaaaggttatcactcgtttaatcaacattatcgctgacctttcgacaacgaattggcagagcaaatattgcactaatccatggcgtcgccatgaaaaggaaatcacccctatgtcaaacggctgtcgtaccagagcagcagtgctgtaccagtgtacggtgggtgaacaagattctcgtttacttttttctcgggagagaggttcaaaagtcatagttctgactaacaacatttcttggaaatcttttaagtgattcccttaatgctgacacgatcaatttctctgggatatttgtatgccgtgcagttctgatcttctcagtttaacgaagggaacgaacctccttatcgtaagttgtacttgtattatcgtaaaaaaatatgtgtattccttttgtgttgaatgtgtgagaataatttttttgaaggtacaaacaaatgaataattattataaagttagaaaatgaatatagaacagtattgtaagaaattcatatgtaattagttttttttcctataaaaaatcatactgtataacagttcaagaagcatactcattaatccattcatcaaaatggaacaagcagggcagaatggaggtgtctgatggtatagtaacagaggagcaagcactggacatat

SEQ ID NO: 52657 - DNA, 448 bp, Oryza sativa
ttatatgaccacatttcacggtttaagaatttcacagacgaaggtccaattcgtgtgcaataattagggaaaaatcgcttgtttttttttgacaattcctaatatcacttttgctttcatttgaatggtctcaccaaaactcctgcaagctgaaatatagacaatagatatggttgcaaatggttccttccatgctaacatctccattcttgaaagctagaattttctcaaataaattttctcaatttttttctcaagctagtttagtttcttgaagctgaagctcaattttgatactgcaatataaagcgtgcgggatgatgtcgagcaccacaacgtttacctggtgtcgttcatttctttgaaaaacagcccccttcttcattactcttttatgcggttatgcctgaataatcctaatcaaagagaaaatgtcaggaagaagcca

SEQ ID NO: 52658 - DNA, 195 bp, Oryza sativa
ccctgaatcgaaaaattgaagtcaccgatgagaccatttgcactgtaggtaaccaaattttttgtcttttgatattttcagctggtttgttttctcttgtttgaatcccttatatttttctccattttcctcttaaccatttttccatttccctctaaccttttatccttttcttttcgggaataaatcgtgcaa

SEQ ID NO: 52659 - DNA, 1501 bp, Oryza sativa
ggcgtccaacatgatccatgcgattggataccctgaagcaccactccactttgtgttctacccttatctgcacctcgttcttaggctgatccatacataccccttgcccttctcccccttcttccttcctctcttcccctgggtttggcaaacgtactctagctaagggcatgttctttttttattatcattgtcagattatcgcgttcatgcatgcttttcaagtttctaaacggtatgattaatgcaaaactttcttcattagtatgtcttattagtgaactcttttaaatcaacttatcatatttctaatatttaattcgttcgcttgtgtcctcgaataattatcataaatttagtttcatccattactatgatggcaatgacttagggaccgtttgaaagtgctaatgggccctaagtcatattgcttatcctacaagctataattattctgcaatttgcctcatgctggtccttgtcaacaatgcaaacccttctctctctctctctctctctctcacacacacacacacacacaccccgatcgaggtacatctcgttgggtgtccgcatttgagttattagctcgagaggacgaggagatcatctgcaagggaggagatgccaccattggagtggggatctagctagatggttaattggggactctgcttgatccatttggtgctaattagagcaaggctaatattatagcctattgccggctacacttcattctatagctaatgctgaagccaactactcatacaataggttgcttgttggctagctacatctcataaataaaataattaattataactagcacatgtcaatgtgtatgatcaagagtgaagtggatcattattgtagccaattttgttttgacattaacatttgtatgctacagaagtaatcacaaaacaccacatagttcacacacttttctaaggaccagtagagctcacgatggcctaaggagctagtgctacctccctcttcgtccggtgagacatggtgttggtggtggggaactatggttttaggcaggaatttctcacgggggcgggagagattattcaaggtggaagaggagcagggctgtggtcgaggtggccagcggaagaaggagatcggaagcggcgaaatattgcgatggggaattttggagcgactggattttttttgtcatatatataggtagtttcgcgagtgcgggagggagaggtggagaagcgcaggagctgcgtcagagagaggggaggagaagcacaggagccggagggggacattgcactgtcggaagagaaatcgtcacggtggtctcgcgcgttgagaatcaatggggcggaggcgatcgagaggaaggggatcgggaggggagggcgatgcagatggggagggcaatgtggaggggtagtatgatccactgtggttgcacaggccccacaatgtgtgtttttaatcgccgggagcagctgcaagcgagcgataccaa

SEQ ID NO: 52660 - DNA, 1501 bp, Oryza sativa
tccctatatctggtatcgaggttcatgacagtattcaaactcgacgtgtggacgagatatctaaaatgaacttattccatatgtcgcggacctcccgttcggccgtttggtctgggcctacgaccgtgcggagggaggcacaccaccgcgggggaacgaccggctcgttgaacgcacgaggcacgacacggaagaggagtgggtgggcgcgtcgcgtgggcgtggtggcctcgttgtttctttccgcctccccgcgccccgcggagaagacgcggtgcgcgttcctctcgagcgcggtcccatttgcgtcggacggcgacgttgaccgctggacctggattccggctaaaatactccgcgaggataaatgggaatcggtgctctaaccacattttcctgtgtccttgtctctctgattatttacagaataagtaagatgctcgtatggtttagctttgctttggagtttccaatttatgcattcccgggagtcctgtcctgatctcctggaccctctctagagaaatgcgaagtcattttctatggtagttgcacgtttacgacgacgcggattcgaggacctcatcaggcgaggattgtaaaatcgtgccatcgtgggaccatgttctagttacttgaggccccgtttagagggttcaccttttcctctgtttcggtaaaaatcaaaagttgtttgccacgagaaatagcgttcagccttcaacttatgtgttctctctctctctgaagactttatgtgttctcttcaataatattcaatgttaggcgcgtccgcacatgaggctagagagccggtaaggaatgaattttccgttggtttttccaatttgcacacttctacgaaggcaacacctcgcgatgacacaatgatgacaatggcacaaatattgcctacaagagatgctcaagtaatgctcaagtcactggaaagttgaaggaaacgtttggggctttctcatccggccgtacaagagaccaaaaagaccgaacgtctctcctacgcatgtacgtacgtgcagcagagctgcatggaatgtcttgaaaagttgccccccaagactcggttcgagttttgacccctgaattgccggcgcattgccagtagcgaacgaaataggagagaggagctgcccctgcatgcgcgcgatcatgcatgcacgcatcccctcccgctgctgctccctcctcctcctcctcgcatccgtcaggtcacttcctaaaaaaacacaggaaactacgcaaaaactcccatgattccgaccagccgaacactttccccacaaaaaaaattgcgctgaagttgccgtcagagagtcgccttcacgaacgccattgtgcgagttgacgcgtttcttcgcggaagaaaccaatgcccgcgttggctatatagaaagggtttgggttggcggtggggaggagatcggaggagggggtcgttggattgggacccaattgaaagggaaaggttgaagaggcgcaa

SEQ ID NO: 52661 - DNA, 1501 bp, Oryza sativa
tctttcaccgttagttggtgagttaattaccccctactcccttcatccgtccccactcatggaattcagtgttgtattaaagggagttcagtgttaggttaaaggtgattgaagttcatagcatcctcttttttttttagtttgaactatggatcacatgacgtatttaacttgtgacatgtgcgcaacgactttgctaaacatctctgatatttgatgttttcctgggcgtaggatcgtgtgtcaagattagtgcaggaaattacagttctatataactaaaattacattcgtaaattcagttgatatgacatgtaaatgtattgtaattggtaaaaatgttgtgcaagtaaatatgtatttgttattttctttaaaatataaaattacagtgctatataactaaaattacatttgcaaattcagttgatatgaaatgtaagtgcgttgtaattttgataaaaatattgtgtaagtaaatatgtattgttgtgttcttttttagttatttggatgtaaatctaagggtagaaaaaacctgggtgatttttttttttagaaatcacccgacaaatggatagacagttccgtgtcgtaaacgcctttgacccaaacagaaaagtgtagtaaacataacgaggcatccccccacgattcatgattttttttatttttacatttttattaaaatatttacaaaaacatttttttcaaaatttacaattctagtcgcctctcgccctctggaagggcattttttaaaaatcgtccttccagagggctttaggggacctaaatacaaattttttatttgtgttcaaactctttccaccggttttaattgcttaaaaactaataattcttattcgacgctccaaatgattttaaatggaaaagtgataagctacaaagttgtagatatcatccagatctacaacttttatataaagtttatctccatccaatgtcgtttgaaatgtagatatgagattttttaaaaaataggttttgcattttgtaacgaatatttggatatctaaaagatcttaaatgaaaaagttgttaactacaaacttgtatatctcctcgagctctaaaatttttatataaagttttatttcatttgactttatataatataattttaaattgtaaaatcatagagttgacaagttatactggaaaatttacatttaggtcccttaataccctctgtgagggtgatttttcccagcgggcgagaggcatttgtaaattttcgaaacaaaagattattttttaaaatattttaataaaaaaatatataaataaaaaaaattccacgattcatctcattagcccactaagcaaactagtgggcccaatagcccaattccgtggccccagaaccagcgcctccgagcccagtgggcccatcttgtcagtgactgacaccaaggacaccgcgacgcggccccctccgcctcgcaaagcaattttgccattctcccgtttcaaaccc

SEQ ID NO: 52662 - DNA, 1501 bp, Oryza sativa
agatatacggggtcccttaactatacaaaaccggtaacccgaggtcctttggtggttttgaccccggttttagtctacgtgacggctgagtcagcggaggacccacaaatcagttctccacgtcaccctctctctttccctttcttttttttttctcttctttttcctctcctctttgcggggctgagcggcggccggcttgcgagcgcgtggcggccggcgaggcggcttgcgagcggaggcgcggaggaggaggcgggaaaggaggagggctctgcgccggcgtcctgctcggcgtcaccatcatcgtctacctccaggagaaggtcggctggggcgctgccgccgtcgtggccgtctccctcgccgtcttcctcgccggctggcgccactaccggtacagggtccccgagggcagcccactcacgccgctcgtccgcgtcacctcgcacggcggccgcgccgccggctggttcggcaaggacctgaacaacagcaggctggacctcttctactggcttctcgcatgcatcggcatcgccaacctcgtcttctacgtggtcgtcgccaccagatactcgtacaagaccgtcatggccggcggcaaggtcgtcgacgacaaggccggcgacattgagtgcgccgccgccgcagctgctgcctactgatcaatcaagcagctgatcgattagctagctagctagaaaatcatggtaagaaagaaaatggcatcatcatgtaggagtatatatggtatgcttcgtggtacgtgacaaccaaaaaaactgtaatgattaagtcgttcgtccatgtatatgcttaatctgcttgtgattgccatctgatcgtgtgctctactgctagctgatgttgccaagtcctaaactgttaacttatgcgtgtcagcgtgtgcttagtgcaagaggcggcttgcaagcagaggcgcggaggagggcggcgcctgcatcacactggtagcggccatccacgtgcgtgacccgtcgcggcgctacgaggcgttgggcgcgccgatggtcgccgtcgtgcagtcggcgaggctgctcggcgcagggggaacagcgacgggaggttcaaggtaaggagcgcagaccgccggaggaggcctcgggcttgaaggcgaagagcgcatggaggccgtgcttcgcttggatggctccgacctggaggcggtcgtggcgagggcccaccagggccgaccgaaagacggccaccgggctagcgccttgccggtagagctcgactccggcgaagccgaggataaggccgggccggcttagactggagcgtcggcctccatggaacggccgccgccacgtagaagaggaggaggaggacgccggccaccgcgccgcggcgtgatctggcggggacgagagggacgacgacgccaacgaagaggagaggagacgagggggacgacaacggcgccgcccgcacgccgcctccccactgccgccgccgctggcggccgctgtcgcgg

SEQ ID NO: 52663 - DNA, 1501 bp, Oryza sativa
gctttatctgccattctatttatgctgcattctatgttcagggcatgcgcaaaatattattgaaatgatcatttacttgaagataattggatttatttcattaattgctccgtaagccttgattcataggtagtattatgctttttttactactaagtctgtagaatcccatctctcctgcaatagctcataagaaagtgacatgttgtgcgatgcagaactggttctgaatgcatagtccttagtgcattttgagctaccctttgtcaggactgtagtctctgtaaatagtgggagaattcattggctaaaaagatgacaaaagctagctgcttatcagtattaagtgtcgcaccatttcttttatcatgcgagtagtgcaagtgcctgaagggttatcccatttagctattccaaatggcacatacgaaatatgattatttgttcatttgatccgtgatacttaggtagctatgatctgtctctgctcggtttgtttttctgttcagacatgcagaatacaactgctgtctgtattcagtttatatcttgcaactcataattctatgtttctacctgcaggtttctgcgtattaccagctctgtacttaatttactagtgagaagcaaaatgaagtgcaatgcttgctggcgggagttggaagggcaagctgtatcaacaacctgcggtcatcttttatgtatgcctgcaatcttccttactagttttgcttaaccagtttctcattgtaaactaacattgtctgctgctattgcagtatacataactgatccttgctgatgattatccgttgagcaggtacagaggatgctaagaaaatactgagcaatgatgctgcatgcccgatttgtgatcaagtgctttcaaaaaggtctgttgtttactcttgaagttgtattcattatctcatactacattttctcttctttcctgtaagctatttttgaatgtacatcatgatttgacaattagggatgccaaaagtacctcaaacgcatacatatttatcatctcgatggttattgccatgtcatttcatccgaatgggtgcttaacacatggagtttactttctagcatgctttgaagcttttatacttctttgatgtgttcgagtgaaaatggactccagtggtttactattttgagacagtctaaacattataattttttttctcagccatatgagacctgttgatacaaatccaaatgatgattggacaaatgtaagttcgcttacgattcattgtagataaaagcaatccttctttttctaacagccagtctgctcattggtacagatgtcaatggctggagtttctccacagatacgtatccttattattttctcattgtccgtaagattcttgtgctacttttgttgaaaatcatcactaactgctatatggaatctatggcgtagctagcctcttgtcctgttttattgtcatagtaatgcaaaaatctgaaagatcaaaat

SEQ ID NO: 52664 - DNA, 465 bp, Oryza sativa
acacttggcaagttgatgaaggtagttggacttgggtcttctaatgtggtgcaaaggagtggtgtcaaaaccaaaagtcttgtagagccgaacgggattctcacgagatcctacagggaaatcatgagatgcccttccagccccagaactgcgaccaccacctctcccccgtcctcttgtattaggtgcatcacttccttgactactgtcaacatccctaatctgaacagttaggttgcttgattgccttgtaaacctgggagaagtacgagtgccactgccactgccgccctcaacaactttctctttacccaaacgaccacgagggaaccgaataggaggactctcatcaccggacacatcttgagaggctttctgtcttttctcacgagtcatagtgcttactgcaacaggaatcaacaatttggagtgcagtagttaggcaaaaattaagagaagtaagaa

SEQ ID NO: 52665 - DNA, 1501 bp, Oryza sativa
ccactcttccagacggccccctctcgctctccctccatgacccatccctccctggctcggctccctcgcgccgctccccatttccaaaccctaggcggcggcgcggcgaggcggcaactggcggcgagaactggaccgcgctaccacggagggggaggctattgccgcggcgggcagcgggtggcgcccgccactccgccaagctcaggcagtcaggccggttgggtggccggcagccgcgaggggtagaagcggccaacggctcaacgcttagacgggaatacccaactttaaaatcctggctccgccactggtataccccgctagaatattaattattgatggaaggagaccaaacatatggcttcgattttctctctgattgtttttagttttggtttgttggacgtggttataacgtggctctaatttgaatatatctggtacggctctgttcatgtttcttctctctaactattctccatctctttcaacaaattaatcttttcttttttttctttgcaaggaacaaaataaaaaatatatatatttcggtttggggatgcaatgcgaatttgctgcaagttttttttcaaaaaataaaacttggctccgagcctacatatataaaattgtataaataatttaaaattagaaactcagcgactacaatgtgttttctaaggacatatagtctgaataactatatgaagtatacaatatctgacagcttagtttctgaagaaaatgaaaatatccccatatattttgttttcctttattcttgttttttaaaaggaatcggcacgaggttatgctatttcattaaatatagaaggagaaaaatacaacccctaggcgtaagaatgaaaaaaatctatacaaatctatccgaggttggaaggagctcctggagctttttttgctcctgctagggtccatgttcttgcttcctcctttattttcgccacgaggccaggtgtcgctatcttcttgtgctcgaagacttgccggttcctctctgtcgagatttctcagacaaccaacaagattaagctacgcatgcctttcttgggtacctcctttttgttagcaagtatctcccaacaggcttggacatcgaggcaaggctcccattggtttggatccaactgttgataggccacccaagaggctaggagtctccagactcttcctttattcttgttaagccctctatgaatgccttttgaagagaaaaaaaattgaagcttttggtccattaagagtctatttggttgaagggatgaaaatagatgaaagataatcatcccatttttacatgtttttgtttcatgggcgagagtggatgggatgggatggacactgaagagaatatatattctcttaagatgttggatgagcccccatctaaattgattgatgagaccatccacttttgtcaacgcaaatgattagacatagttagttttttcgttaattaataattttcatttcaaga

SEQ ID NO: 52666 - DNA, 1501 bp, Oryza sativa
ggtgcaagctagatggactaaaattaaatacaaataagtaattttcatggcattactgttcccgacattgctttcctatacgtccaggcaaagcttgagcaatggttaaccatttcttcggtccaagtttgtttaccatctgaacaatgatctcatcttcctgaaaaggggaacatgtcattgtgagtataagatgactaaccaatattatataagaaatgaaaataaatggactagcatgcttacttctttggaccatggccctttgaccaattcagggtgtagaaccttttaattgccacctgtgcaagcattgtacatcggttctattcgcaagctggaaaattagaaggtcctctgtcaaagcttggatttttaacaatatacaggaacctcatcaacagggtaggaaaaagaatgccagagaagcatgactagagtgtaagctaatgaaacagcacaatgctttactgtacatgagttgtgatagcatcaaagaggggaaaaaaatgcttgcgtggcttaagatatcctactgcactgaagtactaaacaattgtagcgcaaggtgggcttgagaacaatatggtaaaaatgtattatatatcaagtataatattgtgaaatattactcctgttacaacctgacatgtattgacatataactgtatgtaatcacaaagctaatgtgtaaaaattaaaaaaaaaatccaagggagtccaacatatgcatggtaggctatataaaatgcagtgatatagataccaaaggtcacacttttgaaggtgctccccctatgttatttcatctctcaaaaaaaatcagtaaaatgatatatgaattggactttagaaggctattttgtttatattttccagcatacaaaaaacaaccgcaacaaagttgaagaaaaacaaaaaatatgacagctaaaagatagtagaaatactatgataaagagtaaggacaaagtatgccaaatagaaccaatgcactaatagaaccaatgcatcccattgtatgtctgaacagctctgaaacgcacctaactttttcccaattcttcccattgcatgtctgaatagctctggacaatatggcagcctccattgatcagctaaaagctaaaacaaatggtatggtttccactctccatttgtttctacgacacgacctacattttagctgaaatggagaccagctgcagaccacgttcaatgacttcaatcagctaatcaatgaagacaatcaattatataattgtgagcattgttcaatctatccatgtcatcctgattttgccaaataacaagcacaatcagatatccagacaaaagatcaaaacttttgccaaatcagaagcacaatcagagtccaaagatcaaacttttgccagatcacaagcataatcagagaccaaagatcaaacttttcccaaatcacaagcacaatcatatatccagtagataggaaatgcatcacgaaggttcatcgcaaata

SEQ ID NO: 52667 - DNA, 426 bp, Oryza sativa
tttttagtgtgaattgtgaaaccatgctcatatgtatcgatgttgaatagacattgaggtttatgaaaataaaatattactccctccgttttatattataagactttctagcattgtccacatttatatagatgttaatgaatttacacacacatatatgtcttgttttggttgatggtccactggagtcaaaccccggtcgcccagactgtcctttcccttttgaaagaatgggatttcatatccggggactctttatctttattttttaataaagtcttcagtcttaaaaaaagagagaaatgtgtgctatgcggttggtctactaatattgatacatgcaattttacattatgtactgtacattaactttttttactgcatgaagtactcatattggacagtaggggaggctgagcaaggaga

SEQ ID NO: 52668 - DNA, 1501 bp, Oryza sativa
gttaaatatttaaggtcaaagagagtatttgcttgcatatgtactctatccgtctcaaaaaaaaagtctaatcctaattaataacctagacacgtattttcagattcgtagctagagtttgtatttttttatgacggagtagtagatggttgatttgaaaattttggattatattcggcctgaaacgctgggttgaattcttaaatttctggcatgattgatgatcgatcggactgtttactttgagtagcactgcttcgttgcatccaggggtgggaattcggtccaatcgaaaatttcgatctcggtctttggtcttttcggtctttgaaaagtgaagaccgaatttcagcgaaaaatgtcaggatcaacaaattcggtctcggtctcggtcctgaccgaaattcaacaacgttttcatatatgcaaagaaataatggaatttttcaacacaaaaatcacaaaaaaaattcgtaagcactcatgagtaaagactcctattaggttgcatgccaagaagaagtagggatgtgaaaattagagtttaatcctattaaacatactggattataggttgcatttagacatttttgataattcggtctattcggttacccgaggagactaaccgaattgaccgaacaaaattcggtctttcactacctaagaccgaattgatgaccgaatttctcggtatcggttttttcggttttggtctcgatattttcagttcggtctttcggttcggtatttttgtgcccacccctacttgcatcggcttgttctccggccgatctgtttcgtgagtcgtgtagaaggtacagaaaaacaacgtgaatatattttttttcgagggagaaaattttagtgcggtacagttctaaaactagttgtccaatgcaccaggagcaacgtgaatttccgccggctgggccttgagagagctggggaaagagcaaacagaatgtttgagagataaaaagattactctctctctccctaaatataaagaattttggttagatttaatacatgttagattaatacatgttagatatgacacatgtactagaatgtgtcacatccaaccaaaatcccttatatttacggacggtagtactttctccgtttcacaaggtaagttattctagcattttccaatctaaatagatatatatgtctaaattcattaacatcaatatgaatatgggaaatgctagaatgacttacattgtgaaacggagggagtatatccaaattcgttgtattatgatatgtcatatccaatcaaaatcttatatttagggatggagagagtaggtggttaagattaggggtgggcagaataagaccgagaccgagaaattcagttagtaattcggtctcagcctgtcaaagaccgaaatttgttcgggtaattcggttattgggatcagttaaccgaattaaccgagaaaccgaattgtgtcccaataggtctaggaggcccaataagcccaat

SEQ ID NO: 52669 - DNA, 1501 bp, Oryza sativa
ttagtttttatttttttccaaatgattctatttagttttttatgaatgaatttttcacatgagaactgtgtttctcaataagttggcacataaatatgaaaggggcattctagttttagaaaaatataatccaaaaatatggatttggtaagacatttatagacagaaaacctgtaattagagggcttgaacgtgtataaaaatcacgatcttccgtcgtctcttttaccacaatctcgtccataccttaccaccaactatccccatactcgacggtatagcctgtcaagagtactcctaaatttatataccaaaagtttatgctctaaaaatttatatgcccaatttaaatttgaattctgattcggattcaaatgttatatattcagaatggagctatatcagaagattctgcatatatattttttatatgggtaaaatttatacgaataatgtatatttttagaaagaattaattttcccttatttgtagttttttttaaaaaaatatattcccaactttattttcaaaatcaatctacccacatagccggggcccgggggacacggagatgcgatgcgatcacccgcgcgttagccccacccaccctctcatgctcaatcgatcaacaactcgccatgatattaatacgagatatttaactatttgtcacttttagatgtggtaattaacgatttgccattggacccacatgtcatagatacatgtagacccacatgtcattgagataggggtggcaaatagttaaatgccaaatagttcaatgaccccatggaatacggactccgactccgactccgacacgaggaagaagcccatatggcgcacctatatatttgaatttctgtcgtcccacctcctccaacctctcgcccctgcatccacctgcgcgcaggtgctcgatcaacaactcgcgccgcgccatggatccaggcatccagctccgccgtccttgcgtgacctcaacgccgatccccccgccgaagacgacgaccacatcgtccatctccacggcgagcctctgcctcagccaccctacttcccagaaccgaagccgccgccgacctcgacggtggtcgaggccgttgccgttgccgtcgtcgtcgccgccgccgccgcctcgccggccacatgccactacatctggagattaattcaagcaatcaagcccctgctcacaatagggcaacgcaacaataggcaaggtaagacctctacctccactgtgctctcaagtctcaaattctttaagattaatttgatttgctgtaagtaaacttttatatttgaaagatatgttcaggttacttcattacttggctgattgcccgattcttcgtattatattggttaaatggttagggtttggtcatttggtgatttggagtaaaattaaagttatatattataatttctagtgctatgaatgataggtgaactttattatggagaattaccttaaaagaaaagtgcctgata

SEQ ID NO: 52670 - DNA, 1501 bp, Oryza sativa
ccagttaataacagcaagagattcagcactcaataacaagacagattaatctcccatcatctttcaattagttctttttttctcttgcatctataatgaactacagcatttggttcatggtgaaatatcaacagatcacttaatggaagaataatgatgaggtcagcagctccaagagaatatttaggggaaaatagcatcagaagtgtaacatttcattttcaaagtattagcatgtcggtgagcggcataccttcggaagaagtccttctgcagacatcagctcatataacttgcgcatgattgtttcttcttccacctgtacagaccaacattttcaaagtattactatctaaaaagttacttccaagacatagtgacgcctcatactccaatactctccatataaagctcacctgaactttatgcaactcgtgggacattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgc

SEQ ID NO: 52671 - DNA, 406 bp, Oryza sativa
tggaatagaaatgctaattgagaactttgcatgcaccacatagtacagcaactactcaagccaagttctatttactagtgaagccatttccaacttatatcaatccatttattagaaatatgcatgtacattgtgtgtttactgagtttttacttgtagaatgtaccatcctagtataattattttaaataaaactcccttagttgatctctgcaaattaggtggctagctgtccttgcagtgagttgtcgtagtacaaatttgaaacagtcttcgggcttcagattttccatctacattaattatgaaaatgtcacctacatacatctcaattctaatataagttaacatttgcaagtgggagccaattaaactgtacttcagcacttatcttctttttatttat

SEQ ID NO: 52672 - DNA, 1501 bp, Oryza sativa
ccttttattataaagatgattgagacagtcaccggggtattctacatcaaagatgggcaccataattcttttcgccctcgtgctccaccttccttttctccagtggtccctcgatctgttccttctacttcagctggtccttctactagtgccccaccaagttcctcgagttcttctcccatcaagaaggcacttcaggcaatttttctgtatgtgtgctaagactgccaagaaagtgaaaaagatagaaaggcgtcagaaggaagatagaagagaggctgggaaagaagtgttagatgattctgaggatgaggtctatgttgatccatttgaagcttatgaggcagccagcaacgttgccgttgaaggtccatccaccttcttcaatgaagaatcttcccattctgttgatgatgatgatgatgatgatgatggtgatgagggtgacaccgaggcagctgctgaggatgctcccactgatgttgatgagggtgacaccgctgctcagtccgatgagtctcatctctccggcgatacagagattgttccctctgatggagatgagtgatcatcttcttctcttcatagtttctcgcctttttggtgccttgatgccaaagggggagaaattgtgaattgaagggggtcatttaaatccttatcctttttgctgccttgactgttgtctggtcatttgaccggaagttccgggtcctatgatctggaggttccggccaggcagatttcctctctattatctctctctatatggacatgtaatcgtattctattttggttggatgtaatgtctgttagatgctttattatcctttatgtcagtaagttagaccatatggatgttgcattttgatgtgatgttgtgttcttttcatcttttttgagtgattgccatgtcatctagtctttctttttgcatcactcatcattcaagcactttcatctacatctcttatttgatgagggcagtgtgaagtttcttttgagctttccttcatcttatgcataatgttttcatttcaagttctttatatgcatatctttagggggagcttcacacttctctcatcattcaaaatttaaattctattatctttttgtgtgctttaaccatgttgtcatcaatcaccaaaaagggggagattgaagatgcacttaaaccccctagtgggttttggtgattaatgacaaggtggttaaagaggactaacatgtttatcaagtttattcataggagtttagtcccaaagcgagttgtgatggctaagaatgcaaggagaccccccaatttgaatgttcctaagtgcaaaaaacaccgaaggtgattagactaggtttttcactttcgaaattgagtttagaaaaaaaccgtactattaagaggggtttcaagtgtggttctagggtatacaaagtgagtcaaaataatatcggtgagtcaaaatatttttggaatcatttttgaaaaatgattttctcctcg

SEQ ID NO: 52673 - DNA, 1501 bp, Oryza sativa
tgatttgattggttgccgagacatccatgttagcgaccccgacctgagctcaaggcaaccacaaatccggcgccgagaaccatcctgataccgtatctccggttgccagatcgagctgcttcagcacatcaacctcacggtcatgagaatcacaggtccagctcatagcccaactgaaacgatcagccacaggccttggagaccagcatatcatccacatgatttccgatccaattcgcacgcaaggtacgccaaaactcttccgaaattcgcctaatctgttactgttaagtatgaattctgaaaagtttctgatcacggtaaaaaccggcatgtaaaatgaaaatggcccaagtgtgaaaatgtgcagattttgggcgacggtcttcttcgtcaagccgaaaagtcgagaactggacacacgttttcgtttgaaatacatggctaccgaccctggaagctgacgaaacggtgaggataattaagtacgaaaacgtgatcatggtgtgaatttgtacaggaaccttgttaggtagacatcagatgagggaagatatttcaggcacaaaatgtcaagagaggtgatgaagactgatgggctgatgatggtaggaaaattcggacgataaagaaattcagatgattgagaaggtacaggagtcagttccatactcccatataacagaaagattctctgcaccacctacacctagcaaacttcgattgttgtcttcgttcagattgtagccaacctaactaaaaaagattcacacataatttgttcgtatcctactgtaccatatgtgataaacatatagtaataattttgaaggtttggcaactttgccaagaactgtcatgcaactgcaaaagtcaccaattaagatttattcttctcaaaaggtcatcagtccaggtatcctgacttgatccaccttttattatggttgttgcaggcttgtgctccttgttcaaatggaagcagggaaatttccatcaggagcgtgatattccacacgacttctcccgaagaacacaccagctcggtgcctcggtgagtggaaactgggttccattgtgaaataaaactttctgataccaatcaggttactgccgccggcgcaccctgtttccattgagctgttgtattccagaacatcatctttactcaccggtagtgttttctggccttcagtggattgatggtccccctcctcttcagttgcatgatcaactttgtcctttcaatcttctcctcaacaaagtagagattgtcctaaagtagcacagtttctacaccactcattctctcccaacaatttccatgctggaagagttcagattgggggggtctgtgttgatagtgcaattttttttgttcatttcctatgctagaatagctagagttactttttaagatatactacatacttaattaattttaagctggcttttgtagagtaaatgtgaaagtctatgttgtattgcaatcccattggtg

SEQ ID NO: 52674 - DNA, 1501 bp, Oryza sativa
tatggtaatctgcctctcgcattttggatagttttgatggatatcattgttggtggtatggcatgaggcccttcgaccaaaatctgctgaaagctatacgaagagtggggattcaagcccgagacgtcaaagttagtcggggcgaagtccccccatgacgaagactatggaacaaggacggcgagaggcgagggatcgcacgggtactctgccaagccagaggcctcttgggcgaaggatgcagggcgaagagtatatgccgaagggagacgacttcgccaaagcaagctcgcccccgcgagggccgaagaagcctttcaggcccatcaagtctaggggctattgagctgacgatcgcccgacggcccatcaggggcctgtgaacctcaattaccctatgtacccatgtaaatgtccctttcataagggtaaccatgtaaattcccctgtataaccaaaactctagtagtaagaacctgtaataggagctataaatagtctcatagggccatgtaatggggggatcccgaagaaaaattctctaattaatacactttacttctgtcgcgactgagaaaaatgcattttcccgaacgctagtgtattaatccccgtcccaggaaaagtcggggtacaccacacaaacatgatacaaaagacacatctttattatatcgataatatttacattattacaaaggcacttaaggcctgacaatcaaaaataaacagcagcggactagcgggactatggctccatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtgcaaggggtaataatataggggttaagttttgcagtaaacagcatttaaaagtcacttagttgcccaaagccattttataaagatgatcctagagctacacagtgatattaatcaaggccgtaaacccccacgaacatgccttaatccaaggcctacgatgatttagaccgaactggcaacccgaccctgggtcccagctcgtcccaagccaacccaggccaaccattccacattttagtagttaagcaggttttaagaattaaaacactaacttgggtacattgctaggcttgcccataaccgagggcgcggctattcgaatagattatactctgatcagaggtgtacatctttacccacaagacacatcttcctcacgtgtaaccacgtgccacataccaccacggtatacagacggaagatgtgacatagtttccaacccatcctagccatagacaagagtaccgacccaaccccgcctacggccggaacctccgggacaggcaggcaggattgagcccctagcagcaggacaccagccctgtgccatgacatctcgactaccgggccgcagcttgtgta

SEQ ID NO: 52675 - DNA, 963 bp, Oryza sativa
aattttaaaaaaatttgaataagacgagtgatcaaacgttacaagcaaaaacttaaaatcccttatattatgggacggagggagtaagtcacaaataaaataaataataattccaaaaatttttgaataagacgaatgatcaaatagtgcaagtaaaaaaaatcaaaatctcttatattatacttgtcagggttatgaataccacatacctaatagtagtcgactaaatctcggcaggacccaccacataccatgtcttatacggaaacaaccttcggatataggaggagttccgcataaggaagaatgactagagttctacatggaaatgacaaggactactcggattgtatccatactggtttccctagttctacttggacaaagggacatctataggtataaatacaaggccccctagaagaagaggggacacaaccaacagacacggacaacatagacgccacaaagccacaagccaatacaagcctacataggccaagacaagctgctagatatcgacatcagagataagcctaggaaaacccgatatggtacctacgggaaccaaagagaggaatctagcgctatctctgatctcgctggatgcggatttgaggaggaaggctaccctgttgtcgactacgagtcagatcttcaggccgccacgtcgacaacagttagataggctaccccaaatattgtactggtgtgattatgatgaataagatcaacgaccggcttcggccaacaggatgtagggttattacctgataattcaggggcccgaacctgtataaaaatcctcgtctctatctcttttacctcagtctcacgtatatcttagtaccaacaatcctcatactatgcaaataccagaatcgcgacatcaaacgtcgatagtggcgcgccaggtagggtgattttggtgcttcaggatttcgacgagatgggttcaagaga

SEQ ID NO: 52676 - DNA, 645 bp, Oryza sativa
ttttaattgttggaggctttcacaaagattttacttattcttcgcatgattttgaggatgtattttagaggcgatttgggacgcgacagtttattagagtagaagcctttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattattattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaaattggattcacacctccccctctattcaaaatcctcaaaatggttttaggctgggctcggggtgcatggttttgatagtagcacctcggccatataaggaccggt

SEQ ID NO: 52677 - DNA, 1501 bp, Oryza sativa
ggcgtagctgcccaaaacaacttccaacgtcggcgccgcctgcttcggcttcgccgcatcctcgccgacctcgtccacccctccgtttcgctcgtcgaccgccggagcgccgccgtccccgtcgacccgagccgcgccgccgccttcctccgctccggctgccttttcgtcgtcaccgtcgacctatggtgagccgtggaccgccgcctcgtttccccctttcccacccctctctcggccgccgctccgatgtgcccatggccgccgccggtgaccataggagcgcgggcgcgccgcctcccgccggccgcgccgacgtggcccgccttcgggcgcactgagcggctgccgcgtggggcccggccgtcagccgcccgcgcccttgggtgcggctgacgcgtgggacccacggcgccggccggtgcgagcccgagtgcacccggtccaccgtggaccgtgaggctgccgcatgggccccactcccgtggacccggtccgcgcgccccctcccctcggttgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctacttgttatatggagtttatgtcacgaccggaaataacccaacgggcgttccttacgtgcgtgcattaatccttgtcccaggaggcaaggtacaccaaaagttgatacaaatcagagtttaacaagcggaagcgtaaatagttaatttattacatgggcagcgaaggtccagcacacacaaagacaaacgagaaacagcggaagactagggcgacgaccacagacacttgacggcaggcacgagctagacaccgaagccttcatcttccaggaactcctcttctggggttgggaaaaattgagcaagactgagtacaaccaccgtactcaacaagacacacccacaagtgcagaacaaatgcaagggagtacaaaggaattatactgtaaagggttagggttgcagtaaacagcatttaaagacattagttgctcagggctattttgtaaacacgattctagtactatacaatattatttatcaaggccgtgaacccacacgaacctgccttaatccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcaaatagattatactctgatcagaggtgtacatctttacccacaagacacatcttcctcacgtgtaaccacgtgccacataccaccacggtatacagacgaaagacgtgacatagtttcca

SEQ ID NO: 52678 - DNA, 1501 bp, Oryza sativa
agaggagttcctggaagatgaaggcttcggtgtctagctcgtgcctgccgtcaagtgtctgtggtcgtcgccctagtcttccgctgtttctcgtttgtctttgtgtgtgctgggccttcgctgcccatgtaataaattaactatttacgcttccgcttgttaaactctgatttgtatcaacttttggtgtaccttgcctcctgggacaaggattaatgcacgcacgtaaggaacgcccgttgggttatttccggtcgtgacaagttggtattagagcccccttgaccctaggacgagccgtagatcccaagccttagcaatattttcaaaaataaaaatcctttgctatttgtgaaaactgtctagtctctctctgtcttgctgcttcatttactgccaaaatctggcctttaaaatgttgcttttctttttgtttttgtttgtagatggccggcagcatcacccgtcgtggtttggacatgactggcttcgtcttggagctgcggggcatgtgcgtggtcctggggtatccacacggagtggactaccaggccaggccgcttccggagcaggagggtgacgatgcagagccccacgctgcttgggaagtcactgcagtgatcctcgctggttctcccgagcggacctcgctgacagtcaccgcgggtggagactctttccccgccgcttgccagaacgccgctctcctcgccatcggcactcttcaccagcgctacccggacgagttgcagcactcgccctaccgctaccaccctcgtcgcggaggagcccgcgaccacgccaccttccgggatgctagttcggaggatgacgctaccatcgtgcacttggcgcgcatggtggaggcatacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctagcgtggacctgcttcgtcgagaccccccgtgccgagcccgcgcccgtggttccccaggagggggaagcctccggcattggtagcacggaggatgcgctgttgctcaccttccgtcctggcccgtcgcagcggtagacgagcagttagtaggcttgcgcgtgtgttctttcttgtttgtcttcttgttgggttgtgtggggcatggttatgtcggtgtgtggcataactgtgtcagagcctgccttattttatttgcctaagcaacttgaactttaatgaaccaatttaatagcagtaataaattcaagaattatggtagtcgtgggtggttagttttaattgtccgctctctctgtttgctggtcctgtgtggggttttc

SEQ ID NO: 52679 - DNA, 602 bp, Oryza sativa
tcataactcagccatttaaagaagacaatgtcagcttcggagttcaggattccttaccagcaagtaagaggggatatgctttccttacagtcattccagtatatagttcaccatttaaaccacttaagtaaaaggtcagttgattttgagtatatattgaaatattggactagtgcaattcattcaaagtaaaaaagtaaggtgaaggtttcattttgttgatagagtgaatttctgttatatgtttcattacagttatgatgttatttcaagacaatattttagcagtaggccagttacttcttcaggcataaagagtgaatctcattgaaggaacaaaatgaacatttcaatttttttcagcagtctcggtaatcaaagttatgaatataccattgctctatagcacctctctctggcaaaatattagcattttgtctcaagacctccttatgacactatattaaacactatgggcacacaatacctatcatgtaaaagttttttatttttgctaaactcaagtttcacaaggtcaattacatcactttactgtggcattagtgagtattcactccattttgttccatacttttgatagg

SEQ ID NO: 52680 - DNA, 1501 bp, Oryza sativa
ccggctcatcgtctcgcggcgccgcctccgtcttcggattcacagcggcgtgttccacgccatcctcgtcgccgtgtagccactgccggctgcccacgtcgcctcctcgccggccccggtcgtcgtcatcgtcgtcctcccgtcgttcccggtcgtcgtggcgttcgtccctccgtcaagccgttctcgttcgtcgtcctcgctacgtcaagtgccgcagccccgtcattgtcttcgtcctcgcctctgcgttgccaagcgttgcgccggccacgtctcgcctttgtccaaggatcgccaccggagtcgtcccctcgcctttcgtctccatcgttcccggccgtctccgccgcgcccgttcgtcgttgtcgttccctcgcctcgtcacgtggtggtaaggatctctctccctcgtcgccctcgtcctcgtccttttggtgtcgcccgtgcccgttgtgcggttgtcgaccccggtacccgtgtactggtgtcggtagtcgttcgcttgtgcgtgtggtgaccgtgttagtgtgcccgctcggtaccgcgtggtttccacgtgtgcagcccgcgtggtgtctagtggagtccgtttgtcggccactcgcctcggttgacacatggggtccgcttccgtcgacccgtggaccatctctgtgtacccggtctgccgtggtcccttaggttgacatgtggggtccgcatgtcaacggcgcagccttcctgtcttttccaggctagcgcttacacatgttttatagttgtaaaacctaattataataatccacaaatctccatataacaacattaaacttcggatgaccatgcattggtcatacgagctccgaatcgatccgttcaagtctcctaatgtttgttataacctaaagaaccctgtgctttctttttatctattgttattgcttctttataggcttgtagctttgcttgtgtgcttcgcgtagcttctgtcgttcctgaggttcccgaagcgtggttcgcggtcatcgccgaaggttcggaaggccgttatctctgagcaaggcaagtcacatcatccttgagcatattgaatcctagtttataaaattattttgatttaaattattgcattatcgctttattcaaattcccgcgttatcactgttttatttagccatgcctatttatctttgttatgaccttatcattgttgttattgttattattaccttgttcaccctaggataaacaaaaccccaactagtgggtaccctattcatggttccactagtatgaatttaggtagatgcttcgctaattaattaggcaacattaggtggttttataactttagactttgggaattctcatatcatttggacactatggaatggttggcttatgttggaattggacacacacctccccctctattcaaaacccccaaaatggttttaggctgggctcgaggtccgtggttgggttttgttagtcgtacctcgggtactataaggattaa

SEQ ID NO: 52681 - DNA, 1501 bp, Oryza sativa
ccgcagccccgcgtagatcttcgccgcgatcgcccgccgccgccgctcccgccgccggttgttctcccgctccctccacgtcggcaccctccctccccctcctccgttcatcatccctctcacctcacctcaccgccgcgacctacgaggaagccaacggcggtgcgcgctcgccgtcgccgccgctgcaagctcgccgcgcgctctgcagtgtcagcctcgcaggcgcggcgtataaatacgccggagaagcagtaacggccggaggacgcgcaatgaccattctacccctgggtggtcttgcgcgggggagggtaaatgcggcatttcgcgcgggggtggccggtaatgattccgccgcagttaaggcgggggtggccgagaatggaatgcattcgcagtggcttaactagcctatcgccttagtgaacagtggccatttttagcagcagctagctaagctaagctaatccatgcaaaccaagcgtgagcggcgtgggtggtcaggtgacgcgtggtggggccagggtgtcagtgactgtggggggttggtgtgctactggaccagtggtggtcaaacgaccggccggcttgggttttggatatgttcttgggggtgcccttgatgacttgggttttggtatgatgtgtatgatttggtttgatgaggttgggggagaagatggatatagctagtgtggttgctgtcactgttcaatgtgtcaatgataactctacagtaatgattagttaaaagctagcacgagtctagttatggtttgtaacggttttggttttgtgtagcgcatggttatatagccgttaaattattataaatatgtgtatgtggaagtcaataacgagaattgttgtcattgattaactgcctatcgtagttactgtctgcacgattggatagtttaaacgtatctcgtgatatctcctttgacgatttacacgtgacattgattagacgaaggggacgatattaaatttgccacaataaccaccgtaacggttaatctggttgtgtaacggccatggaatgcaattttatcctcataatgactacatgtagtattggatagtttaaattaaacatgtgattccttctttgtcgatttacgcgtgacattgattagacaattagattatgttaatctttaccgtgacaacagtaatggtttgtctagtaacatagaacgtaaaattggacgtgctacgcattaatagagcattgttatctataataattgatctgcacagtcaaaacaaaagatttcaaacggttcaattgggtctagcacatggttacgtaaccatggaactacaactgtacatgcattcaaggtgtaaataaaacattaatatctctagtaatctatctacaacgtaacgcactagatagagctatggattgtaaagcgtccagttagttccatagcacgattgtataactctaggattaccatttacagtgcatataggagttgataaaaat

SEQ ID NO: 52682 - DNA, 1501 bp, Oryza sativa
cgcccgtcgtcgccggccacgagaggctgcaggtccggcggaggagcgcgcggccgcagagaccgccgggtgccggccgaagaggggcgcggggagggagggctccgcgccgcagcggcatgaccggcgggcagcggcgccacggggcctctgtcagtctcaaggcggagctaccgcgacggcgacggcggcggcggcggcggcggggtgaggcgatgcgatgcgaagtagcctgtggttgacagtttcgatggtctagaatcgcgccttctgttccgtacgtggatagttgggccgagaacttgttgggctggagcccaactctccagttgcaaaacgtacctgtgggtcagtggcgagtggcttctctccgtcgctaccccggggacgtcgcggcggtcaagcgccgcgaggcgggcctcgcgggcggcgtcggaggcggtgaggatgcggctcgggtgggcgagcggcgggaccgccagcccggcggcgtccctcagcgcgacgcagtggtgcgccgagctgtgcgtgtagtcggacggccggatcggcgccgacgacgacggacgagcactcgccaccgccgccgctttcttcttcccgtcgccgccgccatcatcctcgtacgcgtcaagccgcaccggccaactccaaatcgacgctcaagctcaagctccgccggccagggcggagagggagagggccccgctggcggcgcgaccggcgggggaggaggaggaggaggggaggggaggcgcgcgggcgggtggcggcggctgaggaggaggcgccagctcggagcgggaggcggcggcggcggcggtggcttggagcgggaggcggcggcgttgtcgagaacgggagcgagagacgcgttcggtcgcgagcgagaccgcgtcaaagggcagagaagatgacgattttgagggagaataagttcaccggagattttttaaagtatcttaaccaaaaaaaccaaatatttactcctaaactctcacaaaccgttcactggaggtccctcggtactatttttgtccggtttttctgacgtggcattctagttagcaaaaaaataagaataaatatgtggggaccacatgtaagtgacataaaaatgttaggtcaacaatcctagtcagcactgatattctaaatcgcttttttctttggcgcacagggggagcaacagcgacacgcatccgaaggcaggcggagcagggacgcggcggttcggcgggcgaggtggcggttcgcgagtgcgactgtgatgagcacggcagcgaagcggcggtggagcggtggtagcgggcgagcagcggcttcgggctcgggaggaacaggcggaggggcggcagcggtggcgcggcagcagctggtgccggccggagagggcggagatgaggccggcgggagagggggtggagcgccgcatcggcggtggtggttgagaggacgggcgcctcctccaccgctgcctccctcgcgggaaccgtccagc

SEQ ID NO: 52683 - DNA, 156 bp, Oryza sativa
caattcctacgttgagtttaaacgggtggttacgtggcaatatggtcagccagataaataaaaaataatggaaaaaaaattgagctccatatgtcaatcagcaaaatagacccacgtgaccccacctctttctctctctcctcttgccctctcagc

SEQ ID NO: 52684 - DNA, 594 bp, Oryza sativa
aatcattgtttgataaaagatttctatagttttgtcatcattagtcttataaaaattactttcataaatgtggacaatgctacattatgaaacggatggagtacaagcataattaaactcatgagactaaactgcagctaacaacacctaattaaatgactgatctatacccatcaatgttcgttccattgctctctaaaaataattaggccttcgatctcgactctcgactgctatctccttttcgctggaccagcgaagagcgctagcccaagtaagatcgaggaaagggtggtggtctgaaaaaatgagcacaacgccacagaccaacaggctgcactatgtttaatttctccgtatataaattaattccttaggtatcattaagtacatgaacagtacttgcaactcactcagccaagtgcttaccgagagttactatggtaatctgcctctcgcattttggatagttttgatggatatcattgttggtggtatggcatgaggcccttcgaccaaaatctgctgaaagctatacgaagagtggggattcaagcccgagacgtcaaagttagtcggggcgaagtcccccca

SEQ ID NO: 52685 - DNA, 1501 bp, Oryza sativa
gcttgaattgtaccatgagtccatgagcacggccatcactcatcaacatttgctttatctacgaataaagcaaggttaggagttgggaatgcatgggccggtcagcaaattaatttgggttatgacattatttaggcccattttgcaccaggcccactctatccttgccaactttatgttaagctcctagggcttgatcatacgtggtttaaatcatcaccgtgctgccaaaaacccaaaagaaaagtcggagattttattattgagtgaatacgcagacagcatccgtaagtaagggggtgtttagatcacatcccaaaattttacgccctgtcatatcgaacgtttaaacacctacatgaagtattaaatataggctaaaaaataaccaattgcacagattgcgactaatttgcgagacaattcttttaagcctaattgctccatgatttggcaatgtggtgctacagtaaacatttgctaataacggattaattaggcttaataaattcatctcgcagtttactggcggattttgtaatttgttgttattagactacgtttaatatttcaaatgtgtgtccatatatctgatgtgacacggcaaaaattttcacccctagatttaaacacagcctaatatagaatcaaattagatacgtttcacgtttcagtactatgaatttgaacatatcacatgctcatatcaaaatttataatattaaaatatgtctaatctgatgttaagtaattatattttacgacggaggaagaactagtagctaaataaaaagagagataacggtgtgtttagtttagaaatttagttcgaaagtttaaatttcttatttaaaaaaaaacacttgtaccaatgaatactgatgagtattttttttttctttttacaaaatgttactatagattagaatgtgtgacccgtgataatcccatgttcgattagctgaaaaagtagaacccaatctagcactctctctattttaggttagaagacgttttaattttagctaaagtcaaactgtttttttaagtttgaccaagcttttgaacaaaataataacatttttaatccaagttaaatttactatgaatatattcaattattgatttgatgaaactaattaaatattataagtgatactatgtttgtttatagatttagttaaacttaaaacaaatcaaaaactcatcctgacgcatctctgaacacaagatgacgcattgtgccaaaagacacgctcgtgtagcagcgcagcatcgatcagcagcgtccagtgccatcactgcctgctaccacctgctgcctgcatttaatcaccgaccttacaccagcagcagtccaccaccccgccgcttccccgcaaaaacaaaaaaaaaaagaaaaggagagaaaaaaactcctttccgccaccctccccttcccctctctctctctctctctctctcacgcagccgaatcgcgaggagagattccatttcccca

SEQ ID NO: 52686 - DNA, 1501 bp, Oryza sativa
ggaaccaacattacgtgcgaatattaaaaacaataatttatatataaggtagtccggaaaaactagaccggactagctccatccattagagttcttgtcaaatatatgtatacaaagttagttataaagtactccctccgtcccattttaaatacaaccatgagtttccatgcccaacttaagtcgtccgttttatttgaaaatttttataattagtatttttgttgctatgagatgataaaacgcgaatagtactttatgtgtgacttatgtttttaattttttcaaaaaaaattcaaataagacagaagataaaagttgggcaggcttcactcaaatgggacgaagggagtaggacttaggccgtgtttagttcctcctccaaatctttttttgatgtatacggacgcacatttaaagtattaaacgtagactaataataaaacaaattacagattctgtttagaaactgcgagacgaatttattaaacctaattaatccgttattagcaaatgtttactgtagcaccacattgtcaaatcatggcgtaatttagctcaaaagattcatctcgcactttacatgcaaactgtgcaaatggttttttttcgtccatattaattgctccatacatatgtccaaacatttgatgtgacggaatttgtggaagtttgaaggaaactaaacacagccttaggtttcgtttgtttgtgctgttgaggggagcttctctcgtttatcgtgggcacacgcttttcaaactattaaatggtacggtttttcaaacactttctacgttgttttcttttaagaatcgaatatctcaattttcacgtttatatttgttaatatttaattaatcatgtgctaatcactattgtgttttccgtgctactgattatctcaatcaattaataatctttattgagtggcgtctcagtaaacttataatatgcatagtgcaaagtaaaattagtgtcggattctattctggacacactcttaaatatagaggcacacccatcggcctagctagttgaggattattgataacattgatatgtaatatacacttcggttgagcctcctttttaaatatcgtgtttagatgtcgtgattaaatttagatctattgtttattcgcgtttgattacggattaccgatgatcttattggtgccattttttatataagaccacccaaagagtgtttccacaccacctttgccttccacacccttctgccatctctcatctctgcctcacggctcagacgacgcacttccttcctcgtattgccgcctcatactcagctagctgcacaaggctggttgtttagtgtaattaacaatccccaacttgggtcgattaccggcggtggacttgatcaggccatcagaatagttttgggatcgaaggagatggattcattattcgtgtgtagtatagttcttcatcttgtatcagctgtcagcatcttgattgcaattgtaggtagcca

SEQ ID NO: 52687 - DNA, 1501 bp, Oryza sativa; identical to SEQ ID NO: 45335

SEQ ID NO: 52688 - DNA, 220 bp, Oryza sativa
aaattgacaaaaaagcattgttttagctcgtctccgcgcttaggcgcctagcccattaggcattagcccaagcatctttctggattcaggagagctcttgtctactccgttctctagcgtacaaaaagcatccgcgaggaagcgcatccatggtagcggcggtggtggcaacaccgacgagatcggaggctctgacccttcctccgcatggcatggcagt

SEQ ID NO: 52689 - DNA, 1501 bp, Oryza sativa
aatcggggcgttacacacatcgtattctaagggtatcagtaggcatattttgggtctaggcctaatatgtctgcagcccatattttcaggcgtggcctgtcacgttcttttagggacttagaaattttttggttaggcaaaagtgcgcgtgatcaagtgcccaatactttaaaaatccttttataccgctcttactcaactttttagtagttggtacaatgcattttaaaaggtaccaaacagtaaagctttatatagctgccttgctgacttttttatctaagtcagggcattgtttgggtttataaagcaattgattggatacaatatcgttgctttttgccacgtaagtgtgcattcttattgaccaatattatggcttaggttgactatatattttggtcgtttttcgggcgattagtaaatcctttatgagtttatttactcggattttacaccacatatgccatatatttctaggtatggtgaaaccatgtgtcttttagggacttaagcacatatgttaaagcagtgtgcgcatggtgtgtgcccaatactttagaaatttctttgttcacagcatactagcttttttatagttgttttgcaatgtgaattttcaatgatgtagtcaactttaggttgcacgcatcatattttataaagcagttggtatatcactcggatcatgttattcggggattcacaccgcatatgctatatattaatattaagtcacttggtttactacaattatcaaaaccactcggttggttggattatttactccttgactatatgttttgtttgttcaactaaccacatagtcgagggctatacctattaggtgcatctagtcgatgcacctacgtttataattaattaatttttagccctccacagtctttagatttggtaaaagtactcgggagaccatggcaaagatgattgatgcactcggctttggagtaatctggttcgagagaagattatcttttcgactgtgaaggtctcacgggctactgtggagattatgggtaccccatacccacacggcatggttatccgactggttataggggataacttatatctatgaaatatgtaaccgatcatgactttggtattacatttccttgtatattatagaacggcctaaagttctggtttgataatattgtaaagtatatttaggaaactgataccatattgattaaggtttctatcttgtaatcctgacccccccccccccaaatcctatataagatgggcaggaggccctctagggggcataattcacaaccagatcgtcagatctataatacacccggcggattcaaatccccaaaaaggagtagggtattacctctcatcgagagggcctgaacctgtctaaatccttgtctctgcatccatccacttttaggtctcatgcgctaccccttttattattgccgaattcttgtttcgacaccacctccccgggctgccaacatctagg

SEQ ID NO: 52690 - DNA, 347 bp, Oryza sativa
acggtgggtttttttttttatttggcaccgaaaaaacgggggagttctgcacttttgctaggctgtgtttaaatcaaactttggatcccaacttccaactttttccatcacatcaacctgtcatatacacataacttttcagtcacattgtcccaatttcaaatcaaacttttaacttttaaaggaactaaacacagcctagtgtaacccccctaataataaagattttcttcagaagccccattgccccataattcatctcaaaacattttgagtactagttctttatgaatttggaaataaacccgctgacataaaacttttaaaagtttcatttttttttaaga

SEQ ID NO: 52691 - DNA, 1501 bp, Oryza sativa; identical to SEQ ID NO: 45341

SEQ ID NO: 52692 - DNA, 328 bp, Oryza sativa
ttctgcctcccgtgaactggtgatttacaattacaacggtgtaaacattaacctttactataatgacattggatccacattttatagatacagatggacccatttgtcattcactcagagtgtcaaaacagcgaagcctctatgtttgcaatcccaatattacaattttctccccattttctccccgtgaactgctactgctactagtattagtaatatcattatctggaaattctaaagcggcattatcacactactccgcttctgctacacggacgtttaacgatcaactaactgactgactcaaatgaatttgcaacgaaaaaaa

SEQ ID NO: 52693 - DNA, 1501 bp, Oryza sativa
tcctctaagcttttcttggcgcagggaccttactggctttaagttagtggcatggaatcaccttctctcacgcatcgctaatattatattatctcacgaccaagatgagtttaaatggaatctaaccactgatggcagattctcggttaaatatctttatcttgcgttggtgcagaccgatgttcccaatataaacaaaagaatctggaaaatcaaagcccccctaaagattaagatcttcttatggtacttacgtcgtggagtagtcttaacaaaagataatcttattaaaaggaattagagaggaaacaagtcttgttctttctgccacaaagatgaaactattaatcatttgttctttgattgtcgttttgcctgcacagtttggtctataattcaattttgcttcgaatattagtttacctaatagtacaactcatatgtttgggcattggataagaagacaaccacgcaatttgagatctttggtcttattaggggcaactaccactatttggtctatttggctttgcagaaattatgtggtttttgaaagaaaaaacatatcttctcctttgcaggttatctttttgattacacattggctccgcttatgggctatccttcagaaggtcaatttgcggggtactatcattgcggcttgttaacaattggagctagtggccatggagttttctaccccggtgcatgggtggtgttctagactacggttagagggctcctgaagttctttttgtccctgctatttggatgatgagtttatcttttgtttctttcttgttggctgtgtgcactctttgggtgcagaagccggaggtgctcgcagaataattatatcacttgatagagttttactaagattaataaagcttccattatctaaaaaaaatacttattcgttgactgtattacagaaaccccattactcaaccgctggaggaagaagctgaaggaaattggcaagaggaagatctcataccaggttaatcctccactagtgtacggtacaacctttcacaatttttattttttttatatgtgtggctaattaaatctaaactcctccagatagagaagaaaggttaacctgcacaagaacaaaagcttaagaatccatggaagatagggtaagtaataacataatatatgagacagccgagctatgtgagcaagtcattcagatgcactcgcttgtgtgtatgatcgttcaagctaagcatcaaaccaagcttgtttagcggggaggtaagtgcgtggcgtcaaccgtggggtgaatgtccggcatcaatccaaatgttagccatagtgttaggtttaaaggttgatggatcctgcatgatgaattgattatggtctaacatgatatttctttgatggtacgtagttttcttgttaagaattttttgagagatcgcacacatgatatttggaggttcaacgtcatgcattaaaaaattgtgttatgtgctatggatgctta

SEQ ID NO: 52694 - DNA, 251 bp, Oryza sativa
caagagagattcttggccttccaccatagtattttagttcctgcagaagtgttggggacttggggtttagtgtcaggttgtagagaggacatgtatatcggcaccacactagtaaaggatggatggtttaattattccgcaccaattttatcattgatccagcttacatttgagtgcaagtttccactgtgttcagtgtgcaacctgttgaaaaatttctactactaattcattctattttacactgcagt

SEQ ID NO: 52695 - DNA, 1501 bp, Oryza sativa
ctgcacagtttggtctataattcaattttgcttcgaatattagtttacctaatagtacaactcatatgtttgggcattggataagaagacaaccacgcaatttgagatctttggtcttattaggggcaactaccactatttggtctatttggctttgcagaaattatgtggtttttgaaagaaaaaacatatcttctcctttgcaggttatctttttgattacacattggctccgcttatgggctatccttcagaaggtcaatttgcggggtactatcattgcggcttgttaacaattggagctagtggccatggagttttctaccccggtgcatgggtggtgttctagactacggttagagggctcctgaagttctttttgtccctgctatttggatgatgagtttatcttttgtttctttcttgttggctgtgtgcactctttgggtgcagaagccggaggtgctcgcagaataattatatcacttgatagagttttactaagattaataaagcttccattatctaaaaaaaatacttattcgttgactgtattacagaaaccccattactcaaccgctggaggaagaagctgaaggaaattggcaagaggaagatctcataccaggttaatcctccactagtgtacggtacaacctttcacaatttttattttttttatatgtgtggctaattaaatctaaactcctccagatagagaagaaaggttaacctgcacaagaacaaaagcttaagaatccatggaagatagggtaagtaataacataatatatgagacagccgagctatgtgagcaagtcattcagatgcactcgcttgtgtgtatgatcgttcaagctaagcatcaaaccaagcttgtttagcggggaggtaagtgcgtggcgtcaaccgtggggtgaatgtccggcatcaatccaaatgttagccatagtgttaggtttaaaggttgatggatcctgcatgatgaattgattatggtctaacatgatatttctttgatggtacgtagttttcttgttaagaattttttgagagatcgcacacatgatatttggaggttcaacgtcatgcattaaaaaattgtgttatgtgctatggatgcttagttctcactggtggagaaacctcaattgtcccagtttacaaccccctatatcccgggttgcaaaccgggacccccaaattctagactaaagatggtatctttagttccggatcaaatttgatcaagtttatagacaaattagttttattaaatttataattgaatattttttcataatatatttgttttggattgaaaatgttaatatttttttctacaaacttggtagcagtttgactttgaccaaaggcaaaacgacttataatctaaaacggagagagtagtttatatgggtttctcattgttttgataccctaccgatggagtagtgcaagtgtagaaatttatggagttaccgaaatttggtagtggtaa

SEQ ID NO: 52696 - DNA, 193 bp, Oryza sativa
aggacattaaatccactggcttataaatcatataagtcaataagttgacttaaaaaatctaggccaataagtctaagcctaaacaaagaaggtctgactaactaactgacccagtgattttttttttataaaaaaaggagcaaactgacccagtgatgaatgatcaaagacattgtccactcgtgcgtgcagt

SEQ ID NO: 52697 - DNA, 170 bp, Oryza sativa
cgatcgggacagggtttaatttgcagtttcttcttatgatcttatcccgtcgtggagtgagcaatcagctcgagttgtgtgcttgtgtccgtgattctgtcgccgatgggatttgggttcgtttcttgtggaaactatcctgattctgacctgtttttgacatgatcagg

SEQ ID NO: 52698 - DNA, 616 bp, Oryza sativa
gtctatccccaagaaagttctcctaaagattcaaaaaaataaaggactgatgctcagtgcaacaaattctttacagggctgtctcacaagtttgaatgtacttgagtgctcataatataatatttagtaaccgagcttatataatgatacacgaataatacatcacacaagatccaacattctgtaaacaaattaactacagcatataccggtaccatcatcagatagtgttaccagttgggagagatgtacatgaactatgaaatctgaatggatgcttaatcaactaatgattcagcttccataccggcaagcactagatcacataacttctcaactaaagtctacaaggttcggccagccaaacggcagcaacctccttaacctcctcgtttgacgactcatttcacacaggattgtgttcccatttcaacaagcaacaccagcggagcgcaatttttcgtcagtacctcacccgttacgcaactatcaggcgattttgcagacctcaagaccccccaaatcaacgaattcggaagcttgaacaggcaaaggatgcgggggctcaccttcctcgaccttcttcttgacgtgattctccctggcctcctgcagg

SEQ ID NO: 52699 - DNA, 1501 bp, Oryza sativa
tcttccaacctcctccgctctaccacagccaccaccgatcaccagcacctccacctgtggagattatgggtactctatacccacacggcatggttatccgactggttataggggataacttatatctatgaaatatgtaacggatcatgacttgggtattacattttcttatatattatggaacagcctaaagttttgatttgataatattgtaaagtagatttaggaaactgatactatattggttaaggtttctatcttgtaatcctgccccccgtcctatataaggtgggcaggagaccctctatggggcataattcacaaccagatcgtcggatctataatacacccggcggattcaaatccccaaataggagtagggtattacctctcatcgagagggcctgaacctgtctaaatccttgtctccgcatccatccacatttaggtctcgtgcgctacccccttttattattgacgaattcttgttttgacagttggcgcgccaggtaggggatggaataaaatacaggagtcgccaacaagcttcgcctctcagattcgggtctaatcggctagggaggatgacaaccactcggcggcgagtttcaagtccaatctgcaattccaagccgaacatgattgattgacgccaagctatacacgtgatcatcacccgttgagaggaccatatttccagttgtgtcccgtatctatttggctagcaagaaattggcgtgcatgcatacagagaagtcggcgacatgcatatgtatgcagtacaagtttaatggcaattaagtatatatgcacatcctcgtcagacatcctctccggttctattatttggttatatctttttgatctttaatctagtaacagaaacttattttcctctcaaatcgtggaatcatccacgaatccagcttctggcaagtttttggtgttttccttttcaatttaactttgtaagcttggtctagcctgaagattggtgctccctaaattttagtgctttccctctcttattacaaagtcttttgtgggctcgtgtgtgttttgcctatgtgcatcctagttatgcaaaggccggaagttttcttagtatggttctatcaacttgatgtagtcatctgagattagtaaaaagcttcctttatgtgatctttttttttctacttttgcatgtatcatcgatggctgagcccgatcaaaaaccaaggcttacacaaactatttgtttggtataattcctcctcggccacgatgagtcaaaagcagcactagccgactggtgcccttgcctccacggttggtttactccgccgtcatttttgatggagacgttgtcttcaccgccggccgccgtcattgcagccgactggtgccctcgctttcacggctgacctattaggccgtcattgatgggcgtcttcgctttcaccgtcaaccaccttggtcgccaccgactggtgttttcgcctatacggttggcggacat

SEQ ID NO: 52700 - DNA, 1501 bp, Oryza sativa
tccgtggacttggtccacggtggaccgcccctttgagtcaccgacaggtggggcccgcttgccggcaccacctatcccctcggtgacgtcataattgattttaattgcgcaataaattcgttaataattatagaaattcatttaaatggttcaaaacttctaaaattcatatctaattcattcgaacttcaaattgagccgttcaacttgcaaaattcatctaaaattgagctctacatgtttgtttactttttatgtactgtttccttggtttttattagagtttttcctcattttgtgtgccagcgagtagattccgtcatttcggaagtccgcgatcgcgaggaaaagagttcggaagattcttttgaagaagcaaggcaagtcacacattccccttgagcatttttatcctaatttacaaatgttttatcgtttgcaaataaaattgcatgttttgctaattacatgggatccgggtattacctatctgctcgcttgtgccatgtttacttgatatctgtcctttgtcaaccttgggtaataaatcaactagctcatgttacttatgtgacctagctagacctatatgcttagccatgcttaattaccactagctcagttgatgggataatgacagtattagacccttttagtatcagaataagctgcgtgctcgagacatctggccatgcttcatagtcgtaattatctaactaaaatgcgactgaatggtgggctgtgggtgcatggttttgctagtcgcacccatggcaattaaggaccggttcgagggatgccctggaagaacttgtcgtacttaccacaagccagcgtaggcaacggctgggcttgtagtgtagctttcctctagctgacgcatccaggcaagggtgggcgtgatggagtttggatgggccctgtgacggcctatgcggcttccggattcacctaggcatgagaggggactgcctgctgccttgcgaggagtgggggtaaaacctgaggtgtggtgcgcttggttagagggggttatgcgaagggtcctgtcgcggcctctatccggtatgtcgtggtggcatgtcggcgcacggaaatgtgtcgtggggctgtgtcttgtgggtacagttgtacacctctggccagagtaaaactattcgaatagccgtgcccgcggtgatgggcggtcgaccagattcaccgtgattagtctcacacttaataaatcgactcaatgcactgtagttcaggtgggttggttgggactgttcaacgtggtgtagcgttgatcagtggagatttaatgttactttaattactcaacagttttactattttgctcagtaaaatgttttacaaccgcctttatgtaaatagccacaaaccgtccttttgttccccttgcacgtctgcatcattggtgtggcttgctgagtacggtggttgtactcagccttgctattattcccccttttcagaagtgtagtgcttctgagctgaa

SEQ ID NO: 52701 - DNA, 1501 bp, Oryza sativa
aaagcacagggttctttaggttataacaaacattaggagacttgaacggatcgattcggagctcgtatgaccaatgcatggtcatccgaagtttaatgctgttatatggagatttgcggattattataattaggttttacaactataaaacatgtataagcgctagcctggaaaagacaggaaggctgcgccgttgacatgcggaccccacttgtcaacctaagggaccacggcagaccgggtacacagagatggtccacgggtcgacggaagcggaccccatgtgtcaaccgaggcgagtggccgacaaacggactccactagacaccacgcgggctgcacacgtggaaaccacgcggctaccgagcgggcacactaacacggtcaccacacgcacaagcgaacgactaccgacaccagtacacgggtaccggggtcgacaaccgcacaacgggcacgggcgacaccaaaaggacgaggacgagggcgacgagggagagagatccttaccaccacgtgacgaggcgagggaacgacaacgacgaacgggcgcggcggagacggccgggaacgatggagacgaaaggcgaggggacgactccggtggcgatccttggacaaaggcgagacgtggccggcgcaacgcttggcgacgcagaggcgaggacgaagacaatgacggggctgcggcacttgacgtagcgaggacgacgaacgagaacggcttgacggagggacgaacgccacgacgaccgggaacgacgggaggacgacgatgacgaggaccggggccggcgaggaggcgacgtgggcagccggcagtggctgcacggcgacgaggacggcatggaacacgccgctgtgaatccgaagacggaggcggcgccgcgagacgatgagccggtgaggacgaacgaccgaccggaggagtcgtcgacgaggacgaacggagacgacgacgatggacagtggaggggttcagatggagggaaggcgatgctgaggatgacgtcgctggctcgccgctgcgatgccggaggtgatgcgtcgctggcacagcgaaaggggttgccgaaggaactccggcgagaccgagggagaggcgccacgggcgacggcgttccggcgaaaccgagggcagtcctgggtggagggcgacgcggcgacgttgagggaggatggcgatgacgacagccgctgcaccggcgaggcggcacaggcggctggaggcggtggagtggtggcgacaccactggtcgtctgcgaggacgtcgctccgataatttcccgcgaaacggaggcgacgccggggaagaagaggcggctgcgaggccgctggcggcgacggcacggccagcccgcacctgagcggcgcggcagtggcggctggagttggccggcggtgtgggagagagaggagggctgcggggagaggtggtgaggccacgggagagcgcaggagggggctaaaacgatagaacggagcgagggtgttccattt

SEQ ID NO: 52702 - DNA, 304 bp, Oryza sativa
gtctacactctggccactgatggcccatgtctaccgtatggaagaggatcatctgacgttactgttcaccgtgactggcatatagttccccaccactctcgaacccacatatcagtcaccaagtcagtatgaagttacgtcagaggatctcaatccgtatcgctcgccggggaatgcggctccacagccggcaaagacaacctaacatgccgcttggctccatgttctttggagattttgatacgggctagccgaagtgccgagcagtgggaggcatatagggtagagtagttgagtagggaga

SEQ ID NO: 52703 - DNA, 1501 bp, Oryza sativa
gcattgttccatcctcggttgaaactcaaacttctcttccttgccgttgatgtggaaacggatactccccgttcccacgtcaatgttggctcccgcggtgctaaggaatgggcgtcccaggatgagcggtgtctccttccccgtgtccatgtccagcaccacgaagtcaaccgggatcagccagtcgtccatcccatgataaggacaagcggccacgaattcctacagacgttcccatgcttcaggaatagactcatcgcttgcctactggaaacatgaaatccttccacgaagggcattggttttgcccatcaggaagaatttcgagaggaatgttatagagcatttatcccaggtgttgacagcagcacggttggcatagaaccattgcttcgctctcccgagaagggagaacgaaaacagtggtagcctgacggcgtcaggactgacacccttgatggtgtacatgctacagatctccaggaactattgcaaatgagcattggcatcctcattaggcttgccacaaaatgagctagccggcgccatcgtgatgaggctggacttcaagtcgaaatccacgtcccctatgttgaccagctgccaaatggccaaattgtcagcagagaaagcagcgaactcgcggagagtcttgttagccatagtcttgaaggttggtggcgccggtatggctggtttctctattggtagagttttctgcggagcaacgactcgcggcctaacgctccgaaagaaagtttctggattttctttgaagttttccggcaaattgaaaccagtcatgcactaacctgttttcagaacaaaaagtaaaaacaaccaaggtttatcctgcaaaggaaaatgattatacaaaggtaaaaataaagtattagttcaagtaatcactattataaatcttccccggcaacggcaccagaaatgcttgttggtatttcttaacgatattactagaaatataattcccaacaatggcgcagaaatacttctggtatattatggttacagagttcatccgcaagcggacggatataccattgtagcatttcacctgagagtattccaagggtatcgtatttattttatcccgtgggaagatcatgtagagaaaacttgactaataatttatatattacttgtgataatcatattctaagtaggggttaagataatccaagggtagagtgacacacaagcattaactactcattctcataatatatcatctaagctaagtggaaagaaaagagagaaaatctattcctatacttcaaaaatcaattcctatacttttaatatacatagtatacatacattctagttaaccgatatactagctaataccctctatccgataccctcctggtacttcgagaagccacccctgactgctgagttccttacgacagcccgtcatgaccatacaaccggggctaaatacggaggaataccctcccagggaattaacttaggattatat

SEQ ID NO: 52704 - DNA, 272 bp, Oryza sativa
caaacagaaaacaatgacaccacagctcaagtttttgcaagagcccagtcccagtcttgtgctaataccaaccaaccttttgactcattcaagctcgaattgtgctgacaatattccactctcatgtgatttaactataaatggtaactatgttatgataatgataagctaatccattgctttgttagtgctttctccacaccgaatgatgttgggataattgttttatttgtaactgttgcttttgtatcaacagcgggggaagtcaagca

SEQ ID NO: 52705 - DNA, 1501 bp, Oryza sativa
gtcaaaggcgaagatcgattcgagaacatagtaagaatcagctggagtccggatcggctatgattgggatcggctaagtccgagtcagactaggttaggtgatacggtcgattccgacaatacgacttggtatacgacatcgggttgagttgatatgcttcaagatgattgccacacatggatagagtcctgagaaggcaattgtatctattaattaggatattttatgtaatttccttagagatatgtttgggcaaaagtctgccataaagacttatggtattttagagtttgttagagataagagtcgtgttcgatatggacattgtttgtaatttttgggtataaatagaccccgaaccccatgtaatcaattaacacacttgttcaatacaatttcggcgcatcgccacccttttgctttagttttatttcgacgagttcttgctttcgggttgagctgcatcggtttcgatcttgtttatgtaaaacttgttatgacgacttgcgttctcgggattagtgcttccatctttatgatactctgatcttgtttatgtaattcgttgagttatcatatatcttacataatctctgacaatatcgctatataacctacaatcggctaacatctgtcggtagagggcagccgattaggttaaacatcgatgttgacttagattatataggatatccaccactctacgaaacctccaggggcttgattgtctagatattgttcttcttttcatacttaatgctgcatcagttgagtttgatctattaggtcgtgcttagaatatcaatctctagcctgtcttctggttgccgattagggtagtatcggagtttcagtcgatcttatctgatttaactatatttactctatatgcttcattgatatgttaaatctgtcctttatattaagatcttgttgcatttaagtatattagacttttatttgatatattctacttgtcttaatatcttagtatagagtggtatcggagtattagccgatacatgctagatccatttgatcggctatgctatgaacatatataatcctattattaatatatatttcgatctaaatgatttatactgtctcggcatggcgaccgatctatcccaatcacttgatttaaatatatatcgatataaggattatatattgttaatatctacagccgatcgagtggatatagttctttcttatttatttatgactaccgatcgatttacacatgatatcggctcaaggataaatgacatgtcatcggcacttagccgatcggctatcatttatagatttaaccacggtttctttgcctttattttttgttggttgcaggatcaaatcaactggcacgctagcatacccgaaggcgagttttggacctacactggagttaagcagatctcgcaggcctcgtgtttttcattaacacgcttttggcacgcctggtgggacatataagaagtcagaagtcttttctca

SEQ ID NO: 52706 - DNA, 1092 bp, Oryza sativa
tcaagggtattacccaggtaattcaatttgatatatatcaaggttttctcaccattttatgtcttgggaagtaaaattttgtgcattccttctattttgtaacttctattttgtaataagttaatctaatacatgatacgatatatctcgagaatacttataattggccactcgattcacgggataagaatcggacgctctctggcagaacagacaacagctagctaatttatctccttcctttcttctctcttttaagaacttttttcttctaaattacttatccgatctataatccaatcgctctgttgtattcgtagaaattaaatctttaagatatcataaattatattctgataaaagaaaaacttgtgtttgaaaccattagaacttaatgttccatacgtgatagagacatggctcaacgtgtgttcactgtgttaaataatattcacgcagctaactgtatgtactctctccgctccatccatgcaagcgcttgcatgcatttagtgacattcaaaacgatttttctactaaactagttatctaatctacgatccgatcccaacattttattccttgcaattaaatttttacaacaagatatcgcatgtttatattctaatagaaaaatatgtttcaatatgttaacatggaatgtttcatacgcgatagcatcatatttcaacgtgtctgcattgtttttcacaaaaaagttaaatgttttagtggctgaaattttttcaccattataactccatgtttccatggtaaactgaaagtctgaaacgcttggctgtcaaattttttaagaatcaatcgggcgcccgatttgaattttttcgatatatctcagcactactaatctggataaggattctatagattcaactaatgcgtagaaaaacaattgaaacgaaaaaaaaacatagtcgtgttcacaggtatattttttttgttcatgtgcatgtcgaatttgacttttctttctgataaatatagtaaatttagattgtctaatttttattctattttttcatataagtattaggacgacattttcatacagtgcaccatttggcatatgcc

SEQ ID NO: 52707 - DNA, 326 bp, Oryza sativa
taggaatataatttataaaaaaaatatatcagaataaaaaatatggaattttggaaaaaaaatattcatttggaacacatatggaagtagcaacatacctctaaggagtagagtggtgatggatgacgagatatcaaaaaactattaacaaaataactaatagaattccaataacgattaattggagggacgacggacagactgttaagcaatacgatctcatcggttggcaggacttccaaaaggtaaaaaattatccccgatgatagtcgcattcaattttaaaatctcaataacaataaataggggaggcagcggacgagcca

SEQ ID NO: 52708 - DNA, 1501 bp, Oryza sativa
ctgtcacatcggagggcgcccactgactctcgaagctttctctttcttccgccatgaatgtgaactggatgttttaatttggtccgagatatggctggagaggaatggggaatcggagtggtggacgtggggagaaatttcgtgaagtttttgagggtgggttggagcagattgatgaaccctagcttcgtcggcgcggttctgtactgtagcacggagtggggaatggcgagagtctcagcggggaagacgaaacaatgtttggacttcggtgtttttagggtattgggagtactaatgggcctgggcctgtacagtatttcagcccaattatgtttttagcgtggcccgttgtgatccctagggacttaggcgctttttgctttggcaatatgtgctcacaatgatgtggcccgatgctgttaaaatgcttttttacgcgattcaataattctttggaatgattatgatgcacatgaaaaggtgcccgacagaaaggtgttataccatttttgtaagcttttttaggctacaaaagttgttgggttaatttgagatgactagtttattagtagtcattctcctagcatgttatatgcttattttgattatggtaagggttatagcctaggctaatgaacttcttaattaccatgatctttatcatatttggtggatcattttaagagtttcttactcggattcctaccaaatatatctatttttggaccttttgagtgtttatcattcggcccttttcatattttttgtccttgatatattcaagtaagaaggagtcggctgggtattttattgagtaccatgcatgcttcgatataaaatcactcgtttcttgactatatgtttagtttttcaactaatcacatagtcgggggtacacctaattaggtgcatctactcgatgcaccatgttttattttcgcccttcacagtcttttagcactcggcaagccgaagcaagttgaattgaagcactcggattattgttttttgtttcgagaagactattttggtcaactgcgaaggtctcgggggctactgtggagattatggttaccccatatctacatggcggttatattccagctggatatacggtaccaaatatagatagaatatctttatgaggactcgggttagattctaaacttgtatgtcaagaaaatacccgggatcctagtcggttacgattgtattttatctacaatcccatattccgttaggatatggactgtactttgtaatacggatcccttcccctatataaggaggggtccgggttcctctcgggacgattcttttttctcccaatcatacaatcaataatacactcggcggaatcatcctcggacaggagtagagtattacttcttgaataagaaggcctgaacctgtataaaattccttgtctccaaacccatccactttcctagcttgatagccaccccctttattattgtcgaaatcttgtttcgacagg

SEQ ID NO: 52709 - DNA, 1501 bp, Oryza sativa
ccgccatgaatgtgaactggatgttttaatttggtccgagatatggctggagaggaatggggaatcggagtggtggacgtggggagaaatttcgtgaagtttttgagggtgggttggagcagattgatgaaccctagcttcgtcggcgcggttctgtactgtagcacggagtggggaatggcgagagtctcagcggggaagacgaaacaatgtttggacttcggtgtttttagggtattgggagtactaatgggcctgggcctgtacagtatttcagcccaattatgtttttagcgtggcccgttgtgatccctagggacttaggcgctttttgctttggcaatatgtgctcacaatgatgtggcccgatgctgttaaaatgcttttttacgcgattcaataattctttggaatgattatgatgcacatgaaaaggtgcccgacagaaaggtgttataccatttttgtaagcttttttaggctacaaaagttgttgggttaatttgagatgactagtttattagtagtcattctcctagcatgttatatgcttattttgattatggtaagggttatagcctaggctaatgaacttcttaattaccatgatctttatcatatttggtggatcattttaagagtttcttactcggattcctaccaaatatatctatttttggaccttttgagtgtttatcattcggcccttttcatattttttgtccttgatatattcaagtaagaaggagtcggctgggtattttattgagtaccatgcatgcttcgatataaaatcactcgtttcttgactatatgtttagtttttcaactaatcacatagtcgggggtacacctaattaggtgcatctactcgatgcaccatgttttattttcgcccttcacagtcttttagcactcggcaagccgaagcaagttgaattgaagcactcggattattgttttttgtttcgagaagactattttggtcaactgcgaaggtctcgggggctactgtggagattatggttaccccatatctacatggcggttatatttcagctggatatacggtactaaatatagatagaatatctttatgaggactcgggttagattctaaacttgtatgtcaagaaaatacccgggatcctagtcggttacgattgtattttatctgtaatcccatattccgttaggatatggactgtactttgtaatacggatcccttcccctatataaggaggggtccgggttcctctcgggacgattcttttttctcccaatcatacaatcaataatacactcggcggaatcatccccggacaggagtagggtattacttcttgaataagaaggcctgaacctgtataaaattccttgtctccaaacccatccactttcctagcttgatagccaccccctttattattgtcgaaatcttgtttcgacagttggtgcgccaggtaggggtagcgtcaagttctcaccgactaagtgcga

SEQ ID NO: 52710 - DNA, 1322 bp, Oryza sativa
ttcacattaaacaacgacggttctgtccactatccattatgatcccaaggatagcttcccgccattgagtcggtatggttttctgagggcgtccacattcccgcctctcaggaagtggctccatcagcataaaaatcatcatgcaatatcccatcccacacaagttaaagaatttagagtctagccaagtgtaatacatgtcccggtgctcaataacaacgagcacggctattcgaatagatttggtttactcacactacaatggatgtacactttacccgcactccgcgactgcccaacacatgcgcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaaatctcacacacatattaaattatggttcaagttaagttctctctcacacacactcatggcagtcctaccaatgacaacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagtagtacggttgtacgggggtcgtttcatgcttaacttcatggctcagtccttaattgactggggacgatactagccttttccagataccacccaaatcctccgtccgccccagtcttaaacagttgttttgattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaacatggttgcaaatatttaagggtaaacaataaccaaggcatggcataatcacaagtaggatgttcatcattgcatgcaatttttatttgtaaacaaaacaatttcgcaattaggatcaacatgttcaaggaatagtgatgacttgccttgctcaggatagtccttattcttgatataattcttgatcaatcttcacctcctggaagttgctgacattgcctcacgactaaccgatacacaaagtctataatacgcgagaaaaaccaatattcaagcaacaatcaaatatgcacaaacaaaatatatttgttgaggttaaac

SEQ ID NO: 52711 - DNA, 349 bp, Oryza sativa
ttcgaattgtataagttaaattttagcttgcatgtttgaaaaaagatactcatatattgatctatttaaaaataataattttttaaacgacatgcacaacaagagaacgtccccgaggaaaaaaatccacttcctatactccgtgacatcagttgctatattatattcctattcctagtcggagttgtagtagcgtttcagttcgtacgtagagtccgagtcagcttccacatcgctcatatatatgccgcgtgtttcgtaaccgtcagtgaaacccttcgcgcgaagcaaagcaaagcaaagcaaaaccttttttcccgccaagaaacctcaatggcggcggcgaaga

SEQ ID NO: 52712 - DNA, 1501 bp, Oryza sativa
ggtcgttcgtcctcaccggctcatcgtctcgcggcgccgcctccgtcttcggattcacagcggcgtgttccatgccgtcctcgtcgccgtgcagccactgccggctgcccacgtcgcctcctcgccggccccggtcctcgtcatcgtcgtcctcccgtcgttcccggtcgtcgtggcgttcgtccctccgtcaagccgttctcgttcgtcgtcctcgctacgtcaagtgccgcagccccgtcattgtcttcgtcctcgcctctgcgtcgccaagcgttgcgccggccacgtctcgcctttgtccaaggatcgccaccggagtcgtcccctcgcctttcgtctccatcgttcccggccgtctccgccgcgcccgttcgtcgttgtcgttccctcgcctcgtcacgtggtggtaaggatctctctccctcgtcgccctcgtcctcgtccttttggtgtcgcccgtgcccgttgtgcggttgtcgaccccggtacccgtgtactggtgtcggtagtcgttcgcttgtgcgtgtggtgaccgtgttagtgtgcccgctcggtagccgcgtggtttccacgtgtgcagcccgcgtggtgtctagtggagtccgtttgtcggccactcgcctcggttgacacatggggtccgcttccgtcgacccgtggaccatctctgtgtacccggtctgccgtggtcccttaggttgacaagtggggtccgcatgtcaacggcgcagccttcctgtcttttccaggctagcgcttatacatgttttatagttgtaaaacctaattataataatccgcaaatctccatataacagcattaaacttcggatgaccatgcattggtcatacgagctccgaatcgatccgttcaagtctcctaatgtttgttataacctaaagaaccctgtgctttatttttatgtattgttattgcttctttataggcttgtagctttgcttgtgtgcttcgcgtagcttctgtcgttcctgagtttcccgaagcgtggttcgcggtcgtcgccgaaggttcggaaggccattatctttgagcaaggcaagtcacatcatccttgagcatattgaatcccagtttataaaattattttgatttaaattattgcattatcgctttattcaaattcccgcattatcactattttatttagccatgcctatttatctttgttatgaccttatcattgttgttattgttattattaccttgttcaccctaggataaacaaaactccaactagtgggtaccctattcatggttccactagtatgaatttaggtagatgcttcgctgactaattaggcaacattaggtggttttataactttagactttgggaattctcatatcatttggacactatggtatggttggcttatgttggaattggacacacacctccccctctattcaaaacccccaaaatggttttaggctgggctcgaggtccgtggttgggttttgttagtcgtacctcgg

SEQ ID NO: 52713 - DNA, 422 bp, Oryza sativa
tttggtctttcctttatagttgcaaggggatatcacaatgatcggtttcttacaaatgggcctcaacataggggttaggtatatgttggtcgtggttcttcttggtgagtgggcctggtcgtcaagcctagatggaacggagaccttgccgacccgccgcgtgtcctgagcatgctagcaaagcttagagtagaagcctgaaacacggttgacgcccgtgggcccgcctatcagccacggataagagaaactgcgagatggttgtggctccagtctcgcggcatggcagtcaatcatactgcctgacagtccacccttatccacacaagggtggtgaaagcctatcgcgaggctggtgtgcattgtcttgtcacgtgtcgttctggtggcgtgccgacactagtggagaaaccgtttgtagt

SEQ ID NO: 52714 - DNA, 1501 bp, Oryza sativa
tgtttaatgcaggcttcaaagaaaggccgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggtacccggccaacagctttcaaacggccacccgggcctggctgatcccatcagccgtagattttccaaacatcaaacctattccacaacagcaaatttcacaaggcagtagtcaaacaaaactacgctaggaatcacctcacatccgcccatgaccatgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacattccccgatccgcagttttggaaattcatttagtttgcaagcaccgacccaggtgtcgggttttctaagtcttttgtaaaacccaagttttacccaagatgtttctcagattttaagtttgaaggcgaccgtcgatacccgtgcagagtgcacgattaccgaggcgcaactaggtgggtacaagcgaacatggtataacaattacaatggaagggtcaaatgcaacaaattaggtaggtccgccaatctgccttgcagacgggacaagcagattaagtgtgatcctatcaatgcataatatttttcaggcaacataattaagttcaaatataggctcaagatgttcaaaggtggcttgcctcgctcgagatcttgagcttcatcctcgaaatcatcgcactgcgggtcttcgggctccgaaactacacacgaaacgggacaactcagcaaacggcgaaaataaagccctattattgacctctaagcatgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcggcccaagagaatggggcggctcggccgagcttaatgggccggccggccaaagaaggcggcccaagg

SEQ ID NO: 52715 - DNA, 847 bp, Oryza sativa
gcgaatgaacgtgaacgaacgtgaacgtgaaatgcaatatatatatgttacttcgcgtttatcttaatacatctttttgtatcttgcagaaaagacgtgttgtcgaagtcgtccctcaagccggagtggaagagctagccctagaaggaattcgtgcaggcaagtgacgtaataatataaatgattgttatatttgtaatgcaattaagattattatatttgtaattagacttagcatataagattgtgtagtgttctaatattatttgagttttaatataagattattttatttgtaattagacttagtatataattattgactatgaattggtgcgactcctagcaattgactattttagtgttaattagacttagcatatacgacagttacacttagcatacatgactattttagtcttagcatgtaatattatttgagttttaatataagattattttatttgtagttagacttagtatataattattgactacggaattggcttgtgcgactcctagcaattgactattttagtcttaattagacttagcgatacgaaagttacactgagcatacatgactattttagtcttagcatgtaatattatttgagttttaatatagattattttatttgtaattagacttagtatataattattgactagctagggtcgtataatatacgtcacctagacttagcttatatcatgatttgtaattagacttagcagtaaggttgtgtagggttctaatgtacgacagttacacttagcatacatgacttagattgttaaaacataaatgtctcatgacttagcagatgtttcttgtatcaccaga

SEQ ID NO: 52716 - DNA, 1501 bp, Oryza sativa
aagaaaccgtggttaaatctataaatgatagccgatcggctaagtgccgatgacatgtcatttatccttgagccgatatcatgtgtaaatcgatcggtagtcataaataaataagaaagaactatatccactcgatcggctgtagatattaacaatatataatccttatatcgatatatatttaaatcaagtgattgggatagatcggtcgccatgccgagacagtataaatcatttagatcgaaatatatattaataataggattatatatgttcatagcatagccgatcaaatggatctagcatgtatcggctaatactccgataccactctatactaagatattaagacaagtagaatatatcaaataaaagtctaatatacttaaatgcaacaagatcttaatataaaggacagatttaacatatcaatgaagcatatagagtaaatatagttaaatcagataagatcgactgaaactccgatactaccctaatcggcaaccagaagacaggctagagattgatattctaagcacgacctaatagatcaaactcaactgatgcagcattaagtatgaaaagaagaacaatatctagacaatcaagcccctggaggtttcgtagagtggtggatatcctatataatctaagtcaacatcgatgtttaacctaatcggctgccctctaccgacagatgttagccgattgtaggttatatagcgatattgtcagagattatgtaagatatatgataactcaacgaattacataaacaagatcagagtatcataaagatggaagcactaatcccgagaacgcaagtcgtcataacaagttttacataaacaagatcgaaaccgatgcagctcaacccgaaagcaagaactcgtcgaaataaaactaaagcaaaagggtggcgatgcgccgaaattgtattgaacaagtgtgttaattgattacatggggttcggggtctatttatacccaaaaattacaaacaatgtccatatcgaacacgactcttatctctaacaaactctaaaataccataagtctttatggcagacttttgcccaaacatatctctaaggaaattacataaaatatcctaattaatagatacaattgccttctcaggactctatccatgtgtggcaatcatcttgaagcatatcaactcaacccgatgtcgtataccaagtcgtattgtcggaatcgaccgtatcacctaacctagtctgactcggacttagccgatcccaatcatagccgatccggactccagctgattcttactatgttctcgaatcgatcttcgcctttgactcagcttcggcctaatcctcttttccgatgctgatattaccaaatttggtcgttaacacgaccaaattgcttttatctcagccgctcgtctgtgtattgatgagacttatctagtgcaagggcatattctgaaacatggagtagatggatctttgatttactttttctctgg

SEQ ID NO: 52717 - DNA, 1501 bp, Oryza sativa
ccttcgaatgtatgagcgtgccagttgatttgatcctgtaatcaacaagaaatagaagcaaagaaaccatagttaaatctataaatgatagccgatcggctaggtgccgatgacatatcatttatctttgagctgatgtcatatatgcatcgatcggcagtcattaataaataaggaaggactgaatctactcgatcggctgcaagtattaccaatatataatctttatatcgatatatacttaaatcaagtgattgggatagatcggtcgccatgccgagacagtataaatcacttagatcgaaatatatattaataatgagactatatacgttcatagcatagccgatcagatagatctagcatgtatcggctaatactccgataccactctatattaagatattaaagcaagtagaatatactaaacaaaagcctaatatacttaaatgcagcaagatcttaacgtaaagggcagatttaacatgttaatcaagcatataggataaaaagtagttaaatcaggtaagatcggctgaaactccgatactaccctaatcagcaaccaagaagtaggctagagattgagattctaatcatgactcataagatcaaacttaactgatgcagctataagtatgaaaagaaggacaatatctagacaatcaagctgttggatgtgtcatagagtggtagatatcctatataatctaagtcaacaatggtatttaacctaatcgtctgccttctattgacggatgttagccgattgtaggttggatatcgatattgccaaggattatgtaggatatatgataactcgacgaattacataaacaagattagagtgtcataaagatggaagcactaatcccgagaatgcaagccgccataacaagttttacctcttgttgaagatcgaaaccgatgcagctcaacccgaaagcaagaactcgtcgaaataaaactaaagcaaaaaagggtggcgatgcgccgagattgtattgaacatgtgtgcttttttaaagttacatagcgctcgggtctatttatacccgaaaattacaagatatgaccgtaacggacacgacaactatctctaacaaactctaagataccacaagtctttgcggcagactttacataaaacaccctaattaatagacacaattgccttctcaggactctatccatgtgcgccaatcaccttgaagcacttcaattcaacccgatgtcatacatcaagtcgcattgtcggaatcggctgcatcggcttgcctagcccgactcagacccagccgatcctaatcgtagccgatctggactccagccgatttctgtctgtttccgaactcgatctccgcctctgacttggattcgatctaatcttctttcccgatgccgatattaccaaatttggttgttaacaccaggctggtgtgttcgattttttttgtcaacaggttcataatcgattagttcaatgacatccacttcttga

SEQ ID NO: 52718 - DNA, 1501 bp, Oryza sativa
gagagatgaaaacatagagttggcgatgaacttttaggagagaaaacaaaaagactaattcattatacatgcttgcttggaaaatataacacctccttatttatctatttataaagaactgctaacagattagatctagagatacgtcaaattaaaccatccaaaaatatgttgcgctctaataaaaactacttatcttataacaaaacaattgatccactaagtatcaactaactaaagtgtttcaaaagccatgtgctacatgatgagccctgatgggcttcatgtcacataacagttgaagtcatttttcatatcattacctggagctgcttgcaaataacgtctactatgactgcacctagcaataaactgcagtttgaatagtaatagtgcacaaggactggatgttacaatactatgaatgatttatctgcatattaactagcctgcaacctactaacttacatcaataaagcccattcaacaaaaaatggatatggtatattggtgatgaattgaagtgagtgaccatgtgtctttaaggaaataaggggagtggactacatagtacatacttctatattcattcttcaattaatgaaaaggatggcaatacctccatgttaacaagggcatattaacagattatatatgtactatgatagaaatagctaaaggaagcccagaatacacgtaattgctatctataaaaccactagctagacatagtggatgctattggtggttatacaagtgaatgatagaccccaagttacaataccataccatgccacatgaatactcacatataaaataattttccaaatctgattggacagaacaacaaaaccttaattcaacatttcaggccgctaagctcacatagtttttttttttttacttccattaccaagcgattgaatcacaaaacatcacagatgatgtacagttagaattttaccacaggaaagttcagaacatttgaaaaagcaaacgattaaaatatgaaatataattcataaattttggaaagctagactgggtaagggaaaaaatcaccacaagaggacatggtgaagaaagcaattaaactcaccaatcactgtgaacaccgtcataaaaatgcatgccctaaacattaggcaaaagagattaccttaatttgcagcaggatacaatcatgcagaacaaagcaaaatacccccgacagaacaaaatacttctgctcttaagcattttcaggagatccatttctctgtactaattgaaaacgccaacagtcacaagtcaccaaacaagtcatcattatcatcagctgaatttgtatccatattcccactagacttcttttcatcagcagctttgactttttctgcctggtcatccgacctgtatgcccaagatgggcccaatagttgtggaacagtatccccataaagatcatcataaattccaccttttgctgtgcttttaactttggtaagaacctgttttagct

SEQ ID NO: 52719 - DNA, 401 bp, Oryza sativa
tggacttgattactattaccttccttcagcgtaggaagagagatttcattatatgccactcctaattggtttgtagggtgagagggggagaggtggcaatggtggctccaaaggagggcactttgcaggcgttggcgtacttcatagttcccagtgagctcccttccgggtaaggccataaaaaaatcctcatctccattattgttcaacaggaggagcaagaaactaggtcagaagcgatttagcaagcaaactaatggtcttcctctcatttttgtttttcctatatgataggatcgatcctgatgcggcgtttattgtgtgtgttcggtttggtcagtacacagctaagcttgatgatggtagtagtgttcatgtgccaagcaaatacgctgaatggg

SEQ ID NO: 52720 - DNA, 1501 bp, Oryza sativa
ggtgacctgagcttgtacttgggcttgggcagtggcgacggaggctttatcatactcagcctgaattgcttgccgtcgcttggaatcttcttcgccccttgcgtacccgttgatgatgcgaagcaggtgttcaagcatctgcggctctttgttggcaatttttcttgtgagtacgccctcgagcagccctgccaaaatggcgttgatgactgacgcctccgttatgtcttgtacttgacaccgggcttgcgagaagcgacgcatgtactcccttatcgattcccccggcctcaggcaaatgccaagtagatgctgctatgtcttcagctcctcgtaggtgcctcgaaagataaggacaaagacatcgcgcaattgctcccatgagtaaatgctgttggctggtaaattgaagtaccaagaacgggcgatgccatctagagtgagatgtattacctttcccttggtattttggtcgccatgagccgcttcgatcgcggactcgtagatggagaagaattcctttgggtcagtttcgcctgaatagcgtgggacgggtgggaacttgaactggggtgggatcggacggatcttaattcccccactcagtggtagccccttttcgccccctgccctattcacggcaccttgctgcggatatggtgtggcgaagggcgaggtcacggcctgcacgtgaggttgaaccacggtgttcagttgcctggctctgattggtgctgtttggtgagccgccatggatgggtcgaacgttggctggggccacaccatggcggcctggtttggtgcttggtttgccccgaagcctggtgttgtttcttgcggccgaaggtttggtgcctgagcagtgttgatgaagtcgaactgcggtccttgactccaaggcgaagcccccagacccggctgattccacggcaaccaactgggcgcaccttgacttgtgttccccttcggctaggctgaaggggttgtacctgaaatgttgtggggttggctgaattgttgaaggaaagcttgaacctacaccgaagccccttctgccatcgcttgtgacacttggccaagcggttgagagtgtgtttgggcagcgaccggctgagcttgcagctgcacgtgaggggccggatgtattgctgcggtcgaaggctgcctggtgaagtatactggcgcttgcgtggcttatgacggaaggggctggatcggtgcttgtggatagacttgggtgggatgtagccttccgaatactggaggattggggcctgaaagtgtatctaggcccctaatgattttgatgattgattacaatgcgattagagaggactaacacttttattcaaacaagtgtgaaggttgttatgtcctcgacatgttgtaatgagatgcataccccatgaatgcgacatcacgatgcaatgcggcaatgatcaaatggtatattgtatcttttaccttgcattatgtcgtactattaagagggataccacat

SEQ ID NO: 52721 - DNA, 1501 bp, Oryza sativa
ggtggataatgcaatggaattttgcttcttggaggaccaagaaacaagggaccgcctgtcgaaacaagatttcgacaataataaagggggtggctatcaagctaggaaagtggatgggtttggagacaaggaattttatacaggttcaggccttcttattcaagaagtaatactctactcctgtccgaggatgattccgccgagtgtattattgattgtatgattgggagaaaaaagaatcgtcccgagaggaacccggacccctccttatataggggaagggatccgtattacaaagtacagtccatatcctaacggaatatgggattgtagataaaatacaatcgtaaccgactaggatcccgggtattttcttgacatacaagtttagaatctaacccgagtcctcataaagatattctatctatatttggtaccgtatatccagctggaatataaccgccatgtagatatggggtaaccataatctccacagtagcccccgagaccttcgcagttgaccaaaatagtcttctcgaaacaaaaaacaataatccgagtgcttcaattcaacttgcttcggcttgccgagtgctaaaagactgtgaagggcgaaaataaaacatggtgcatcgagtagatgcacctaattaggtgtacccccgactatgtgattagttgaaaaactaaacatatagtcaagaaacgagtgattttatatcgaagcatgcatggtactcaataaaatacccagccgactccttcttacttgaatatatcaaggacaaaaaatatgaaaagggccgaatgataaacactcaaaaggtccaaaaatagatatatttggtaggaatccgagtaagaaactcttaaaatgatccaccaaatatgataaagatcatggtaattaagaagttcattagcctaggctataacccttaccataatcaaaataagcatataacatgctaggagaatgactactaataaactagtcatctcaaattaacccaacaacttttgtagcctaaaaaagcttacaaaaatggtataacacctttctgtcgggcaccttttcatgtgcatcataatcattccaaagaattattgaatcgcgtaaaaaagcattttaacagcatcgggccacatcattgtgagcacatattgccaaagcaaaaagcgcctaagtccctagggatcacaacgggccacgctaaaaacataattgggctgaaatactgtacaggcccaggcccattagtactcccaataccctaaaaacaccgaagtccaaacattgtttcgtcttccccgctgagactctcgccattccccactccgtgctacagtacagaaccgcgccgacgaagctagggttcatcaatctgctccaacccaccctcaaaaacttcacgaaatttctccccacgtccaccactccgattccccattcctctccagccatatctcggaccaaattaaaacatccagttcacattca

SEQ ID NO: 52722 - DNA, 1501 bp, Oryza sativa
aacccatcgcacttagtcggtgagaacttgacgctacccctacctggcgcaccaactgtcgaaacaagatttcgacaataataaagggggtggctatcaagctaggaaagtggatgggtttggagacaaggaattttatacaggttcaggccttcttattcaagaagtaataccctactcctgtccggggatgattccgccgagtgtattattgattgtatgattgggagaaaaaagaatcgtcccgagaggaacccggacccctccttatataggggaagggatccgtattacaaagtacagtccatatcctaacggaatatgggattacagataaaatacaatcgtaaccgactaggatcccgggtattttcttgacatacaagtttagaatctaacccgagtcctcataaagatattctatctatatttagtaccgtatatccagctgaaatataaccgccatgtagatatggggtaaccataatctccacagtagcccccgagaccttcgcagttgaccaaaatagtcttctcgaaacaaaaaacaataatccgagtgcttcaattcaacttgcttcggcttgccgagtgctaaaagactgtgaagggcgaaaataaaacatggtgcatcgagtagatgcacctaattaggtgtacccccgactatgtgattagttgaaaaactaaacatatagtcaagaaacgagtgattttatatcgaagcatgcatggtactcaataaaatacccagccgactccttcttacttgaatatatcaaggacaaaaaatatgaaaagggccgaatgataaacactcaaaaggtccaaaaatagatatatttggtaggaatccgagtaagaaactcttaaaatgatccaccaaatatgataaagatcatggtaattaagaagttcattagcctaggctataacccttaccataatcaaaataagcatataacatgctaggagaatgactactaataaactagtcatctcaaattaacccaacaacttttgtagcctaaaaaagcttacaaaaatggtataacacctttctgtcgggcaccttttcatgtgcatcataatcattccaaagaattattgaatcgcgtaaaaaagcattttaacagcatcgggccacatcattgtgagcacatattgccaaagcaaaaagcgcctaagtccctagggatcacaacgggccacgctaaaaacataattgggctgaaatactgtacaggcccaggcccattagtactcccaataccctaaaaacaccgaagtccaaacattgtttcgtcttccccgctgagactctcgccattccccactccgtgctacagtacagaaccgcgccgacgaagctagggttcatcaatctgctccaacccaccctcaaaaacttcacgaaatttctccccacgtccaccactccgattccccattcctctccagccatatctcggaccaaattaaaacatccagttcacattca

SEQ ID NO: 52723 - DNA, 283 bp, Oryza sativa
ttatttctacggtgcttcgatcttcgacttttctctcggtttctcatctctggaaaaccgaagaacccacacaaccgatcaatctctacgaccccatcctcctgcatgaaaccacatcgtggaggccctccgactggtggaaaagcccattaataccatcagttcttaccaacccctattgccgttaccaacccctatcactgttaacaacccctatcgccgtagcctatcaaacccatctgaccaccaccgcagcccaatatattgccatgctgctcgcagg

SEQ ID NO: 52724 - DNA, 1501 bp, Oryza sativa
aaaaagttgttaagcctatcataccatgctctaggagcttgtttcaagccatacaaagctttagacaatttaaaaacatggttgggaaaatctggattttccaaacctggtggttatttgatataaacttcttcctgtataaaaccatttagaaaagcacttttcacatccaattgatacaatttaaaaccttttgaagtagcaaaagccaacaaaagtgtaattgcctcaattctagcaacaggagcaaaagtttcatcaaaatccaaaccttgagcaacaagtctagctttatttctcacaatcaaaccatcatcattttgtttatttttgaaaacccacttggttccaataatattatgtccagaaggtggtttgtcacgcccggaatttctatccaaaattccaaacgcttacatatgtgtgaaccctcgtccaggaatcagccgaggcacacaataacaaattgataattgtcacatcctgattttcgtttcaggatttataaattatttaataaattattattagaatttatattaaatgatctttaatttacaagtgaagttaaatgtgggaaataaaatttcctaaatataaagcatggatggatttaatttttattaaattctccatggttaattatactctctggaattttctcagatttttcgaagctcaattcctaattttaatcatacaaagagcatttcagtaattacccacatattaaattaatcattaaatggtctaattataattttgttaagtactttgagtccaagtattttcaggatttttcttgaaattatttgggcattggaagtatttttaacaattcaaagatcatttcattgattaatttaattcgaaaagtaataataatcctcttcctagtcttgggccctttccagcccatctccctcttttgtgtgctcggccgtacagcccaagtcggcccagccgagcttcccccttctctttctttctttgctttgttttcagccagcccaacacgaaaagtctaatttgcctccccttctctctcccttcctctcagcccgcatagaagtctgtttttcgtccctgtcgctacagtgctccttcttctacctccagacagagcccgagctctccagcccgtgcacagtgccgccgcctcctcccaccaatctcgcctccccgttgctccttttttccaattttgttgaggggaaatattcctcttatcctcctctatctttacccccaaaaaatcggagctaatcgttgagtatctcatccgaatcgaactcgttttcgagtttatctccaaaaccgagtttttgatttcccggatcgatttcttgcgggaggagtccgatctcttcaatccaaggatataaataggaccccctagtcttcctctttcgtttgcccctctcccgtggtctcccgtgccccatagcctctccgccgccgccgccaagttcgccgccgccgccggccgaacttcggccgt

SEQ ID NO: 52725 - DNA, 1501 bp, Oryza sativa
aatattgatgtctcctagatcttcttaactgtttgcaggtatatccgaacttatcaatgtagaggcatgggaggtacccttatgggtttcatccaacaatccttatcttgatccgtaaaaggcgtatccaaactcttatccccaactactgtctcattggctttttaatccaacacagtttaattggttttcttttccatcaacaggttggttattaactcgaggttagaatatagttcctctgacacgagaccctaggtctcctttattagtaagcaattatacacataatcccatatccgcatcttccaaaagaatcctcatagaacatgtctatattacaaatttctcccttattaatgaatactaagcactgcctaaaaggaaaggtgcttagcatcggtacattgtttctgctatgggttatgattaacacgaggcctcacaggtatggcgtttgctccagtgaccacaatacgattaggatgtctgcttcgtgtaaattggcggtaatgtggaggccgactttgccttggttgtagacagtccctcaagtcatgccctggttctttgcagttgtaacaaatcaacgtcttctttattgagctgtccgtctggggacgatcattctgacttggagttggaattggtggttggaaatccttgctaacattggcatcagtggtaccatagttgctatcacaatttctagggttgtcattctgggtgccatcattgatactatcgtcgacaccttggtgaatgatgttgacattgcacgcttgattcgagtggtcactaatggggcaagaagcatggttgttggtggtatcatcatcattagtattgctaatgttattgtctgcattgtgtccgtcttcttggggcaggaactcttgatgcgcaatagaagatccggtgatctgaagtggctcagtgcgctgtctttggttaccacatggaaatgttgggatgctgacaatccttctcttgcagttcttcatccgattatgctcactttcgagttgtatggttttgtccacaagtttctcaaaatcttcatattcctctaggagtagttgcactgcgatctcatcttttaacccctagagaaacttctcttgtttgtcttcatcagtttccacatcttctggtacatagtgagccaaacgatggaactcatgcaggtactctgtgacggtcaaatcttcttgcttcaggtagcggaattctcgttttctcagtgtgatcattcctgcgggaacatgtgatctcttcaacacggctgaaaactcatcccaggtgatggtatgtccttctggccgtgatgcttcgtagctatcccaccattctgaagctggtccaaccaactgatgagttgcaaagacaacccgctcctggtctgtgcactgaatcaaccccagcttcttctcgactgtgcgcaaccaatcactagcttccataggatcgacggcaatggcaaaggttggaggcttagttt

SEQ ID NO: 52726 - DNA, 205 bp, Oryza sativa
tcggtccccataattatatcgcagtgctacaaacaaccaccaggaaccaacttgtgtgcttaccacgtgtgcgacatgctcagagtaaatggtaggtacaaaacaaccagtaaccgagtaggtcatcgaactcttctctacaaagaaacccatctcgcacacacttctcactgagtaccgttttattttcctttctgtgtgcaga

SEQ ID NO: 52727 - DNA, 261 bp, Oryza sativa
tgcataaactaggtaggtggatgtaatatggtgcaagatcttgagaaatgagtaatctagcgcagcaacatgccaggtacgtgctatttactatcaattcaggataagtgataaattaaatacgcctgcatgtaaggagggcgcgtctagagtatcatcattcaaaacgttatccgtcgtctgaactaggtggtgcacataaaaaatgtgaccataataaaagggaaatcgaactcatgtaaattcagtgtaaacatcatt

SEQ ID NO: 52728 - DNA, 1027 bp, Oryza sativa
ctatagggcgaattcgagctcggtacccatgtttacttgatatctatcctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccacggttatgggcggtcgaccagattcaccgtgattagtcccacctcaataaatcgacctaatacactgtagtttaggtgggttggttgggcctgttcaacgtggtgtagcgttgatcagtggagatttaatgttactttaattactcaacggttttactgttttgctcaataaaatgttttacacccgcctttatgcaaatagccacaaaccgtccttgtgttccccttgcacgtctgcatcgttggtgtggcttgctgagtacggaggttgtactcagccttgctattatttcccccttttcagaagtgtagtgcttctgagctgaagat

SEQ ID NO: 52729 - DNA, 252 bp, Oryza sativa
attcaccgtgattagtttcaccttagtgtaatcctttaatttggatagtttaggtggatggttgggcctgtcgcaacgtgggttagcgttggacagtggatagttaatattaattaattattacaactgtttaaatctttcaatctctgtttataaatgctcgctttatgcaaatgaaccacttcagctcttctttgatgatttccctgcatcatacccctattccggtatgacttgctgagtacagtgggt

SEQ ID NO: 52730 - DNA, 485 bp, Oryza sativa
  unsure (1)..(485): unsure at all n locations
gtaccgatgttaagcaccttcccttcttgtttaaggcaaggccttgtattcatgtaataagggagacatgtgtaataaaaacaagttctatgaggattatttcggaagatgctgatatgggattatgtgtataattgtttactgtcaaaggagacctagggcctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagcttttgacgaaccacttgaaggtttttttgaaaggccgcaggctcaagtaccacatcgtcaccaaaagcatncacaactcttcgagtgaaaagtacttagttgacaaaggtcgaaaaggtgataaaagtcaaaggtgtaaaaggatacgttgaatgcttactgaggacaaca

SEQ ID NO: 52731 - DNA, 373 bp, Oryza sativa
catgatttttcgtgcccaactttgatcgtccggcttatttaaaaaaattttgaaaaaaattaaaaacatatgtcatgcataaagtattatttataatttatcatctcataacaataaaaatactaattataaaaaaaatgtaaataagataagcatttaaagttggacacggaaactcctggtttcatttaaaatgagacggatggggtagatgctaaaaatggagttgttttgtgatggagagagtaagtatttagggggataggaattaagttggggatggattttaatccctaaggggatgtcccctcgtatatatttttcttccaaattccaaccaaatactttaaagaaaaccatttgaaaaaaaaaa

SEQ ID NO: 52732 - DNA, 463 bp, Oryza sativa
aaaattttagaaattatgtaactctaaattttccatcaccccaattacgtcattagcatatatacatcatattacatttttactccacagccctagctcaaaatcttttgactctaggggcattctcgtatttttgaagaattgatctctccaattgagacaaaagtgccatctagcaaattattaggttttagagtgtcttttttccgtggcacatttttaagatttctaccagcaaattacacaaaatttaagtgtattgtatcaaattttgcctaaaatttatgagaagactagctatatagatattaactgttttactgtgagttattttatcatttaagcatggcttgtctttctatatgtgtatgaattttggaataaaactgtttgatgaaaacaaaacaacgaacacacagaaaatagggaaaccctgtattttattaattatgattcattaaca

SEQ ID NO: 52733 - DNA, 436 bp, Oryza sativa
gaaaggatgggaagctgcatcccatttgcaaagattttgttggccttctgcaatgagatgtagccatgcacatagccacatagctgtgaggaaaaatgttatcttttcttccttttgtcatctggggtggtccagaaaaaacattatttgctgcagcttgcatgacagatggcaatatatgataatgctatatcacctctatcaaagaagtgtgctgaggtgataaaatcttgttatgcatgtttggaataagatggctgtctactcactgtttagatgcactttattttcttacattatcagcgtgaatcttgaagctgtacttatctgtgtgagattgctgtcatactcttgatgtatagatcttgcaaggaaattgtgtttcgtgcgccataaaattttgacacttttaagactattttgttggcatacaagg

SEQ ID NO: 52734 - DNA, 1501 bp, Oryza sativa
tgcagctggccaaaatattcaaccaatttggagcttggagctttgggagaagtggttcttctgttctttttttgtttaaatatgtaacttttattcaaccgatatgctcttgaaatttggccacgcccacatccaatgcctaggaggaaaagcaaatacaatgtatttaggcataaatcattgactcgagaaaggcatctctaatgatccaacttagcatgggcacaattttctttaaaacctcatcaaggtgtacttgtattaagaaggagggaacactgtacaatagccttatgggctaggagttacatgtaagaaaaaaagaaaagaagaaaaaggggattggaaggactatgggatgtccaacatgtccgagtttacagttgctttgttaagattatatgtagtgccaccttgttcgtttggcatcagggacttgatgccttttgctccacccgcatgccagaataaaatctcgtcggtcaccctatctatgatccgttgtagcggtagcttttcattcctgaattctcggttgttcctcttcctccatatttcctaggatactaggatgagaattgacttgatgcctgctcttttttttcctttgttgtcgctttgacgttttggctccaccattcctcaagggatggtgtgtcaaaccaaattctacggtttttgttggaggaggtgggtccgtgttgccactgtgtcctagactttcatggttgttggacactcattgaagaggtgatgtgccgttccgaggttcctccagaagaactgacataagtagttgttgggccattctttttgtagatcgtccaaatcatgttttgtagtagtagccatgcaaagaacttgaatttcgacggcgcccaacacttccacaccatacttgctatggccaagggggccccgccaagggattgcatctggtacgccaatttgacaatgcattatctatttctcttgactgtccatttctagcggatgctatccgcagtcccttgcgttagcgtgatgtttgcggtccatatgcattcaaacacttggaagaattcagcgacgagtgttatggactggtcgtgtctaatgtcatcaatctattcatcaccttttagggcctctgggactgcctgtttcttccttcttgagtgtttgtataggtttggggcgattgttctgagggggatactagaggctcaggttgtttttcaagagagtgcctttctgccgtctcccaaaaaacctttgtagaggctacaaatagatccatgtcttgttcgtcccctggtgtgggcatgcctatccatggtttgttcgagctaatccactcataccatagctagcgtagctggagcgctcgtccttttttattttttaacgttagagactctggatccaccatacttgatcagcatgcagacccttccaatacactttgcacttgcctccatggatctcattgcctccatcccatcccattggaattttctcc

SEQ ID NO: 52735 - DNA, 1501 bp, Oryza sativa
acagagtcgttgcaccgactgttctgaattcaatgtaacccgaaatgggcagcctaacggccaaacaaattaagaatttttgttcatttcgccctttaggatagtactatacaatagtaacaatggcctccgatccttccgttctggagttccctttcctatgttgagcgcgctattccagcgaaatctactataagaactaattaaagccacgttctaaaatgtggtttaaaacaaatgattagtcgcacgtaaaatgtgaaaagcgataagtataggattgattgagtattacttattgaaaactataaaaatggatttgttttatttttaatgcaacttcatttctacataaaacacaacgtttattagttaaacgataagggtaacagtacttgtgtacacaaatgcaatactttctgaaacttggagaaaattttacccggaataaatcctccgtccacaaccgtggcagtctggctcgatgacttgatctctacctctccttttcctcgtgacacgcatatagcgcgaggaagccatgctggctaccggcttaggccctatttagttcctaatacaaaaattttcacacttacatcgaatgtttggatacatacattgagtattaaatgaagataaaaaaccaattacacagattacatgtaaattgcgatacggatcttttaagcctaattgtgccatgatttgataatgtggtgctacagtaaacatttgctaatgacggattaattaggcttaataaattcgtctcgcggtttcctggcggaatctgtaatttattttgttattagactacgtttaatattttaaatgtgtgttcgtatattcgatgtgatagccaaacccaaaaattttcccgagctaaactagccacatagtcgcgtcgacttttgatcccgtttaagaacttttctaaatggtcttagtttaggtaagtttttaagaaggttttgatataataagttaatttttttatacagaattgatttccctagctaactgtatatttaactaagttgtactatatgctggttataagagaaatcactagaaggctcatgtttcttctctctttatcccctctcttttttatcgaataaaatttaaatatatacttttatttttaacgttttgcatttatatacatgtatggagaagaattgcgaaaatatacctctatgacagaatggagatgcgggacggaggtagcgccgctagctctgcgcagcgtccgcgcggcaccgtcgctcccgcggaacgtccgcgcggaaccgcacggaatgcctcgctcccgtgcgccacatacgcgcgaccggcgtggcaaagcaagcagcacttgcagcgcatgcattcagcgaaagcaacgcatgcattccttcgctcgatcggtcccgcactgctcttctgcatgaccgccggttccgcggaatggtggtgcgggaccgagatggtttcgcgtatcccctatgcagtagat

SEQ ID NO: 52736 - DNA, 1501 bp, Oryza sativa
attgaaataatcaaatgggaggaaaaggaacacaaataattgatcttctaactttggataaattttggatgacgtcaaaaatagatggaggtaaataactaggattttagcctccaaaatatggggtatggattctcgatgaaatatttgtggctaaacgaagttggactttgaatagaagggattggaaataagtttcttagcacaagagcaatcactcaattatttgtgatagtatagttcttgtgccgaggaggaaatcaagccataggaatcaaacaggcggcttgatcaaaataggaacttgacccttgaatgttttggatcgatgtagaggaaataaaggtttttggggataggtttagatagaggtgtgatccaaaataaattccaacaaaaagggagttatactggtttagtccaaagataaaaatggttaatgggatataacagagagtcgggtcaatcggggaagtattggcccaagctaaataataaactttgaaatctcgaatggataatttagataaacgatatttcaaaggggaaatatgtgtggaagataaaactagatttggtggtagtgtggtaaactctaaataaaaaggtattaactctagagagattgatatttcatgtgctctagagatggttgagcgggaattgaaagggtatttgttggaggtgttcgggaatagattcaaaggaaatataatttagagccaaagttagatattacagaaaacaaatggaaatgttttatagaatttaaaagggagctattaactttgcaaataaagtttaagtccaaaatcaaaggaaagattagaagcaagatcactccaatgcaagaatcgagaagagcatgacttaaaacatttcgcaaaaaaattcccctgaaattttgggtccgttacaatatccgtgattatttcattattatgacttctagatggatactaaacgtatgtaatacggttgtttgctactaatgaatcaagttggagatagcttggtctcggaatatgatttctttgtttatttcatgtgtaggtgactcgatgtctcgggagagtattcgcagtgatggacctggaatcagcttggggataagacgacgtccgtggtggtcagagatcatgcgggatactaaggctagagttgatgcacgtggttgatggagattccatatggcatacgatggaggtattgtgtgcgtatgggatgcggagtcgaatttggaaggagtccgaatttggtacgattggttatgtaaagttttttttcttgtactagagggtttcctaaggtgtttagaactcttagtatgagtttggttcgtggcattaggctaccgacctcatgtataaatagagggggagcgtgaggcttcccggtatcgctttagagagcaattgagttgagttttgagttagggtttcgagtttagtcgaatattttgtaaggagtgctgttggtgcactttgtaaacacagagaga

SEQ ID NO: 52737 - DNA, 296 bp, Oryza sativa
cacccaaaactttccgaactccccacaccaacaaacttcatcatgtataacattcaaaaatacccattttaaccggattcctaagtttgtaaagatgtttgaataataaaccacataaaatgatgttcagtatatctttccataatctcatataacaatgcttaaaagcattaaatatcattttaagccaccacaatgatgttattcatatgattaacttatgcataaagtaaatatgggggttgattatttcatgtggtaaaaattttaattgtgtcttgccttgtgccttaaga

SEQ ID NO: 52738 - DNA, 452 bp, Oryza sativa
tccgccgccctctacgccctcctctccaccgccacctcgacctctccaccgccgccctcgccgccgccaaatccgccgccctctccgccctctccgccaccctctacgccctcctctccaccgccgcctcgacctctccaccaccgcctcgacctctccaccgccgacctctctgccgctcaccctctccgccgaccttcccgacgccggcctgcaccaccgccgccgcactcactctctcgaccgccgccatccatttccaccgccatctccaccgtcgccgtctcgacctctccgccgccatctccgccgccctctctgccgccatctccaccctctacaccgccctctccaccgccgcctcgacctctccaccgccctcctcgccaccgccctctccaccgctgccgcctcactcactctctcgaccgccgccgggacctcctcttagt

SEQ ID NO: 52739 - DNA, 476 bp, Oryza sativa
  unsure (1)..(476): unsure at all n locations
gcctgtggagtggagtcgccccgctgcagaagtcaaccttccgagtttagctcgcttttatcttttccgctgcatttgtaatcttttatatttttgtaagacatggatatgtatgtcaacaattgtcgtttatgtacactggctggtcctggataggggtttaatgcatatccagcttggaaattctggttcgtgaatttctgggcgtgacacgcccgttgcgggtgacgtagcttgccggcttggagagggggtggagggggagggggaggagagggtggcggatcggaggaggaggagagtggggagggggccagaccgncagaggggagggggaggggagggcacggcggaggagggggccgcaggggacggcgggggagggggaggggagggcgcggctgaggagtgcggcagaagggctgagggggccgaggccgcagaggggagggcgcagataaggttaaggataagga

SEQ ID NO: 52740 - DNA, 747 bp, Oryza sativa
gattgtgaaaattgtgctaatttggaaaaagaggtgtcttatttgaaaaattctttgctaagattttctgatggtaagaagaacctcaacataattttggatcaatcaaaggttagcacacataatcgtggtttaggttttaacccttatgctcataattctagacatcctcttgttgtgttaggtgttggtgctagaagtggtgagattttggttaaacctgatactaacaaaactgtgtttaaatctgctggtatcatgtctaccttgagtgcatcttcttcaaaatccaatgttgtgcatgcaaaatctcctgttgttgcttgtgttgctaaatcttctaatactaccaatgtgtctaatcatcgtgaaaaatatacttgttcttttttggaaaagatggacatattattggtttttgtttcagattaactcataaacagaaaaaggagagagagattgcttttgcaaaatcaaagtggcaaaaatctggttttccctcgaggaaaccggtcagaccgcagtgggtcccgcggtcagaccggctactgagtgtcggttagaccgggcatcggtcagaccggcggtacagcggcggtcagaccggcccccggtcagaccggccactgtacctcggtcagacggcctcggaggaatttttctgaaaattctaaaattgattttgcacgtggatatatgcgtattggatttctggtcgtgtgtctcagtactggattcctaaatttt

SEQ ID NO: 52741 - DNA, 181 bp, Oryza sativa
atgctcgccctcgtcttctccaccacacttaaaaatttttgccccgaacgacctctctctgcttctccttcaccgccactgcctaaggcatccccgcgccgacgcctacgtcatatctcgccatcgtctcacgcacttcgtcttcgacaccttcatctactccgcctccaccgaatctcta

SEQ ID NO: 52742 - DNA, 1145 bp, Oryza sativa
aaaggggttttcgaacacaaatggaaaaactaatttcataactcgcctggaaaccgcgaggcaaaacatttgagcctaattaatccgtcattagcatatgtgggttactgtagcacttatggctaatcatggactaattaggcttaaatgattcgtctcgtgattttcctcataactgtgcaattagttttttaatctatatttaatgctctatgtatatgtgtaaagattccatgcaatgtttttgggaaaaaaatttgggaactagacaggcctgagcccaccaatatgggctgccatagttcctgcccatcaaatcgcaacaaaaaagaaaaattggagaggctgaagacagatggattctcaaggcagaccagtatggcaggaattcaattcggttggtcacaatctaagtgttacatcaaaggggcaagatactataaagatactataaaggggcaagatactatatcaaaccatgatactataaagttaaacacaaaatctaaatcgagggcactctcgatttagttgtaacgagcgactcctattcagatatgtgttaacttgaagaatcttactttattatagtcctaatccattaagtaactaggagaaatattcctatcatctaagtttcaaataaaattttctcttaattactcatccgattacaccgttgtgttcgtaataattaaatctttacaacaaagatctcacatgattatattttgataaaaaatcacaaattacttttatgatatgtctaaattacttttagatttcactaagttactgcttagacatataaaagtaaattcagtaaagcctaaaagtaatttacatatattatagtaactttaattaatgccttttttcattgaacaaattatcatatatataaatataagttacctttaaatttgattaaaatacttcctatacattcataatgctctgaggtgattaataaaagttaatttcataagttgtgttgattaattaaatttctagatagagtcatatttttatatctacaacggatttacttcaaatgacatgccaaatttaccttcgttttgttctaaggtacttctataatatatgtaaatttcttttaggctttactgaatttacttttatat

SEQ ID NO: 52743 - DNA, 1501 bp, Oryza sativa; identical to SEQ ID NO: 51043

SEQ ID NO: 52744 - DNA, 1501 bp, Oryza sativa; identical to SEQ ID NO: 51045

SEQ ID NO: 52745 - DNA, 1501 bp, Oryza sativa
cgttcgtccagccgtgcgccgccatcgctccggtcgtcgtcgtcactagggaaggccgacgtcgtgatcgtcatctcgtcgccatcctcgtctgcccctccgtcgtcgctgtagatcgccggagccccaccgtcgtcgtcaagctgaaggtcaccgccgcttcttcctcgacgccgtcgccgtctgttgaccttccgccgctgctttggtcactagtgagttcgccgtgttgcccgcaacccgtaggtgtcctccgttcgcgtcgccgtgccgttgttcgccggcgaggatgcgccgtccgagccgtcgccggtgatgacgtcaccgctgacgtcatcgacaccgtccgccgtagaccggtcgtagaccattaaatcttggccgtccgttttggatagatcgatctcggccgttcgtttctgtgaaccgctgccgtgcacccggtccaccgtgagccgagtccgctgacgcaataatctctttttccttttcaaaaataattcattattgcgtcataattcaattaaaatctatataaatgatttaatccgatttaatctttaaaaattcataactaattcatcttagctcggatttacttggttcaagtctataaatttttctaaaattgagatcaacatgttaaaaatatccacatgtactgttcatgcttgtttatgtgctgttttggtgatttttgtcacgaccggaaataacccaacgggcgttccttacgtgcgtgcattattccttgtcccaggaggcaaggtacaccaaaagttgatacaattcagagtttacaagctgaagcgtaattaattaatttattacatgggcggcgaaggcccagcacacacaaagacaaatgggaaacagcggaaggctagggcgacgaccacaggcgcttgatggcaggcgcgagctagacaccaaagccttcatcttccaggggctcctcttctgggtttcggaaaaattgagcaagactgagtacaaccaccgtattcaacaagacacacccacaagtgcaggataaatgcaagggagtacaagggggttataatataaagggttagggtttgcagcaaacagcattaaaagacacttagttgctcaaagctattttgtaaatacgatcctagagctatacaagattattaaacaaggccgtgaacccacacgaacctgccttaacccaaggcctacgatgatttagaccgaactagcaacctgaccctgggtcccagctcgtcccaagccaacccaggccaaccatttcacattttagttgttaagcaggttttaagaattaaaacactaacttgggtacattgctcggcttgcccataaccgagggcgcggctattcgaatagattatactctgatcagaggtgtacatctttacccgcaagacacatcttcctcacgtgtaaccacgtgccccataccaccacggtatacggacggaagacgtgacatagtttccaacccatccttgcc

SEQ ID NO: 52746 - DNA, 1501 bp, Oryza sativa; identical to SEQ ID NO: 51053

SEQ ID NO: 52747 - DNA, 777 bp, Oryza sativa
gttaacgtggacgcacgtgaacgaacgaacgtaggtgaatgaaacgtgaccttaacgagaacgcgaacgtgaacgatcgtgaacgaaacgtgaacgtgaaatacaatatatgttacttcgtgtttatcctaatacatctttttgtatgttgcagaaaagacgttatcgtcgtcgtccctcaagccggagtggtagctagccctcgaaggaattcgcgtaggcaagtgacgtaaatatatatatgattgttatatttttaatgcaattaagactattagatttaatatatgacacttagacttagcattatagttagagttttaatacaatattatttgagttttaatataagattattatagttttaatataagattattatatttgtaattagacttagtatataattattgagtagctagggtcctaatatacgtttcctagacttagcatatatgactatttgagttttaatataagattattagatttgtaattagacttagcatataaggttgtgtagggttctaatatacgacagttagacttagcataagattatttgagttttaatataagattatttgagttttcgtataagattattatagttttaatatacgattattagatttgtaattagacttagcatatatggcttcgcatatacgacagttagacttagcatatatgacttagcatatatgattgttagcacataagattgttaaatcaaaaatgtctcatgacttagcaactgtttcctgtatgaacaga

SEQ ID NO: 52748 - DNA, 240 bp, Oryza sativa
taaattccccccaccacctagtgtaactgtatcccactgttcactattttggtgggaggctgtaggggcgattttttgtcctttttccaaggaaaacagaaattaaattcccaaaagtgatcaaaatgaatcaatcaagtgagtaatattattcattaattgagcaatttcatcatgtcttacttttgcaatactgatcttacaatatgtgcctctaatttgttttttttattttgtagc

SEQ ID NO: 52749 - DNA, 671 bp, Oryza sativa
tttatttcttaaaataaatatctttgattttttttttaaaaaatatttcaaactccttttgcttttaaactctttattcaaaagaacccccaaatatttctttttttaatttaattaaacccctccattcaaattttccattagttttcatctcctgggaaattccatttcaaatccctccacacaaaattcctaaaccccatattcattttgggccgaattcccttcaattaacccaatcagcacaagtttacatgtctccttcccccctcttggggtgtcagcagagccgagccgagccggccaaattgggcccatggcagagccgctccctcttcttttgggtgcacttggcgcacgcacagggcgccgctttcgccgcggtttggccacttccggatgccgcccgcggttttgcgccgccgctgtgtttttcctttgaccggaaaggatctgtcacaaacgtcagttgagacatcacgccgcggaggtcagccgcggattggacccgcggaatcaacgaatagagcgggcgcggtgttccatttttccacgccccggtcgcggggttctcttatttttttcctcggaaccgccttacgccacggcttttgccggcttataaaaggatgaggaggtcccctcttccccttcacataaaccgagtcctc

SEQ ID NO: 52750 - DNA, 530 bp, Oryza sativa
agatgttcgtgcatatattatttgcctgattccgagtccgtatgagaaagttacgcctattttaatagatgacatattttgtccgtttcggtagagttttggaaaattctacaagtcacatattttgtccgtttgagtttattttttatacggttggttcctatgttctcctaagtgtgaaaaaaatatcaaaaaaatgaaataaaaataaaaaaattgcatctctatgtactgtttaacttatatatgtcatttcatgtggttatattttgaattagattaagtaatttcatatagtggtaaagtgcattatatttaacatgctaatcaaagggttttactaaatgaattatggtctaattttagtgaaggtgcaaagtagactaagtggtatgctaactattttcagacttagctaagtggtagttcgagtttaattttttttgtggttggttgtatcgtgatcttgagtgtgaaaaaaaaatccaaaaaaataaaataaaaatgacaccgttgcaactccatacaga

SEQ ID NO: 52751 - DNA, 1429 bp, Oryza sativa
ggaaatagcttgacctaaagtttaaacaatgagtgcacaagtctgtataaaaagacaagaaccttttgttatttgttagatcatcaaactaaaatgcgattgaaaagtgcagcttgataattggtaacagacctaggagaatgggaactgttaagaatcagagaaaagcaaaccgttttcaacatgcttttaggacattttctctagaggaaatgaagacttttttgggtataggtgagtaaagtgtatcttgtgatgttcagtgtactgtacttatgtttggtgcattggctgttgagatattacacaattctgctatatgcatgcctgcaatgtgcacaggacacccttgtactttttttgataaaggtagctatttactgaaaaaaaaaagacctatttggttagggtcatgtcacagtagagtgcctagctggcgcataattatgtctgataaaaaaaagggtttcatatatgtcttttggtaacacttgattttttttttctttttgctcactttgttttaatacagaactctctctgaaggttgacacattttccttggtgtgatcaggagatactggtatttgttcactagccaaggacatactttatcaagaatacactccaagggatgattaattatttaatcaagggaaaaggatactgcagcgtcaaggtaatttccaggattccaccagtcatatgttagttttcttttattttctgcttctctgaagttcttttcaacctcacccccagacaacatttttttctaatatagttctgaacaaacagcaataacttggtgcaaggtttgatctccaatctgttaatgactctgaaagtaatactacctccgtcctattttaagtgtagccatgagtttccgtgtccaacgtttgaccatccgtcttattttaaattttttattattattagatgataaaacatgaatagtactttatgcatgattcatttttgttaaaattttcaaataagacagacggtcaaacatttgacacggaaaatcacaactgcacttaaaataggacagagggagtaccgagttattcatgttggacatgctacaaagatttggcttattgtggatcagttcacctgttgccatcatatacagcaacacttcgcaatcaatggataccaaaagcagaaagagaactaaaagtagagtcagtaaagcatctagatttcacagctgatgcatcagatgcaatacacaagggcaatttaatcaattaaatcattaagctagaacaagacagtgggctcacggcatgtatacatcatatagtggataatggagatatcctgcctatcctacatgttgctgctatctgaagtatgtgcagaagacaacgtggcctacattcttacagcttttcttggaccaaatatgtttcctaga

SEQ ID NO: 52752 - DNA, 1501 bp, Oryza sativa
acttgttgaacaatgagccatgtattgctgttcctgttttcagttaatgcaatgagttttgcttacacctcacagtaatgcaatgggtcatgtttactgtatctttatgatataggcggccataccattatgtgatccattcgttgatgttcttgactgtttaatagtaggtagtgggtagcaattcttagttgaaattgttaaatttctgtttccctgtaggcaggagtttacttcttagacccctgatgctctgaataaacttaacacatactttgccttaaaacccaaggcaaacaattggtccatagcgtcttgtgtttttctttgctagaagtcttagatgatctgatcatggtattgtggtatttgttgacaagccacaactctctgaatgctatatctttcttcccctgaaacacccgacacataattcagttagtgcagtgagttttgcttacaccttacattggtctactgtttgatattggtgaccaaatgactatcaatcattcaatcagccaatgttcttgacacttgaatactcctaggtagcgattcttagttaaattggtatatttctatttccttgcaagcgggagttttatttctgagataatgatgctcttaagtctggatgaacaacgcaggccattggtccaaagtgtcttgtgtattttttctgctggaagactagatgaccttattatggtgttatttgtatatgctggctgccgttattccgtacttttggcaaaatctatgaaacttacaagcctcaaatccttggctcctactcctctactccctctgtctcataatataagggattttgagttgttgcttgcaacgtttgaccgctcgtcttattcaattttttttaaaattattatttattttatttgtaactaactttattatccacggtactttaagcacaacttttcgttttttatatttgcaaaaaaaatttgaataagacgagtggacaaacgttacaaacaaaaactcaaaataccttatattgtaggacggagggagtattttttttcctcagttgcatcggggaacagtaaaagcatcggattgatgctcagttcttttgttagtttatttctcttgttattctagtgctggaggttctgttcctctttcttgccaaatgaaccgcttttctacaatatactgcatatctgaaattacgatttttttttgctgcatatctgaatgtgatggatgaattgcatgtttctgataccgctactatcgcctcgttgtagatttgtgcatgcacgttctacatgtaggttggtgtagtctcttttttcaggagactgacaaaatttgacagcacaaaaggcctcacatgagttcaggtccatggaccatggttgtctcgagctagtggacggacggagcccatctccagcccaggacgcgcgcaccggccctgcggcccattctgcaagcctgcaatgactgtctctcactccgtctgttt

SEQ ID NO: 52753 - DNA, 1501 bp, Oryza sativa
gaaaccggtgttgctattattcatctgaaacacacaaatacaatatttgggataacctatctagctatcatcgacttggcggcatagataactacctcgtagtcgacgacaggggtagtcttcctccttgaatatgaactcgtcgagatcagagattgcgctagatatctcttgccggcttccgtaggcactagatggggtatgtctaggctaatatctaatgtcgatatttggcggcgtgtgtcttgttggtcttgtaacttgtcccctctcctcctagggggcttgtatttatacccataggtgccccttatctaagtagaactagggagatcaatatggatgcaatccaagtagtcattgtcgtttttatatagaactctatttatccttccttatccaaaacacattctatatacgaggtataattccgtataagacttagtatgtggtaggtcccgccgtgcttagccgattactattgggtatgtggtatccataaccctgacaggtcttgttttactttcttttccaaaatgtttcaatttggcatatttcttttatttagctcccacctttcctctcattgcttgagtaggtctagcaatcaggtattgacatcccaacccaatcgagcgtacgccgatagcaccattggacttgaggaggccttcgagagcggtattgcgcggatggcatacttaagcaagttgaagcttatgacatacaatagagatacatctacaaagtgcccaatagtcaacttgacatctatcgcattagctttgtctctgtcgtttccacatcctttgttgcattttcttgagcttcgtagcacccgccactacgtggtcgagcctgtttgctaagaaaatccaatatccacatcccagcatcgacaccaatgcatgtagatctcaagcatggacaacaccgagagcagttgagcttagtctcctccattgctacgagcgtatttgttgtaaggtggggagggttgagattttgacgtgctttctctggtagagatgaagagagaggggataaaccgaagataaacatagttataaagtgaaatgtttttgaagaaaaaggcctgatttagagtgaaaaagttggtttacccatgtccaaggcggaagagcggtaaaaagagcaatttactcctttttttttacaaattattaaaacggtgaaattatattataaaggtctacagtctccggcctcattagcccagggcccagcccaagtcctacagtctccgtcctacagcataactctcatgggcccacggctcagcccaactcaatcaccacctcccccatcgcaccatctcgcacccactaaacccttcccccttaaaacgcctcttcttcttcccctcgccgccgcaaaaaccctaaaatcccctccccccaacccgccgccatgtcctccccgccgccggccgccgccgcctccccctcctccgagctaaccaagtccaagaagaagaaga

SEQ ID NO: 52754 - DNA, 693 bp, Oryza sativa
atagattcactttcaagcttgaagaaagcaaaggaagaagggcatccttatctaatgcgggtcacatctgttcgacagctctgaagatccggtgtcatttggaccacctgccctgctgcagtggtaactttcttcatccacacactttgaaattctttagcaattactagcttctaaaccatattaattccaatagatccgcagaccaataattagctccacttaagttcacatgttgctacagcttcatgtagccgttactcgggcggtcggccgttggccagctgcagcctgcagataccggagcatacaatgtaccctgcacatgtggagccttgctctatacatctcacaatccaaaattttgacaacaattcctagttaatactttgactccacctgttactagctgcctgacgcagaaaattggcaaatgcctgtaccactgtgcaaggctttggagttcggagcttaaatggcacacctctccatgtgggcagataaggtcgtcctgagaatgagctaccgacccacgccctctcttcatgctgcagccaccgacactgtttgaatttctgcactaatgaattgctttgctactagtaccacccaccagggattattagttgctgtaagagacagttttggaggtttgcttgatctcatgattcatcagctcgatcgttttgtagg

SEQ ID NO: 52755 - DNA, 1501 bp, Oryza sativa
gagataatgaagtaggcgaagaaaatgttgtcttacaaattttgaatctaaaaatccttatattttaaaacagacggagtgagagacagtcattgcaggcttgcagaatgggccgcagggccggtgcgcgcgtcctgggctggagatgggctccgtccgtccactagctcgagacaaccatggtccatggacctgaactcatgtgaggccttttgtgctgtcaaattttgtcagtctcctgaaaaaagagactacaccaacctacatgtagaacgtgcatgcacaaatctacaacgaggcgatagtagcggtatcagaaacatgcaattcatccatcacattcagatatgcagcaaaaaaaaatcgtaatttcagatatgcagtatattgtagaaaagcggttcatttggcaagaaagaggaacagaacctccagcactagaataacaagagaaataaactaacaaaagaactgagcatcaatccgatgcttttactgttccccgatgcaactgaggaaaaaaaatactccctccgtcctacaatataaggtattttgagtttttgtttgtaacgtttgtccactcgtcttattcaaattttttttgcaaatataaaaaacgaaaagttgtgcttaaagtaccgtggataataaagttagttacaaataaaataaataataattttaaaaaaaattgaataagacgagcggtcaaacgttgcaagcaacaactcaaaatcccttatattatgagacagagggagtagaggagtaggagccaaggatttgaggcttgtaagtttcatagattttgccaaaagtacggaataacggcagccagcatatacaaataacaccataataaggtcatctagtcttccagcagaaaaaatacacaagacactttggaccaatggcctgcgttgttcatccagacttaagagcatcattatctcagaaataaaactcccgcttgcaaggaaatagaaatataccaatttaactaagaatcgctacctaggagtattcaagtgtcaagaacattggctgattgaatgattgatagtcatttggtcaccaatatcaaacagtagaccaatgtaaggtgtaagcaaaactcactgcactaactgaattatgtgtcgggtgtttcaggggaagaaagatatagcattcagagagttgtggcttgtcaacaaataccacaataccatgatcagatcatctaagacttctagcaaagaaaaacacaagacgctatggaccaattgtttgccttgggttttaaggcaaagtatgtgttaagtttattcagagcatcaggggtctaagaagtaaactcctgcctacagggaaacagaaatttaacaatttcaactaagaattgctacccactacctactattaaacagtcaagaacatcaacgaatggatcacataatggtatggccgcctatatcataaagatacagtaaacatgacccattgcattactgtgagg

SEQ ID NO: 52756 - DNA, 1501 bp, Oryza sativa
atgaggaatgcctctatcttttgagaacccaaaaaatgacttgaacttcattcacaacccaaacagcgacatagtgagggcgtgagaacaatgagaggatcgcgctgggaatttttcacacacacacacaaaaagagatgcggttgggtgtagagctcctacggttggaggctggggagatgatttgtgttgtcttcctactgaacctcgattttctcccttcacctcaataactattcgggggcttagttaggtactctattggagatgctccgagcattctatacctgcttatatatccctatatttaacatttccccttataattttaccaaatcactatgtttaacatatttcaatttagtactagtagagcaataaaatcagctcaatccaatttaacgtgctacaaagctacttcctccgttcaaaatatttgacaccgttgactttttagtacgtgtttgatcattcgtcttattcaaaaaattcaagtaattatttattcttttcatatcatttaattcattgttaaatatactttcatgtacacatatagttttgcatatttcacaaatttttttaataagacgaacggtcaaacatatgctaaaaagtcaatggtatcaaacattttgaaacggaggaagtataattttttttccaatcaacgatgaaggaaaaaggtggacgacgctgaaatagaaaacaaacgaatttcggaacgggaaggccatgtcggactttaaacagtaggacaaacataccactggacccacatgtcatagacacatgtggacccacatgtcattgagataggggtggcaaatagttatttgtcaaatctaaaagtggcaaatagttaaaagcccctgcaaataatactccctccgtttcaaaatgtttgataccgttgactttttagcacatatttgaccgttcgtcttattaaaataaaattgtgaaatatgtaaaattatatgtgtacatcaaagtttatttaacaatgaatcaaatgatatgaaaataataaataattacttaaatttttttaataagacgaatggtcgaacacactaaaaaagttaatggtgtcaaacattttaaaatgtagggagtagctctgaaccgaaccgaactgaactgaagatttgcgacgaccccccaaaatggcgaaacgcgagcaaattcaattcaattccccctcctcaaatcccgcaagcgaggaaccctaatcccatttccgcctcgatccaattccaaatgctccccgccggcggctacccgtcggccgccgccatctccttccccgacgccgacgtggatgacgactccgacgacggcgacttcaccgacgcccccctcatcgacccctccgaccccaccttccccaacccggcctcctcctccgccgccgccgccgccatggctactccagcctctgcggggggcgggagcgggagcgtgggaggcgtcggctcctcctccggcggcggcgaga

SEQ ID NO: 52757 - DNA, 1501 bp, Oryza sativa
taagaatttataattttcttttgtagatgacagtagggttaaagttcaaatgtgaatagtgtcccatgataagtggattactctctccgtcccattttaatcgcaatcataagttttcgtgtttaactttgattgctcattttatttaattttttattgtgatttaatgataaaacatgaatagtactttatgcttgatttatattttttagtttttttaaataaaacgggtgattaaagttagacattaaaactttgtgcttacaatgggacggaaggagtattttagaagagaggagcaataatcattaatcaaccgtaatttttttttgaaatttgagactatggtatgcgatgaaaattttcatgcgtacaaaaagagagaaattttaggttctgtctgacaagtgctcgattctactatgaattacaacctgacgaaaatgtcatcgtagtttccgtcaaataacattcattagccccttttaaaataacatttattctgtggacgtttgcggatgtctaaattgtggacatttattcttttttctttttactttcgcagtatatgaaatacaaaagtaaaaaaaaagaaaaaaaaagaaaaaccttcttcttttttcacctttttgcaggctttgcacctgaatcccatgatccgttgggtacaaggaagaagaggatactactctccaagtagcgaaaatccacaaattccctctccggctcgcgcgcgcgctctcaattttttgggggaagagaagatctccccttggagggaaccccgcccaagaatggcgggtctcggcggcggatggggcggcgggtacgacgacgacgacgactgggggctgagcgcggagcagctcgaccagctcgagcgggacgcctaccgcaagctcgccgagcgcaaggcctcctcctccgccgcctccaccgccacctcgccgctcccctccgcggcctactcgccggtcaagaacagccaccaccacccggcatccagggtttcccaggagtcttgcttcggcaaggttagggtctcatctcctctctctcttcttattcttttcttttctttcttttttttccttcttttgttaaaaaaaaaacttgggtcagtgagggttgcatcttcttgcgaattggcatattttcatcttaatacatttcgtgaaaaatgtgtagtgttcgttctggcaatttccttatatttcttttacctaattcgtcatagtgaattttcgttcaaacaaatggatggggctcttgtccaagaatttagccagtgaataaaattcttattgacaaccatagccagtgtgaattgcagtacgaccttagctcagagtttgtataccgtggtaattttacgaattttcttgtgctctgcagttgagttctttgcgttaccggctatctgtttcaactttcaagaatagtttttttctctgcgttgctgtttcattgagttctttatatgtcctgcattgcagtatga

SEQ ID NO: 52758 - DNA, 1405 bp, Oryza sativa
tagctgtgatccgatgcttttttgagctgcgattgggatggggatggggatgagaaagtgagtaggaggcgaggaggtggcggcaatgggggactgtgtgagaagatcgagatgccgggtgcagagaggaagggaaacgccgccgggggcggaaaggagaaggcgacggcgtgggactcggggtggatgggaaggctgttaacagcgaaatttggtaaagcccaaagtcatcatcggcttagagttaatatcggctggaatcagccgattgggggaatcagtcgatgggagtcgtcaaattgccacgatgttgtgttctcgatggaatcggatcaatcaaaggaagcttatctagaagagtccgagttcaagaaggatgcggcatggcagtttatctattaattaggcatagtttgttagtttccttttatctttaggaaagtgtgtttaatgtccgataaggactttattttttccttttatttttagaatagtttttttttggtcggccaaccactcgtatcaacatatgggtataaatatgtacacccggggtctatgtaatctatcaatcacgatcaatacaactactctcggcgcatcgccaccctctttcctgaggtctttacttatcttccggcggaatttgggcacctgacgcagggctgcatcggttcagttcgatctccggcgaaggggtaagtcctacgttccgtcgggccctggtgaatttgtcatctacgtcggcatcgctcaaggctgcattagtatattcaatctcttggattgctacggtttggatgatatatttacctacctatttatcatatgtctctgttaatctagtcttagcatatcaatttagctctatcggctgcttctcgctttagggtttctgccggtatcggctaaatcgtattgctagattagattagcttagatatctaccaccctgaaaatcagtcaacggcttgattgtctagatattatgtttcttttcatacttagtgctgcatcagttaagtttgatctactaagtcgtgcttagaaccataatttctagcctgcttcttgattgccaataagggtttcatcggggtttcagccggtgagttatctggacgttgcatcggctcataaggatcgcatatacatataagttagatttagccgatgacaacaaaggtttcactgtttaatctaatcttgtgaatttcctgacatcggatccccagccgatgtatgctttaacctttggatcaatacttgttctactatatcatattattagccgattggttttctactggattatattgctatattatattatcatcagccgcctttatatcattatctacattggacatatagccgatcgcttaaaccctatcgctatcggctg

SEQ ID NO: 52759 - DNA, 189 bp, Oryza sativa
aggagtttaggacacaatttaatgctaagcaaatagaaaatctattattacctgttccctttaatatttttgccttcggagttttgaagctaaaaaccaagcaaacagctcatggtcactatgttattggttctctggtgtgttcatgaggcctgatggcaccttaaccttaacctgttaattaacaac

SEQ ID NO: 52760 - DNA, 1501 bp, Oryza sativa
tactatatttgtttataaattagttaaacttgaagcagttgattttttactaaagttaaaacatcttataacctgaaacggagagagtagctggctagcaagtaaatttgctcgcctagactgtagtccatattataagcaatttagtgcgtatgtgtccactatgtataatgccatttgcagcctttgtggatatctgccttatgttgtttgtgttcaaccttaatttggacgatataaatcattatcatagcaaacatccttaatacgtaaaccaggatatagatgtactaacgttattaagaaatgtcttgcattttgcattattttctcatgtcaagagtaacatatatctatgtggtctttaaaatacaatattgaccatcaatatctaattcctctgtccctaaaagggcgtagttttactctaaaaaattatctctaaaggagagtagtttttaagaatttatctctaaaggagtgtagttttagtttggtccactaaattaaacctcttttatacggcttcatcatttttagctatactctgtccttgttttttatctgtattaacgaatgtcatagtattcctttaacctcttgcttataatatctttatgctaaaactacatgccttttgagatggaggaattaattattgcagaagattttttttctaaaaaaactgagagcattataataccatgaaaatattgttttaacgcaaatatatagatagattttattttatgcaatctactattataaaacttgataatgttcctacaagtttttcatctgttgcctccatcgtcgatcgggtcaggctcttgtccggtcacacggcgacggaatttttttcggttttagatttttttttaatatttacagaaataatctatcggccaaaaaaattacaaaaatagaccctgccgcccacctctggggcagcaagctgacgtggcaaacgggggaggaacgggcgatgacggagggagggtttttttgcaggaaaacccggcaaggggcccgaatgcaaaaaagccagacggggccggctattttgcaggcggccccttgccgccctctggccaggcggcaggcctcactgcctataaaaggcctgctgcccagcccccagccctcattcttctctcctcaattccagtgaaaaaaaaaagaagagaggggaggagaagagaagaaggggcgaagccctgccggattcaaacgccgatttcaggtaatattcatagatcctatatatgactattgagttaaatagtgtgtattctttaaaaatttgtttgaataaatgcattatatttttagggttttagttgtactaatctagaagtgcgtattgtagatatcggtaactacatagatctgctagtttggaatcaatacattaccgttgcattggcttacacaagatattacgttgtagatgtttattgcatgaaagagtaatatgatctagttatttcgttgacagata

SEQ ID NO: 52761 - DNA, 1501 bp, Oryza sativa
agtcaatcatcccctccccaacatatcagctatgcaatacctgcccggaagacactgatcacatcttccttgcctgccccctggcttctgcttcctggggcctgattcaagtgctacacatgctaacctccctgagtgagattcacaccatccactggtctggagaccttccagaacgactaaacagcaccttcttcctcttgtgctgctggcgcttatggaaccaccgtaatgaagttgttttccagcaccttgcaccatccatcaaccgtcttctccgctgctgcgtcaacgacgccaagctttgggcaaaccgtttcaagctggctgaccaggcggttcttccgtcttggcttgcatccttctcctctcctctccaccttatgtaatctctcttgtttgttttctctctctctttcgtcttttctttcgctctgttatgcttcctcttttcttcttgtatggtttgtacagttttgatgtttccttaattttaattcaggtgagaagttcccccccggtggcattcaaaaaaaaaatcttttcataggcgcaacatccatccgccggcaaaaacaatctcaacaaataaaaaaacgccaccacctccacccgtggcctatagatggccatttggtccgaggcccgacggctggggtcgtgcccgtgccggcccggcctgggctgctccctcggcacggctcggcatgacaaagagaaatagttgagggatcccaaatagacttgactcagctatataaggcactgcccaaagagaagagggatataaaatagacttattctagtcatataagatacaaccaaatagataagggaggaaaaatagatttattttatgaaaaaatacgatgggctatcgtgcctttaaaccgacccgacatgcggcatgagtcttattggcgtgtctaagctaggggtgcagcgtgtggacaagcctggaccggtctggcgtgttggttgagccgtgtctggccggacggcccatttgaccatctataccatcgctgccctccccgtccggctggattaggagggagagggagggccggatctcgatagcaggggaggggagccgcgccgtatgcggttgacggatcagcatcagtgctaactttgcgtacgtctcacttgattcccctttctatcctaacaactcggaattgagaataaacaattcggtcgtcttacttcccctttctatcctaacaacaactagctagctcggagtctgccactcctcacaaggacactatatataaataagcatgcaaactcgagctccacacatcagctaattattaagctacagcaacacgtactgtcttaattgcatgcgtttagcttattaattctctcgagctgatggatcacaggctaatcaaattgttaagtttgttagctacttagctagctgcattactctgcaagctacgcgccaagctaggcacacagatggctacttggtccaagccatctctga

SEQ ID NO: 52762 - DNA, 163 bp, Oryza sativa
agtacttcatcagcttgacactgcttttttgtcataatgcaactctggatttggtgtccggcagtgacatctttttttagtcaactttatctcctaacctgtcctaaatcgtatggtggtttatgtgctaatttgtctaatcatataagagtgcagttctagt

SEQ ID NO: 52763 - DNA, 1501 bp, Oryza sativa
agctagcgatgtttctgacccacatcattgccctctccgagcaagcaacgccttgattattacagttggaatcaatcaagtgatctaaacgcttagatttgaaatagatcgttgagcgaattattatttttgatttatctattttgtacacaagttaattgttttggtaaataaacttgataatctcttaaaacaagttctctgagcaaatatagtagaagaaagtttttttcattcaaaaaaatgaatatttttttaaaaacgtgaagtaaacaattcgtttcaacaattcgataaataatccgaaaagaattaagcctcgaaggtaataacgtattacactgatgattattacaaacaaaacctatggttctccctttgcgccgaatcgttggatctctccaccaccatggatccaaacctgtggccatcctgcctcgctccatgcctggaactctctccaatggcctttgtcacttagatcacaacttatggtataaagctagccatatctctttctgaaagattcttaaccactgtgatatttcctactgatatggttaattttaaaaatttaacccatggatatttattcttgattttggagaattttgaggcctggaatcgtttggggtcattttctgcggtttggtggtgttgtgcatgcatgtggggggaaaatgagcatgtggcctgaatcttccatgaatagtgtccactagtaaattagcataaatgaaatgattcatttagcataaaaaagattcattctcctggtagtgccattggaccaaatttccgtgtgaagtcgtcttcgtcgtcgaccatgaccgcatccctctactaaagtttaattgtactctaaacataggcctaatttagttcaaaaatattccttcggccattaatatacgaggaatgcttgtttattcgatccaattagaactttttgaattttgaggtttcggaaattctgatcgaacatatttacactaagcacaacatacttttggataaagattacggaaatgtcgaaacgatagattaaaaaaacacatgattaagctggggcgattgtcctgagatttatcccactaattcatagtagataagctcatgtggctaacaacagattccaatgaccaaccacccactgacacccggccccacagacctagcgctggacaccagtaaaccaccctctcccactgacacctcggccccacagaccttgcacgggatacccctctcccactgacacctgggccccaccatattcctctccttctatccgggacacaccagtgcagcgctaatccagcaatttttttcttcttttatttttttatttttcttgacgccacacacctctcctctgttcttcgcttcctccgctttataagcgcgcgagctcggctcggcctcccatgccgcgctcgtcgatccccaaatctcgccgccggtgaaggaggtaaaagtggaggtggaggtggggggagga

SEQ ID NO: 52764 - DNA, 1151 bp, Oryza sativa
tagtagggccggtctgaccgcaggtatgtagcggtcagacgggcagggtccgagtccaagtctgtttttgtcgggtctcgggtttccttgctcgggaaggcatgtttcgtgtttcctttggtttctatcctgagttgggcatagagaagggcctgtagagggcaagaccaatccctatttaagggacaaggccggttcattgtaaaacccccgaatacaatctatttgaatcgttcttttactatgttttatattttaccctagtttagtccatctttgtcggtttgcgccataaaccgtccgctgccgctgcgagagtgcgacacctctttataggtttgtcctgaaaaccttccgttttgcccacgagacgggtagttatcctcgtatcgatctaaatcggcctagaggctgattttgatctctaattcagtttcgctagccggtttagttgttttcccttaaaacccatcttgatttggccgttcggctagattgaggtggttggcgactctatatcaccacaagacgtttagatgttgtgatcgtgcttatcgacttgtcaaaaaagttactaacaatgatatgtgacagatcaatcgatattcaatgccgttacacgagtatatgctagtactgtacgttccaaccatttttgtcttccatccggtcgagttaataaactgtacgcgtgtgacgtgtgtcactcctcttgcataatatactaactagagtctttgtttggaggtgcacgcttaattggtgtgatttcttatggtaaaatattcaagttctatatttgacgagtgttcatatttacgactattttcttaaggtaatgtacacatggataacaaggcgttatggtgacttcatcaatctagagatattctggttcagttttcagagatggttattattgtcatgattacgaataaggcatacctcctattctacgacttatggaatatatggatatggtataccttcatgtacacgggttatttccgtatgtgttgtaggaatccgctacaaattatagaaaatatccctacgagttaagtgatttccaaagtcctactaggaggggatagagtttctattgtctcgtacgggatttgatgtctctgagtcttacttggagatcaaga

SEQ ID NO: 52765 - DNA, 910 bp, Oryza sativa
atcaatagtgcgtaaaagcgagctcgtcgttcctattcctcacttctggaaagtatctgatgtcgcggaaagagtccaagtaccaatcccgcaccttcaaatatggcgaacaaacccaccatcagtcccacaataagaaacttaaaatttgcatgaatgaattcagctgcgaaaattccttgattaaatatttactctgtgctgactccaaaattattctagtacaggcgtgataagatcaataagacagcacaacataaacttgaagcaaattaagaacccccgaccccactccaagagaacaaaattcaagcaagttggcgagcaagaatatctaaaattgccccccttatcctactttttttagaacacctttcgaatattaacaacacaaacacacaattgatgctgtgtcaagagttatcgactactacaccaatttcaaccaatacaaatcgcacattttaagtagttgcatgtggtagtgatgtaccttattcacactccactcccccagaattacctttcaaaaaaaatttcccagaattaatgataaaggtgatattctaataataacaaaacatgaaagacatcaaaggatccatccaaaaggcgccacctctttttagaataattcctattaaacatcactgcaagataagcagattcagataagcatgcaacggcataacccatccataatcaaccgagccacacaccgaaaactcgccattaattcatcatccatccacgggccaaaacgacagaacaaacaatcgccatgattcagtgtgggcatagagtaatatacatccaatcgcccaccaaatcatcaatcaatcaaccaatcgatcacaacgaacacacagagagatagagaggtgcgcgtggtaagtaactaccttgagga

SEQ ID NO: 52766 - DNA, 1501 bp, Oryza sativa
tccacttttacctccttcaccggcggcgagatttggggatcgacgagcgcggcatgggaggccgagccgagctcgcgcgcttataaagcggaggaagcgaagaacagaggagaggtgtgtggcgtcaagaaaaataaaaaaataaaagaagaaaaaaattgctggattagcgctgcactggtgtgtcccggatagaaggagaggaatatggtggggcccaggtgtcagtgggagaggggtatcccgtgcaaggtctgtggggccgaggtgtcagtgggagagggtggtttactggtgtccagcgctaggtctgtggggccgggtgtcagtgggtggttggtcattggaatctgttgttagccacatgagcttatctactatgaattagtgggataaatctcaggacaatcgccccagcttaatcatgtgtttttttaatctatcgtttcgacatttccgtaatctttatccaaaagtatgttgtgcttagtgtaaatatgttcgatcagaatttccgaaacctcaaaattcaaaaagttctaattggatcgaataaacaagcattcctcgtatattaatggccgaaggaatatttttgaactaaattaggcctatgtttagagtacaattaaactttagtagagggatgcggtcatggtcgacgacgaagacgacttcacacggaaatttggtccaatggcactaccaggagaatgaatcttttttatgctaaatgaatcatttcatttatgctaatttactagtggacactattcatggaagattcaggccacatgctcattttccccccacatgcatgcacaacaccaccaaaccgcagaaaatgaccccaaacgattccaggcctcaaaattctccaaaatcaagaataaatatccatgggttaaatttttaaaattaaccatatcagtaggaaatatcacagtggttaagaatctttcagaaagagatatggctagctttataccataagttgtgatctaagtgacaaaggccattggagagagttccaggcatggagcgaggcaggatggccacaggtttggatccatggtggtggagagatccaacgattcggcgcaaagggagaaccataggttttgtttgtaataatcatcagtgtaatacgttattaccttcgaggcttaattcttttcggattatttatcgaattgttgaaacgaattgtttacttcacgtttttaaaaaaatattcatttttttgaatgaaaaaaactttcttctactatatttgctcagagaacttgttttaagagattatcaagtttatttaccaaaacaattaacttgtgtacaaaatagataaatcaaaaataataattcgctcaacgatctatttcaaatctaagcgtttagatcacttgattgattccaactgtaataatcaaggcgttgcttgctcggagagggcaatgatgtgggtcagaaacatcgctagctggtaattaactcgcccatt

SEQ ID NO: 52767 - DNA, 1202 bp, Oryza sativa
agaccggccctactagccggtcagaccgcccacatgcctgcggtctgaccggccctgtgaaggaaacccgatactttccaaactttggcaattttcccctatttcgtccataggtgccaaatttgggtgtaaacacatgccccccctacctttttggtgaacatacgtgaacctaaaagtatagaacatgttatctcagggcgataatccaattaccagccataggacttcctaagtatcttgccaaatgctcgggaagtatttcttcaagtatttcccattaatcgctctctgaaaacaccgtcttgaagtatcttcatctcctttaaagtcttcaaacgcttgtcgatgacgtcttcaaaattgcttcccatcaaggtcttgtaatcttcaactgacaagtcgtcttacttgaaataccgaagagagccaagatttacctcaactggcaaaacggcaatttcaacaatgtttctttactcgactcggcttatccattagcctgagtgtagtaaagagaagaacttaacaacttaatatcataagattcagcaaaacttctttggacataaaagaagctcctttaacgtttgaggaataccgaatctatgaacaatatgcttcaaaataaagtcaattacctccgtacaagtaatattctcgagcggcacggcttcggcccacttagtgaagtaatccattgcaactagcacgaaccaatgcccttttgatgacgaagaataaatttgaccaatgaaatctaaaacccaacctcggaacggccatagtttaatgataggattcaacacagcggtaggcgctaattgaacattgccgatccgttaacaagcttcactccctctataacatttgaaacaatcatcaattattttcggccaatgaaaccctactctcctaagcagccaatttatcttacgggccgattgatgaatttcacaaatcccttcatgtagtactctcctagaaactttagattgatcattatctaagtaatactccatctatttttcggcgatataatatttgagcgcttgccgctgaatcttccaattaaccttaagtgtaggatctttcaaatatctaatcaaaggaattccccaagctatttctaactcatgggcacaaatgtccgaattcacaattaattcggccttttaatcaattgtaacgtgccccccagc

SEQ ID NO: 52768 - DNA, 448 bp, Oryza sativa
tttcacatgcgggcctcctaatctaaccgcataggaaaatagcacttccctcccatcctattcaaaaaaaatggacttttcttctctctccccccgcccacctctctcctctctccctcccccttatcttctcagtttcctcttctctcattttcctctctctctctcaccttctcctcctctcctccgggcggctctcggcggaggggtcgacggtggctagcgggcgcagagggctcgcggcgggctcacggcagcggcgggcggacgtggggaggcggctgggagcagcgtgcgcgcggccgacgacgacgacaatggcgaggtagcggccgggagcagcgtgcacacggccgacgacgatgacgacgacggcgaggcggcggctcggagcagcgtgcacgcggccgacgacgacgacgaggtggtggcctgaattggcgtgcgc

SEQ ID NO: 52769 - DNA, 1501 bp, Oryza sativa
cagctccactcccacaggcagctcaactggggtataagccaaacatcttttccttctggatcctttttcttcaactgaggttgattgattattgcaaggtgagcatatgatatactcaacaagccacacaacaaatatgcaagtgcacaaggataccaaaggatggcataacataggctcatttgcaaaagcagtatttagcaaacatttaagagtagtgaaatagtagagtaattaatcatcaattttaatcaacactgcacagcacacccatgctgcacaggcccaaccaccctgaacaaccatacccggctgcacagatctaactccaaaccaggagctaaacaaattattaccagttatagcatcaataattattgtgagaggtgtgagactaataacgaaaaacattgctcaacccgcccatgaccgcgggcacggctattcgaatagttttactctggccagaggtgtaccgctgtatccacaagacacagcctcaacatcatgtctaccatgcgtcgcgatactggaaagtacccgaatagaggctgtgacagtaccccctgcacaacacaactcaccacagtgcaccattcctggatcataatcaccccctctataaatattaccagaggcatggactccccagcgacccccacagacttctcgccgcttctcagtctggcaccccgtaatgaatcatgctatacaaaaggtaaagccgttgcccacgctggcttgtggttggcacggttaatgtctcacaacagtagctcgcgaaccggtccttaattgccatgagcacgaccttcaaaaccatgtgctcacaacccaccattgacaagttttaaatatcaattaattatcataacacgattaaccatcgtgagctatcattaaatataatcataaataataatgtagtatatatgattcatcccattaatgagctaatgtttctaagcatggctaagcaattatacatatagcatttagctgaactaaaccaatatataaggttctagctaatcaaattataacccataggaaaaataacatcattttcggccattaattaattgggaaaggcttaccacccgatgacattcgaaaataatgcataagttaaaataaaacattagctttaaacgggttcaacatgctcaaagggttgtttgggatctgtgtgactttccttgagcttccgtaaacgcttttgaaccttcttcaatgtaaacgctctcctccggaacgtcggaaactaaagcaaataaacaaaatcaataaaacagtaaaaaacaagcataaacagtacatgtggacatttttaacatgtagatctcgattttagatgaatttagcaacttgaaccactcgaatccgagttacgatgatttagttatgaatttctgaagtttaatcgattttcatctaatccagataattattacgaattaaataaatgatttatgatgtcatcacgacatcatcgcagcca

SEQ ID NO: 52770 - DNA, 247 bp, Oryza sativa
ccggactttgttggaatcgtaaaccctggccacaatacgagcagtattgctttgcttctgcataataggtacgatctaccatgcccacactaataataaaggcaaattttgtctacaggacactgtaatttcgtggttttagccgtaggacactgcccgaactcacttttggaggaaaacactctataaacatggtaatttggcaatagacatcgtgctgattaaaataataatttttggttgaaga

SEQ ID NO: 52771 - DNA, 1501 bp, Oryza sativa
tttccctccttttctaattactgattgaaattttgatgatttcgctcggaatttcgccaaagccgaccggttttcgcaagcttatcggtaaattcagggaatttgtattcaaattttgatttatcaaatgtgttcagaatctaccggctttctagcggatttcgcaaaaaccgtcattccgccagagcccgaaacggaaggccatctcggaattgtaaaccctgttacagcactgaaacttgtgtctaacatggtaattcaacctatgtggcatgtgaggttcaagaattatatgtgccgcactactgctgcccttacagtttcatggtgttatctttgttgaaaacaactccatcaatcctaattactcagctgatttatacattttaaaatttatcttgaaataaattaaaatttttgctttttttcctagggagttgctaaaaaaaattggcacaagattttatagctaaaaaactttcaaatataattatagtacaattacacagtttaactataaatgtaactattattataattataattatagtgtaacaacattgcaacttctctatataacttatgtataaagttacatgcacatttttaatacttaagttatataaaatttataatatagttgtcaaaaataattaattatattatagttacatttgaaagtttttcctagacaagttttttatagtccatttacctagtatcatccataagatgttcttttaatacacttacctatccatccattaatatttttctattaataagaggcactttggttttttatactcatcgttaatatttttctcgatattttaagaatttatttttctctactactgtaaatgtaaaagtgaagtcttctcctccaccaccctcgtacctccctcgtcacatagaagattcaccccatgtacaaaaatacagtgtttctattaaaaaaatcaacccaacataaaaagattctgtaaaatcaaaggtgttttttattattattctgtgatgatcaattgggcattggagattattggttttgttatttagaatttattcacgaaatgattttggagatgattggatttcacaggtgatcgtaggattctatcattttatgtgaccggtcggaccgggcagtgtgtgccggtcagaccagcggtgatcgagcggtcggaccggccagcccgcggtctgaccggccaacgctgtgtcggtttcggtttcgggttgttcgtttggatatccgtgattatttcatgattatgacttctagatggatactatacgtatgtaatactgttgtttgctactaatgagtcaagttggagatagcttggtctcggaatatggtttctttgtttatttcatgtgtaggtgactcgatgtctcgggatagtatttgcggtgatggatcgggagtcggcttggggataagacgacgtccgtggtggtcagagattatgcgggatactaaggctagagttga

SEQ ID NO: 52772 - DNA, 167 bp, Oryza sativa
cggctacctcgtttgcaaaataaacaattggcaggagatactttgtttgcccccaaagaagacgacgatttcgttgtacgtataacaaattacaaatttaactagcatctgcttattattactatcctaactaactaattatgtttgtttcttatggcaatccaagg

SEQ ID NO: 52773 - DNA, 601 bp, Oryza sativa
aaaacgagaggggagtgttgggaattcactctttcgatcactgccaggtgtgttcaccacccctgactcccaacaccaacaccttgcacggaaaacggagcgattcattagcgcgtgattaattaagtattaactaatttttttaaaaaaatggattaatttgattttttaaacaattttcgtataaaatttttttttttaaaaaacgtattgtttaacagtttgaaaacgtgggagagcggtttggaaaggggttgcaaacgcagcctggccgcctcatcccttgtttgcccacgaacaaacaaattaaagcatggacacatgatctgagattacctgaaaaaaccacatggtgaatggctgggaactcctctttaccaagtaccaatatttatggactatggtgcaagaacatgtttcatcaatcaccaaattacgcaatgccatttcagctcacagaatgggttaggactactaatttggactagtgctgaacagaaaaacactagtttgcttattctgcattttatgagtacgaggatacgagtgatttctgtcgaacatgtactttactcttttatatgtgttgcacaaccgcagg

SEQ ID NO: 52774 - DNA, 1501 bp, Oryza sativa
cacgtcatcaccatgatgaagaactgcagccgcgtcagctgccccttgttcctcttctcctcctcgtgcatcgccctgcgtgacaaacattccaaattttgcttataagtttccccgcaaaaaaaaaaaatgctcaaaataaagtttgtgtttgcccattccccatttgcatcatatatttttcagaaacaaatatttcgacaaaataactgctggtaattagtaccattacctgaagagggtgacttggacgaggtttgacggccaccacatgtaggctgagtcaaccaggtacttcctgaacaatccggcccatccatacccaagcaactgtatgaaatcaaataaaaggccatttttggattaatcaatgtgtgtttgatcaggtcttcgatttgttactaatcaaccaatgcatgagtggcaacctgggtggtctgggcgagcagcatggcggcgtaggggctgatctggcgcttgtagaacaccttgacgatggcgatgatgttcatggcatagacgccgctggcgccggcgccggcgaagatgatgatgaggcaatgctccttgaggctgaagggccccgggttgagggagaaggaccagccgccgacgcggaggcgcctcgccggcagcgtcgacgccatgaggcggccgatgggcagcgtgatgatttgcaccaccaccgtgccgatgctcagctgcgtggtccggtacatgaagaactcgttgacgaaggcgaggaacacgcacgacgagagccccagcacccacacccggaacgtcaggcacggctccgacgggtcgtcggtcaccggcaccgtgttccggacctcctcgatcgggtggtcgttcacctcctcctccatgccctcctctgcagtgcgcacacacacacacacaaaactctgatagtgattatggctgataacccggagagggcttttaatcattcggttggatatgttcatatatttattacatgtcaactagataattacaaaataataaatcaaaacaattgacaagataagatagattaatatgaatattcacttaaacaaacaagttcaaatttaacttttacgagttgtaagaaaaacaaatttaactgtgagtatatacgtatactaattagagttaattttttatgtttttgttagaactcatagaagtcaaatttaaacttgtatgtttatgaagtgacatattatgtactccccctatttcatattgtaagacttttctagcactgttcacattcatatagatactctaatgaatctagacaaatatgtgtctagattctttatatctatatgaatgtaggcaatgctatatgtctagattcattgtggaacggaacgtattaggtctccatcgtttggcatattcatatgcttatcagccaaaatttgaattttcaatattaaatttgaagctgattttagggttttttcattgaaggttatttttcagcctttgcttttagatcgctaat

SEQ ID NO: 52775 - DNA, 842 bp, Oryza sativa
aggtcctggtgctggtgttggctttggcacgggtggactctatggtgctagaggaggctatggtagcagtggtgctggtgcttctggtcgttatcatccatatgcaaggtagacagcttcagatgctgccatgtgtgtgttagataagcttgcagaaggtcggtactagacaaggcaagataaattatctgcagctagaaaagaagagttgaagtttaatctgctaaggttatgtacctctcctgctagatttggctctgctaaggtttatgtacgcctgttagattggctctgctaaggttgctgtaccactcctgactcctgttagattggcttgtagaatttaaaatcactttttcagtgtttagaattcaagagatcgcacatatgctttgattagatagcaaagtcactatggctgttagtttagctcgtatttagtcgatttgagatgcaactggagcatattttctgtggatctttcctatcataggcttgatatgatggcgatgaagtatcttgaattcatagtagtatatcatcgtttttcttctgttcttagttaaaaatttcgtaatcattagtgtccattgaggtcagcttgcatcttaatttgtatgcgtatcaattttctgcgctggcaattttgtaggttggttgggtgctataggctaatgaatgctgacttcttgggtgctatatggctaccatatatcgttgcatattttccttgcagggctcagtagtcttcggataaactagtttggtataattgcattttcagccggtgtagttcattagtatctggtttgatttaaattgcactatattaactggagaca

SEQ ID NO: 52776 - DNA, 554 bp, Oryza sativa
cccccccccccaattgaaagtccatccaacactctaaaacttaaaacgagaatactgttcatataacaccctaagatgattttatcaagtggtttttatctaacttgcatatatgttgaatgagtttgaccatgtgacacatgcattgcacatatatatgttaaaatccttgcctaaacattttgcttttaccttttttttctctcacttacaaaccaatgttgatataatactagtatgacatcactatagagggatcgatgaatgacgatatataaacatactatgttaattattattcaaaaccacttatttaagctccaaatatgcaaaattactatccaaaactatcttatggtgtaatataaatgatattgtaaaatttgaaaggttgaatgtttggtttcaaagtttggtgtgcttcatggaagtacagggagtacacagacttttccctttcggcaaccatgtgaatttaagtttgtattgaaacttttaaacaagtactcgaaattctatataaatttgctttagaagttctaaaattggctcca

SEQ ID NO: 52777 - DNA, 1501 bp, Oryza sativa
cctacactgggaatgcaaatgaaattctctcgtggtagaagatcgaaattaagctactagctagtttctcttggagaatgaaatcaacaacagttttcttccacttcccatttgttcgtgcaaaattgctgctaaaatatttaacgattttactcatgtttctttttttttccccaatggaatctgaacggctcagtgttgctttgctaaaaacatgagggtttgagaacttctctcgcaaagacatgcaggcggcctattttagggacagaagatgacaaaagaacatcaaggaagagggcgtacgtgtagagaaagacggtgaaatattttgccagccagccggccggccggagtccgacgatcgagcacattccgatggacactgcaggcggtacaacaaaccacgcctaaaacctcctttacttgtaagtcatcgtcgcaaagttctaccacaaacaagtgaaacgcattgatcgtcaatttcgtaaaaacacttcaaatgcatagatcataagctttcaaatctcggttgcatatcgtttgctggttagtttgttagccatagtcaagatttgaattttgaaactttacttgggagttctttttcatcgtaatctatttttagcattagcttttaaactgcaaacaaatagatataaaaagttgtgattagttcattttggaatttgggattatttcattcaattttgggtcattagaggaaacacttttaatcatttagatggacatccacccatttgttgcctgtcaaattaaatgattatgatttttttttaaaaaaatggataagatatattaatacttcctctatttcacaatgataagatatattagggtgccatcatttggcatattggtggaataagctaaacggtatatttgcaaatgaaaagtaatttgtgaataaaatttttatatatgtgttattagcgatctaaaagcaaaggctgaaaaataaccttcaatgaaaaaaccctaaaatcagcttcaaatttaatattgaaaattcaaattttggctgataagcatatgaatatgccaaacgatggagacctaatacgttccgttccacaatgaatctagacatatagcattgcctacattcatatagatataaagaatctagacacatatttgtctagattcattagagtatctatatgaatgtgaacagtgctagaaaagtcttacaatatgaaatagggggagtacataatatgtcacttcataaacatacaagtttaaatttgacttctatgagttctaacaaaaacataaaaaattaactctaattagtatacgtatatactcacagttaaatttgtttttcttacaactcgtaaaagttaaatttgaacttgtttgtttaagtgaatattcatattaatctatcttatcttgtcaattgttttgatttattattttgtaattatctagttgacatgtaataaatatatgaacatatccaaccgaatga

SEQ ID NO: 52778 - DNA, 1501 bp, Oryza sativa
agttagatagactaccccaaatattatactggtatgattatggtgaataaaagcaataccggctttggccaacatgatatagggttattacctgacatttcaggggcccgaacctataaaaaatcctcgtctccgtctcttttacttaaatctcgcatatatcctagtaccaacgatccccatactgtgcaaataccggaatcgtgacatcaaacgtcgacaacacctaaaccctattccttcttctccatggcgcccgacaccacgtcgaagccagcgttgtttcctgatgcagctaacgccgcgatcgatgaggctgtcaaagccgtcgccgacgccgtacgcaattccttcacaccctcctccggatccgacgttgacccaactactggagaagcggtcgctgctgccgctgctcggcgcgcatccaaggctgcccacgacacactctccaccgctcttgcgtcgttctgctccacctcgcattataacattgttgggattgtagatctattatactccatccgtacataaatatttaatatttagaatatatttgggtcaaacttttcaaaatcaagtttggcgccaaatacaaaaccgtatcatctgtcaatcttacaaggtaattaggatattcttaaattatttacctcgccagtatgccattccacgtggactgtttacgcaaggagagaatcttgtggcctgaacattggtgagcgcatttaggtcctgtttgttgttaacgttatcaaattttaagaagtactaaattgtggcacatttttatgctaccgaattttgatagtatttttgtgtttgggttgaagccttatcgatctttggtaaagtagcaatagtaagattattttttttaccttgtaaaaatgtggtaatactaatagatattaggcttgtttggattattaccaatttttgtcgtaccaatattttgctagtgctaaaaccttgataacttttggcactaccaaatttcatatgccctccatttcatattataaattgtctgatttttctctaataaaacttcataaagtttgattaagtttatagaaaaatttagcaatatctaaaatattaaattagtaccattaaatctaacattgaatatatttttataatatatttatttttttaaaaaaaatactactatatttttctataaacttgatcaaactttaaaagtttaactagaaaataagtcaaacaacttataatacaaatactgtgggcctttatacgttactattgaagctgccaaaaaaaattgacagggtaaaaaatgctattaatccaaataaacacatggcaaagttggaagtgaccaaaattgctactccatccatgatccagctagatgggatgggatgaaaccatatctgattttgggttaggatgattccactcacgtgtttggtttgtaggatgtgacaatcctaattttttgtttggttgaagggataagggggagatggga

SEQ ID NO: 52779 - DNA, 270 bp, Oryza sativa
catcatagcttaaacttttagtaaagcaatagctgatgtatttgttgataatagatgtctgatacttctattctaccaaatatgctttgcctttttcatgttgtgaattatttaattgggtttcatgtgcacttgttacctatcatacaaaaggtcaaatttttttgtactgatcttcgtgtggccctcggaaattattttttcattggtctgtatcttgtattctaagatttatataagaagtaaaaaatctgaggctatttttttatt

SEQ ID NO: 52780 - DNA, 1501 bp, Oryza sativa
cgtctcctcggcgaccgccggcgctcgtccgcgcccgcgcccgccgcctcctctgtgaccgccggcgctccgccacgaccgcctgccaccacctccacgaccgccgacgctcctccatgaccccctgcctcaacaccggtcgccgccacgagcgagatgctctgcgccatcctgccgctcatcgcgatgctcgacgagagcggctgcggtgatgtcgacgtggcgggctcgagtggcggcgaagcttggaggtagggagggcggcggcggtggatccagaggagggggactcggcggcggcgaaacttggaggtagggagagcggcggcggcggatctggcgcaggggatctcccgatccagccgcggcgacgatggtgggccagcgggttgggtgctccgacggtggtggccgtcctgctgctgccactgtgcttgattgtggcgcagtcaacggtcgttgacggtgatggcaaacaatgtccatcccatctcccccttatcccttcaaccaaacaaaaaattaggattgtcacatcctacaaaccaaacacgtgagtggaatcatcctaacccaaaatcagatatggtttcatcccatcccatctagctggatcatggatggagtagcaattttggtcacttccaactttgccatgtgtttatttggattaatagcattttttaccctgtcaattttttttggcagcttcaatagtaacgtataaaggcccacagtatttgtattataagttgtttgacttattttctagttaaacttttaaagtttgatcaagtttatagaaaaatatagtagtattttttttaaaaaaataaatatattataaaaatatattcaatgttagatttaatggtactaatttaatattttagatattgctaaatttttctataaacttaatcaaactttatgaagttttattagagaaaaatcagacaatttataatatgaaatggagggcatatgaaatttggtagtgccaaaagttatcaaggttttagcactagcaaaatattggtacgacaaaaattggtaataatccaaacaagcctaatatctattagtattaccacatttttacaaggtaaaaaaaataatcttactattgctactttaccaaagatcgataaggcttcaacccaaacacaaaaatactatcaaaattcggtagcataaaaatgtgccacaatttagtacttcttaaaatttgataacgttaacaacaaacaggacctaaatgcgctcaccaatgttcaggccacaagattctctccttgcgtaaacagtccacgtggaatggcatactggcgaggtaaataatttaagaatatcctaattaccttgtaagattgacagatgatacggttttgtatttggcgccaaacttgattttgaaaagtttgacccaaatatattctaaatattaaatatttatgtacggatggagtataatagatctacaatcccaacaatgttataa

SEQ ID NO: 52781 - DNA, 935 bp, Oryza sativa
tagttggattatgtggtaaaatttgattgaaacaagctttgtttctagctttccaagtggcccaaattatagcagccacaccaaccaacattagctgttttgtggttttgtcacaagatcgaatccaagagttcagcatgtgtttcaggtctttgatctgtttcattccaaaagcgcaaatcacaacgttccaggtgaaccttactattggacattcgaaaaataaatgttggattgtctctttttgttcacagaactggcataagttgtttccttttttccacccctttttatcaaattgtcttttgttagaatactctcttttaacatcaaccacatgaaaatcctaacttttaaaggaatcttgattttccagattttcttatgtatacccctgtcatggaggatgtttcctgaagtttcagagctgtataaaaggatttaacactgaacaatccattttttgtcagattccacacaaccacatcttttttatcatttaaagttaactgattgcaagaagccttaattctgttccaatctgctagtcttgctagagatttatttatgcccactccttacgtattcggctgagttcttttaccaacttttccaatttaccaccctcattttccgcactcacttttttcaaaatgctaaacggtgtggtttttgcaaaaaaaaatatacgaaagttgttttaaaaaattatattaatctatattttaaatataattagtaaatacttaattaatcatgagaaaatgtattgctccgttttacgtgtggggtaggtgagttactcccgaactcagcctagccctgcgttcgtgcgaccacgttccgcgcgaacgttcggcgcgaacgttcgcgtggtggtcagtggccatcatcgtccaaagtccaaagtcgaaaccgacataaattagccgctt

SEQ ID NO: 52782 - DNA, 1501 bp, Oryza sativa
ccgttctttttttactcattgtttgaacatcaacataatttccgaaggggcaaaatcaatatgaacatcgaagtaggggtaagaatgaaattgcccctttccgatacacatgttttctaaatatatatttataaaactcgttacgagaaaatacatgaaaagaacatattaaattctaatatattttttaatctaggactgatttaaaagttcgagctttggctgcatgtatttgatgtcatctttttgagaacggaggtaatatccaaatagtgatatgtggtatgaaaccatctagtcatatgatttctttctttattgagtaagataataggatcacaacaatcccctatcaacatattaatatgatcagacgggagtgtaagttatttcacttgtcctataatatactcactccaataatattcatatatgaaatttttaacactcattaatatctaacagttttaacactaaactagtgttaaaaagtcatatattaatgactagagggaacctatgcatcttgtttagagacggagttccaaattgtactacgtctgtcccatgatagaataatctagaattagatggactcaaaatactattacgaatttggataggctttctgtttagattcgtttgagtcatatctgtttctaggttgctataatttgggatgaagagagtatcaattcatttattttgttagaagaagttgtttgttcctaaaaacttggtgccgaattaaatcacttcaacggtacgcccacatatccattgtcctatatgtaaacctctactaggttcattgcatctggccacctttggcacgttacatgcctctagctaaattcattcattccattaattaatagaagtaccttgtaagaagcctcatccttactttgtcttctgctcggttgttgccaaagctacttgctaggagtactaagcatgaacgtacacggctaactttgtatacgagatgcacctttccacaatcacggtgttattcacaacgggacaacaaactttacaaagaaaggaactctgggctgtactcctgccattcattcacttaacctaatgattttgcaccatgactgtgatacatgccttggataaacttaattaatctatcaatatcttttaaatatccagcatgaacacataaaaatgatatatgcagatttatttgaattagtaatcaaacttattatatatattattctaacaaaaaaatatggtcagtcatatctcgaaggcctaaaaaattaacatcatatatgtttttaactaaggtgtgcgtcttcaatttttaactttttatatatctatataaaaatatttcagtaagagtgtaacatcatagaaacaatttcagtggcagatctaataatataacttttatatagcaaatctgcataattcaaagcatattacagtatttattccggtttcataattcttaatgtttggacaatgacacagtctccta

SEQ ID NO: 52783 - DNA, 200 bp, Oryza sativa
gttcacctggaacgttgtgatttgcgcttttggaatgaaacagatcaaagacctgaaacacatgctgaactcttggattcgatcttgtgacaaaaccacaaaacagctaatgttggttggtgtggctgctataatttgggccacttggaaagctagaaacaaagcttgtttcaatcaaattttaccacataatccaacta

SEQ ID NO: 52784 - DNA, 601 bp, Oryza sativa
tcatgctcattgtttaaggggaagatttcctcatcttacgatttctgttaacatgacgattagctgtttttttttctcatggagtattcttatttcgttgatatttaactcttatgatactagattatctgactttgtgagctgtttacccaaataacatgcaatatatacaattttatatgccatgcaaatgttctatcttctttagcacatattgtggattccatacttccatggtcacatactgtggattccatacttcgatggtggttcatggagcgtaagaggggataagattgttactgtttaagtttgttacaacctaaagttagtatttatgtccttgaaaatttgtctagaaaatgctctttacatctaattcattttccaaaggactttattatacactgtatccagacgtcagaagccaacaataaattagtcattagctcaacagcgtagtcattggacttatgaactcagcttagtattaaaattcaattatcttttttgaaagcaaataaatataacattgtataccttcacagctttgttcaagatttctcctatctgacaccatcatcttttcaaacacaagctg

SEQ ID NO: 52785 - DNA, 1172 bp, Oryza sativa
tgtttcgggcatttcatgctgttttttttctttcttctttgtttgctccatgtgagcccctggggagagttttctcctcgggtctaagaccttaaatttccacatttctttaatggaaatggagggctttttgccctttgcttaaaaaaataaatctctagcaagaagatttggtatttggtaatactttgatttttttataataataaatttgtttggtttgtaaccttgccaaataatgacaagtaattttgagaaccactatagcactttgtttaataaacgatgtatggcatatgacatttccttttcttaatccggaaaatgggaaaatattgagaggataattttttttattatttttacttcctatcttagttatgcagtacaacggtttctaaaatgaatcatcattacattctctttctccacgagggcggtgacctcccaactccactactcattgtcgatggattgacacctctgggtagatctgcaccatgcgactgaggtagccccttcccccctcccccggcatatgtaagtgtgatgcaccccctacatctctttctccctccttttcttacacaacgtcctcccatttattccatctccttccccttttcttgcactacatcctcccatttattccatctccttccccttttcttacactacgtcctcacatttattccatctccttctgtagcaacctgattctcgttctggagactaaactctccaagacaatgagaaagaagaggaagatgctagacaaggtgagaaaggacaccttccctggatcgcagtcgaagtgtgagattttgatagccgattcacggctcccgtccttattagatccaactcttgcatccttagaactgactgaacatagggatgccaagacaggaaagaatttgtcgaagacatcacaagacgataaagcaagccgatgacgatgaggaggttagttgtttttctttttgtcttttatgtgttatgctctaataacaatgtcaccttgcgatagaaatttatacctgatgaggctcacgccaaatagggaatatactctctgacaagtgaacattctatgcttttctttgcctactatctttgttgggttggtccccaacatatcacatggatgcattcgtggatgaaatctgagt

SEQ ID NO: 52786 - DNA, 1501 bp, Oryza sativa
cactcttactgaaatatttttatatagatatataaaaagttaaaaattgaagacgcacaccttagttaaaaacatatatgatgttaattttttaggccttcgagatatgactgaccatatttttttgttagaataatatatataataagtttgattactaattcaaataaatctgcatatatcatttttatgtgttcatgctggatatttaaaagatattgatagattaattaagtttatccaaggcatgtatcacagtcatggtgcaaaatcattaggttaagtgaatgaatggcaggagtacagcccagagttcctttctttgtaaagtttgttgtcccgttgtgaataacaccgtgattgtggaaaggtgcatctcgtatacaaagttagccgtgtacgttcatgcttagtactcctagcaagtagctttggcaacaaccgagcagaagacaaagtaaggatgaggcttcttacaaggtacttctattaattaatggaatgaatgaatttagctagaggcatgtaacgtgccaaaggtggccagatgcaatgaacctagtagaggtttacatataggacaatggatatgtgggcgtaccgttgaagtgatttaattcggcaccaagtttttaggaacaaacaacttcttctaacaaaataaatgaattgatactctcttcatcccaaattatagcaacctagaaacagatatgactcaaacgaatctaaacagaaagcctatccaaattcgtaatagtattttgagtccatctaattctagattattctatcatgggacagacgtagtacaatttggaactccgtctctaaacaagatgcataggttccctctagtcattaatatatgactttttaacactagtttagtgttaaaactgttagatattaatgagtgttaaaaatttcatatatgaatattattggagtgagtatattataggacaagtgaaataacttacactcccgtctgatcatattaatatgttgataggggattgttgtgatcctattatcttactcaataaagaaagaaatcatatgactagatggtttcataccacatatcactatttggatattacctccgttctcaaaaagatgacatcaaatacatgcagccaaagctcgaacttttaaatcagtcctagattaaaaaatatattagaatttaatatgttcttttcatgtattttctcgtaacgagttttataaatatatatttagaaaacatgtgtatcggaaaggggcaatttcattcttacccctacttcgatgttcatattgattttgccccttcggaaattatgttgatgttcaaacaatgagtaaaaaaagaacggagcaagtatataactgctaggaaacgttgaacaagattagtagttattcaacgaatttcagttattcatgtgtgctttaactagatgggatattcgttaattgatagtagtactacttagtagaacgtaattcagca

SEQ ID NO: 52787 - DNA, 1501 bp, Oryza sativa
attcaggagtaaatttagaaaagagcatggaaaaaaaacataagcgccataattatataatacacccatatggccatatttctttttaggctctcgagtgagatgtctcttcgcagatgtggtttaacctacaaccaaaatggtatgccatcacaaacccccgaacaaactatttaccgctgatttacctcacaagaggtgcacaaacattttttcagtctttaacaggcctacaataataagcaataatgggcttctttagaccattttcaggtacgtctattttttaatttatgtgatgattggaatactacgtggacgccacgacagcgaaaaccaccttcaaagcagtcaaggaagtttatttgcgccgttttaatagttggaagagatattatatctggttttaggttgagagatacttcttataacgtaaaatctaaatcgagagcgctctcaatttagtcataacgagcaacgctagccattgtccagatacaatcagccattgtcatatgtgtgttgaagaatcttactttactatagtactaattgatcaagcaagtagaaaaaatattcctaccatctatgcttcaaatacaattttctcttaaattactcatccgatctacgatccgattacaccgctgtgttcataacaattaaatctttacaacaagatctcacatgattatattttgataaaaaatcacaaattacttttataatatatctaaattacttttagatttcactaagttacttcttaaacatataaaagtaaattcaagaaagttttaaagtaattaacatatattatagaagttactttctttttgttataagttacttctatagtatatgtaaattacttttaggctttattgaattacttttatatgtctaaaaagtaacttagtgaaatctaaaagtaatttagatatattataaaattaatttatattttttcatcaaaatataatcatgtgatatcttgttataaagatttaattgttacgaacacaacggtgtaatcagatcgtagatcggataagcagttttagagaaaattatatttgaagtatagttggatagtgtctatcatatatggagtggtagctggtttagacaaaccagctaccactagctgtgtagtcaggtccttcttataaattagatttgactatggctgtgtttagttcacaccaaaattggaagttaggttgaaattggaatgatgtgatggaaaagttgaaagtttgtgtgtgtaggaaagttttgatgtgatggaaaagttggaggtttgaggaacaactttggaataaacacggcgtatattggagggagtccatgtggacttttttccaatttccccgcactgcccgccccgacggaaatccggaagcccggcccgctcgtctaaaaccctcgacctcctcgcctcatccactctttgcctgcctccgcgacgcggctccgcctaaaccccagcgtcccctcc

SEQ ID NO: 52788 - DNA, 1501 bp, Oryza sativa
tataattttctctaaaactgcttatccgatctacgatctgattacaccgttgtgttcgtaacaattaaatctttataacaagatatcacatgattatattttgatgaaaaaatataaattaattttataatatatctaaattacttttagatttcactaagttactttttagacatataaaagtaattcaataaagcctaaaagtaatttacatatactatagaagtaacttataacaaaaagaaagtaacttctataatatatgttaattactttaaaactttcttgaatttacttttatatgtttaagaagtaacttagtgaaatctaaaagtaatttagatatattataaaagtaatttgtgattttttatcaaaatataatcatgtgagatcttgttgtaaagatttaattgttatgaacacagcggtgtaatcggatcgtagatcggatgagtaatttaagagaaaattgtatttgaagcatagatggtaggaatattttttctacttgcttgatcaattagtactatagtaaagtaagattcttcaacacacatatgacaatggctgattgtatctggacaatggctagcgttgctcgttatgactaaattgagagcgctctcgatttagattttacgttataagaagtatctctcaacctaaaaccagatataatatctcttccaactattaaaacggcgcaaataaacttccttgactgctttgaaggtggttttcgctgtcgtggcgtccacgtagtattccaatcatcacataaattaaaaaatagacgtacctgaaaatggtctaaagaagcccattattgcttattattgtaggcctgttaaagactgaaaaaatgtttgtgcacctcttgtgaggtaaatcagcggtaaatagtttgttcgggggtttgtgatggcataccattttggttgtaggttaaaccacatctgcgaagagacatctcactcgagagcctaaaaagaaatatggccatatgggtgtattatataattatggcgcttatgttttttttccatgctcttttctaaatttactcctgaattgatgtgcaagttgttaaagggccaatttgcctagtaccatcacaaaaaacacggagttagaaaataccatcgtatgtgtaattgacatgtgggtctaggcctcacatgtcattatcacgtatgattatattttacaactcacatacctttgcgatggtacttcccaaattttcccattgttatctcagcaaccattgtcgtggaagttcatccattagatcttaccaccaacatgtacagacgcatctcaacgtgtgtccttttctatcataaaggcatctgatttcaagattcaggatttagtattgacctaccaaatgaggaggtaaaaaaaaagaattgctactccatcttatattactttacttaaacaccgtgggattgctgaagaattagcgcgccacgtcaacgacgtttttgcaaaa

SEQ ID NO: 52789 - DNA, 1501 bp, Oryza sativa
aatctccactgtcaaatgccactgcccactggggattggtgcaaaaccgcaaactttgaagagcaagtttaatagtatagctaactactggctacaaatcatctatagccaatctaatagtccattcatacaatagcatatactacactattaatgtatagccctaccttcatacgcacataacgtactgagtccgtgctagttggctacaaatctgtagcccgttttccttctctctcttcttccctctcctacacatatgcttacagttgctattctactcgctctaaattcaaaatcgaccaagcgaacttctattcgcacatcccgaattcgaaagacttttgacagaaggatagtgcacgtatggtacctgcacgtacacttaggaaatgtacttctcgttttctctaatcaaacactgaggcttactaaaatgttttctccatttgcctaatttgctcatcttgttaggccaggaaactgatttaaagaagattaactgcacatctgtgtcctatatcttgcgatctatatctttattgtttatcaggacctgatattatttgtccctttctttcttaatttgtctttctctgttgctctttgcagccctgccgatacaatccctgtttcccttcttgtattttatggtgagcaattttacttgcttttttttagaggtgcaatatgatgacattttgtttcatgagaagagaagagttactagcgtcactatcgattttacatttggacttaacagctgtgctggatctgtagtatgtaaaaggtaaaaataaaaattaatatgcactgtcacattgtaattatttcatatattgagccaaggaagaaccaaatagtaaatactataagagcaatgctacacgtactaaatttttcttactaaacttttactaacaatcatctcaaccgtttgatttaagtagatggaagttacaaaaattctaggtgcactcatagcatgacacatcagtgttagtaagaaaaagttagtacgtatagccttttccatactataaacctggacacatatcaccttcattgttgtagtaccaaaagagccataatctgacatcctctattacaatgatcggttaaatatttctccttaaatatgcgtcttagatattctatcgacattttgtttccttatttggtatagatttgtcggaaacataacttttgaacgtaaaacagctttgcaaatgctgaactgtgttctaaattaattctcttttatcaacattggagtttctgtttgcagataagggacctgcatattgctaaacaagaagaagatattggattttatgctggttttgtcggtgagttttctctgaaacatatttcctcttttgcgtcaatctgagtaagcacttaaaagtagcttctaaggatgtattatgaaagtgatagcctcagcaaggcagccttatctaacagggtgaacttgtgatatgtgaaggcgcttcatata

SEQ ID NO: 52790 - DNA, 268 bp, Oryza sativa
ttccccgtgataaattgaccttctcagagttgacctgtacaaggtagggaatttaggcagcaccgttacatttcgatgtatcaaggatagttcactatattcataattatgttagagggaattctttgcatcagtgctttagtggttttagtgtctgggctcgtcagtgtggaagctggtaatttgttatcaagccatcattgaggaacccgcagcctgctctttgctaatatcccatttttgttctcacaatagattcgcatatgga

SEQ ID NO: 52791 - DNA, 1501 bp, Oryza sativa
tacagatccagactgttctatgctcaaccttccatcactgccagcaccagctgaagctttttggattacaagactctcactaatgttagttcttgcagtaatgccagagcgtcccctaactccacaattattacagttaccgctagcactataagatggtcttgttccattctctccaaggatcattcgctgatccagggatgaaaaatccacaccttgattctgagaacggttggacatgtcctggttggaaggaaatccaactgcctctggaataatccttttccggccatcaggacgccggtattctctttgtttcactggactagataaacgaggtgctttatttatgtcatcagcagtggaacctgcagttttcttctcatcttcaggtaaagcttcaggagctttctgatttggaacgcttgtagacgggttaggtgcatctgtaaaaactttgggggtgattgaaattgctggacactggaaaaccttttgcttgcagattgtttggccgatgcttcttctagcagtaactgagcagggctttcagctatatttgattgcctccctctaacatcgccatatctattcttcttcaattcatccagttcagcatcccttaacctgtatccaagctcctttgcttcaaagtgaaaggtagcaactgaaccatccaaagagcaggcaaaaagtgaatagccatcaggactcctgtcagggaaaaagagcagttgctattgagcttgcacatacacgggatactaattatagaatatgttatatggtcaaattcacataccaagataaatcaaccacactttgagtgaagaaatgcttggcaacaaacaatggccgggcactcgctgtcgtccagacagtaatagttcggtcctgactcccaatagcaataacattatatggttgatgttctttagatgatgcttttgatgctccattggcccatccagctggtgcagcctttgcgtcttggccagaagataaatgcttacggaacattgagtggttaaacttaaccactacaacaggtgcgttatgccccagaaaatcaaaggttgctgaccattcaccccgttcaagcacaggggctgagtgcctaggtttctgaaaaccatgagttgtggttatgaagtggccacagggagaccaagcaagtcgcctaaaaaatgtcgaaccaagctgcaaacacacacacacacatagaaaatatttttcagtaaggaggctttctgcaaacaagatatgtgaaccacagaaatgtaatgaccaagtccaaattcacaacaatataacaaaaacataccgattttgaccaatggccttctgtcctgtgagcaagactccagtcactcgtacgccatatgataacagtcttgtcatctgattggcttgcgatgaaagaaccgataggatcccatgtaacgcctttaactaaactggaatgccctcgcaagacagcagtgcatatgccattggccat

SEQ ID NO: 52792 - DNA, 1501 bp, Oryza sativa
gttcacataacataaaaatattttccatctttacattcttacatacaaatgaaagcacggttatatcttattttgcgctaaactaaactacagtatcatggttaaatcagcaaaaatctatgtgttgatagctcgttccaaaaagacaccatcctgaatacgaaaaaaagcagcaccatcagaacaatccacatgaaacaattgcatttttttttaattcattagcccttgtgtacgctgtgcatgacaaagaaatatgtggtcatgcactcatgcgttcgtaggttagtcaatgcatttatgtaacattagattctattgttgactttctagatcttttatatttccttctaaaatgaaatgtaaatgcatctttcatataatattgattatttagaaacccaactattacaaagtattagttttgcttgaagaagcttacattagtaagcatgttgaagttctccaaagcttgaacctacaaaacctggcctcgaacattcgtatactcagagttccactttctgtggaaaagatgtcagttaacgaccatataaatcataacggtcctagttataccctcaatacaaaatcaatgcttagtgaggttgaataacgaggttgttactacaagataatacacctgaagtgctgtcagatagttatggattgaaaacatttagatagtgcatgaaccgagttacctgaataattgacaaagcaattaaggacatatcacataagatttgttctacaatgatttctcttaattccaaatagcacatgcacataatgtagagttagcttgatccattcaagaagatctaaataacccaatttcacataaatcatataagcaacagcactgactatttgtgttcatatgaaaaaactataattgatttgaagacatggaccagctgctggtcataggatgatcactctgtatccttgcctaacatgtgctgaaaatgattaggatagcaaaatctgcataataaaaaaattacttaaggggaaattagtatgttgtgtagccagaagcaaagattatctattaaacaacgctaaaattcaagctagctagagtggcgtgccttgagaaaccattgcatcaataacgataacaatggcatgcaagaaatggttagattgcatcagaataggcagatgtaccataattagaccgataaatttgagaaaataattccgtagatgataactatagatgggagaaaccatggtaacgtgcaggctaaaatatattgagtaggaaatctagcatccatatacaaataatattggcatatcggatagaacctattgcaaataccggaattgcgacatcaaacgtcgacagagctgataaagcaccagaaccagatggcttcactggggcattctttaaagtttgttgggaaatcatcaaggaggacatcccactggtgttcaactccatcttcaatcttaggtgtgcgcacctcaacctaatcaactcagc

SEQ ID NO: 52793 - DNA, 1501 bp, Oryza sativa
tactgaccgcattgagggcggtgagtgaacctgcaaagagctgaggcaatggcggcgactgtaatattcacgttggtttggaaaaaagtgcttgttttttacatctccggaaccgtacgacggattcagaaatctccggttgatcattctgttattcaaaatatacttatatagttattattaattttactgagatttaatttatcattaaagttttatttaaatatattttttatatttatatatttttttaataaaataaatgatcaaacgtttatgaaaagttaatagcatcatagaattcagagcttttgtgttcttagagagtttttttattgctgggaaaagacagaggcagcagctctgccgtttgttttatcctctcttcacttatatttagagacgaagggagtactgcgtatcatatataagaacccttaattgactatagctctagtccaactttggtccgttgattatgaaaccatttattttttccccaactcttaaagtcgttaattttgatccttgatgtcaaactaagatgttttctgagatgatgtggtgccatgtagcatcttagttagcaatttaaaatgattaatttctaggattaaggagaggaagaggaaaaaaattagtttcatgtaggttgtaggattttctttttattattattattatagtttcatgccactcaccaccgctagctgtacctcctcctatcgcgtcggtagctggcccttgataccatgacgccggaggccaatggagatcacaccggctgttctctctaaaggtgtgtgatctaatggaaatttattatacatgatctaagggtgtgtgatctaatggcaagctcgtttggccgttgcgattgttcggttccatttaatgtggaatggacgagccaacgatgccaaaacatctttctgatgtaaattgagatattttaaaggattaggttctaagtgagtagtacttcatccgtaaaaagaaaacacaacctagatttagatagaataaaatgtaggacaccaaatctaaagacaaatctaaagggagaactatccaaatttattgttttatggtacgtctcatttcaatataggttaatttattttttttaagacgaaaagagaaggttgtagttacaagaggtgatttgtgtacatctgtactatattttgtgtgtgttgaaactgtgaaagaggaaagaaaagaaacgtaggattgcacttgcaaaaacaaatttgactttggtcggtgtaccactgaaagtaaactggaaaaacataaaaaatctccgtggcgtgtagcaagactagtaaaagatgcaacgtcatcatcttcatcgttgggaatgggatagttcatagtttagtgcccacctacccaaccaccgggaacacctcattctcttctcacgccggcgccgcggcgtctcgtctcctcccaccgcaacctttcttcttttgcttagctttcacttacactaccc

SEQ ID NO: 52794 - DNA, 749 bp, Oryza sativa
taccatagataggattcaaaacctctctctctctctgtagagcaaaaaagaaaaagctagcacagagctgctcacttctcagtatagaggcagaggcagagacgacagaggcagcgcgattctttctttttggcctcctctcctcttgtctcgctcttcttcttctccctcttcttcttctatgagacctcgctctactctctctggcggcgcggccacactgctcttcttcctctgatcgagacctctctcggcggcgcgcacactggtagcgtggtgagcggagcggtacactccctactccccagtgcttcttgttctgtatacgcatcatgttcttgcatctcacatcttgcaatgtttttcatgttctatccgcctccctcttctttacaatctgtttctcgatctattgtgtgctagcttcttttcttaaagaaaataatttggataaagagatgtcgctttttctacatctcgctcatgctgcatgcttatatatgtttttccattgagatcgattggacagccatggttccaaaataactagtttttaaaatgtttcaataaaaagagcatcttttttcttgtcttgtgggcttgtggttagtacaaattttcggtccgatgccaaccggggttttggtgcacatacgaatgccagctcctctatatagtttttggatggtgtgagaggccaccatattcatcatcaaaaggagctgatagatcgatgttgcctgtgtcca

SEQ ID NO: 52795 - DNA, 1022 bp, Oryza sativa
  unsure (1)..(1022): unsure at all n locations
ttattgctgatattaatcagagtttccaacgggaggagagatttgtttttgtttcaaaagctaactgcagatcttatgattgagtaccaggtcgaaagtgtgagtttgccctttattatcctctcttttcccccgttcttgccttttactttttgaaaggttcatcgatagcaattttatttgtcttgtcaatttagtacgatcatgtacctgttgcagcctttgaaatataaaactccatcatctgtattaaattcaaaaaggagaggcaacttaagaaatccattattattgggatgtctagttttgtgagaacatatgggggaaaacgacagttaaagatttttctctgatctttcaaaattggattatatggatttttgtttgtccagaagagggggagaaatctaaaaaagaggattattcaacgaggaattcgtcaaaaattgcagttctgtcctgtcgactggatctttctgtgtggttctgagcctattgctttttcaacaaaacagataacttttcaatggtcaaacgtttctgattcctttaatcttaaacaaatcagaggaaataaatgccagattattattcaaatcaggtaagattattattcacgcaaaggtctggcttccaccgtgccaaacttcttttttgacaaaacaaaagagccaaaaaagttactatattagtttgtttacagtaagtggttcatacttcatactacatttatattacccatttttctctaattcacttacgcgctaaaaacagttctctcttttagtttgtaataatgtagtgtttatttccacacacaaacaccaaaatcgaccctcgntctattgagaatccgcgagtacaatttgctttcttgcaccaaattttgtcaattttgggtacacatttttgtcaattttgagccttcactaaatacaaattcgactagtggatttttttccaaccgattattcctttgaatgattatgcctaatgggcatttatcctcccctctctgcaga

SEQ ID NO: 52796 - DNA, 1501 bp, Oryza sativa
tagacatgctaaaactcgacaattgagtttaggtcataagtagtgctacatattctatcaataaaaataactaacttttatttaatcatattaatgaatgaggagaaaaagaaataagataaatatacaacaccaaaacaacctatttcattgcatggatacatttatataaatggtatttgatctactagtttaaaaaataaataataaaaaaatattatgtactgttaattaggctcgacataagctctagctcgactcaacaaagctcacgagaattggcacatttaggcttggctcgtctagagctcgagcctataaaatgagtcgtgctcgagcaggcttgcgagccccgagctttgtgcatgccccctggtcaagcaagctaacaatgatatatattttttgataatggaagtacctccaagtatcactttcggtctctgtacaaattaggagtacatcaaacacaatggatgtgtgtactgtccagtgtaccgctggacaagctagctaacagcggatatcttttaaggtaatggaagtatgtatcgttctggtccctctgcactaattaagatgcacaaaaattatatggagaatgcttcagatcgagcatgcccttacctaggaagagtataatgtatgattaaacacaagtaatcaagtctactagagaaagagtgaatggtaggaacaccaaaaatcgaacttttagtgcaaataaaggttaccctcgaatctaatggagatgcaccagtcaaacttccagataaaagctagttaggccgaaccctagccgccggttagaccgcagtgatgccatcggttagaccgcctaccacccatcggtcttcccgctagtctgaccgctcctatgccgttggttaattaaaccgtcggggttcagagaaaaacacaccaaagatgctcttgaagatggatcaactttattgcatctcataaagtgcatctaaagcattcatctctaaactcacgaactagaattcaagcgtcgaagcgaaacctattttttttctctcccaaaaagttgatatagatgtatacttctagcctcaacccctgtactatttatactcaaaacatggttgtccctagccacgaatccaactagaactaggactcctaatcatataggaccccaacaaaataactagggaaataacatccccatacaactctatactctaatcttcccaaacttggactccaattaaaatttgactccactttccatatgaaaacattcacttccacgtacattattctctatcctgagcatccttgcatgatatccttgatcgtctgaacttcaacttttcccaagcttagtctcgatccatcattggctatactctcattgcctcaagcaacgcatgcacatgaacaacaaagaaactctacatccaagtgcaagttcgcaccaacttgactcatatcagcatacaatagtatcacatatgaatagaaaaccgtctaa

SEQ ID NO: 52797 - DNA, 1501 bp, Oryza sativa
cgttagaccgggttgaccgacgatcataccgacagactctaagggcacccgcaatggttatctataggctctctacaagagatccatgtcagcatattttcctacttggaagagattaaatgaagagagagagcaaagctatctactaacctggagatagtctatagagaaatacgaggcaatggattagagagctatagatacccatgtagacataccattgaagtggtttactattaatctagtctattgctgagatgtacatgttttacagatatcaccttactttaccattacgggtgctctaagagggagtcggtttcgggttgtttcgtgtaaattatagattgcttcattatataacttttagacggttttctattcatatgtgatactattgtatgctgatatgagtcaagttggtgcgaacttgcacttggatgtagagtttctttgttgttcatgtgcatgcgttgcttgaggcaatgagagtatagccaatgatggatcgagactaagcttgggaaaagttgaagttcagacgatcaaggatatcatgcaaggatgctcaggatagagaataatgtacgtggaagtgaatgttttcatatggaaagtggagtcaaattttaattggagtccaagtttgggaagattagagtatagagttgtatggggatgttatttccctagttattttgttggggtcctatatgattaggagtcctagttctagttggattcgtggctagggacaaccatgttttgagtataaatagtacaggggttgaggctagaagtatacatctatatcaactttttgggagagaaaaaaaataggtttcgcttcgacgcttgaattctagttcgtgagtttagagatgaatgctttagatgcactttatgagatgcaataaagttgatccatcttcaagagcatctttggtgtgtttttctctgaaccccgacggtttaattaaccaacggcataggagcggtcagactagcgggaagaccgatgggtggtaggcggtctaaccgatggcatcactgcggtctaaccggcggctagggttcggcctaactagcttttatctggaagtttgactggtgcatctccattagattcgagggtaacctttatttgcactaaaagttcgatttttggtgttcctaccattcactctttctctagtagacttgattacttgtgtttaatcatacattatactcttcctaggtaagggcatgctcgatctgaagcattctccatataatttttgtgcatcttaattagtgcagagggaccagaacgatacatacttccattaccttaaaagatatccgctgttagctagcttgtccagcggtacactggacagtacacacatccattgtgtttgatgtactcctaatttgtacagagaccgaaagtgatacttggaggtacttccattatcaaaaaatatatatcattgttagcttgcttgaccagggggca

SEQ ID NO: 52798 - DNA, 1501 bp, Oryza sativa
accatttagcagtttaaaaaacgtgcgcgtgaaaaacaagggagaggggtcgggaacaagcgaaaacgaacgcatcctaagtagatccgattcccccgtttagtagtttaaaaagtgtgcactacttaaaaaattgaagatgtttttgccggtactttggtaagtcatccgtgtatgagtcggtttttaagttcgattgcttttggaaatacatattgtatttaagtcggtttttaagtttgttcgcttttggaaacatagaaagagtcgtataagaattctcttttaaaaaaactcgcatggtaacttaagacgatcggacttctaattatagctcatgaatttctaataaaatatatatccaagtgaattcctacagtgaatttcaccttaactagaccgtataacaacaataaaattaaaatagcattcacccattgcaacgcacgggcatttttttctagtaaatataaaaattgaagatgtttttgacggtattttggtacgtcatccgtgtatgagtcggtttgtaagttcgtttgcttttagaaatacatattcatgtttaagtcggtttttaagatcgttcgcttttgataatacggaaggaataatataagaaatctgtttaaaaaaactcgcatgctaacttgagataatcggattcctaactacatctcattattttctaaaaaaatatatatccaagcgaactcctatagtgaattttatcttaactaaaccatataagattaaaatagatttcacccgttgcaactcacatgcatttttctataataaaataataaaaagaaaatcagaagctttatatttaaaaagtaaaaaaagagagaaaaaactaagaaaatagtcaatgacaaatacactcctttgtttctctccttccattgggagaaatttcagtatttaccatccaatacgatgacctttaaggagctgccacacaatacgctggcctttcaaaatttaccaccaggcacgcgaaattcttcatttggagccactccgtccgcctgcctcgccgtccatccgcgcgactgtctccgagctaggtggcgtcgtcgcccaggcacggtcgtcgtcacctcgcatcccgcccccgccgccgtccccatccccaagctcgttcagcaccgtcgccaccgccgtccccaacctccatcgccaccattcccatccccaagctcgttcagcgttgttgccatgctcgcgccccatcgccgccgtccctgagctcgtctgccactgtcgtcgagctcgcattccgttccgccattgctgccatgcccgagctcgcgtccggtcgccgccgtagtcacccccaagctcgcgttccgctgccgccgccgtcgccccagagctcacgttccgctgtcgccgccgtcacccccgagctttccgctgtcgccgccatgcccaagctctcatccgatcattgtcgccgtcgcccctgagttcgtgttctgctgttgaaccgcca

SEQ ID NO: 52799 - DNA, 810 bp, Oryza sativa
cccccccccccccccccccccccaacacacacacacacagcgcctcgcgcgcgcttttccgccgccggcgacctcgccggagccgcgcgggttctgtgtacgcccaccccctccctccgtctcccaccccccgccctagccatcttcccttgcgcggcgggcaacctcgcgcgcgcacggccagcagcgagcgagcaggtttggggggggagaggcgacgcggccgcgacctcgttccaccgcgccggcctccgtcttggctttgttcgaatcgaatcgaaggtatccgttcttctctctcgtagccctcctcctcctcctcgccacctcttgagccgggcgtgccgtagtggccgaggtggagatccaatacgaacttgatttcgtttcctccaattaacccttatccatttgtaatccatttgtttgaggatttctttgatgtgtagtgcggcgctcgcagcaatttcctccaattaaccgatgtattgtcatcaccaatgaacaaacacgctaggaaatttgatatacttttggaatgcttgtgttggttcttgcactagacctgacctatgccatgcggtatatctttattttgttgaagctgtgatgctttttgtatctgaacaaatcttccttctgcgtcgcagagatggccggaaaagggagctacgttccgcctcagtacattccattatatggcctggatactgaggaggatcgcgtttctgcggaggagaatgatgccgcgcgccacaagttaacccgggatcctacacaatggtcttcaggcatctgtgcttgttttga

SEQ ID NO: 52800 - DNA, 1501 bp, Oryza sativa
ggtagggaacataagacaatgaatgacttgtgcagtggtgaagatagtgataaacaaaatatatattttttaaacttcgttaaacatattatgaatgcaaaaaaaattaccattaataaatcatggtaaataatttgttgtcataaaaatatactccctccagtattttaatgtatgacaccgttgattttttcgaacaacgtttgaccattcattttatttaaaaattttatgcaaatataaaaatatttgtgccatgcttaaagaatatttgatgatagatcaagtcataataaaataaatgataattatataattttttgaataagacaaatggtcaaatgttggttaaaaagtcaacggaattaaaatatggaggtagtattaattattttcaatcattatacttgcattctaactatacgcttcttaatagtttcatgggccgattctagaatgaaaaaacgaaccccgtgctggccgggtttttgtttttgttttgcggaatgactttttactctgacagtgtgaatttgggtaaggggagcactattgcaatgaactatcctctctacgccgccgattctatagaatagaccgcaggagagtgaattatattcgcttttcagaaaattaactagctagtcaaagccgcccggtcagttgttctccatcttgtcagcctcagtcaaaaattaagatttacacattagcttttgagttaattttgatgtttttaactgtagtttgttttttagtgttgacttttagtgatcggctgtacaagtcatgtgcattgtgcaatatgtgcatcatcgcgatcttctaattaattcctgtaagggagggaggatccgagtaagtattcctatatgggggattcgggtcatatataatcagtactccacgaaacgatctactacttcacaatcagtgttgtcttggagaatggagtatctaaaagaaatactagcaggactgtacgtaggagtagtctgtactagtactccatagtgtactccgtttctttcttatagttcttcggaatctaactgctaacattgacctcttccgagtctaactgcattgaccagtgacacggcgaaaacaatcactgaccagtgatcgatacaacaatacgtttcccatctctacggtctacgcccacgtttcacatcttgtgctaatattagctccgtttctaaatatttaataccgttgattttttaagcacatatttaaccgtttatctattcaaaatattttatgacatatgtaaaactatatgtatatatataagtatatttaacaatgaattaaatgataaaaaaaattaataattacttaatttttttaataagacgaacaatcaaacatatttaaaaaagtcaacgacgtcgaatatttaagaaaacgaagggagtactagctagctttagagcaagtataatagtaggctataagctggctaaatgctgaggtgtaagagagaagagaggag

SEQ ID NO: 52801 - DNA, 1501 bp, Oryza sativa
aatcgatggatcctatccggctcaagcgtccatcaatttagcttttttttctgacagatttttcagagcgatttattttttaatcgacgatgtttttttcttgcacggtttttttaaaccattttttagaaatggcgtgttttttctgacagttttttcctcccttttttttaagtaatttttttaccgacgatggaaataattattgtcacgcggttttttattttttttacggaagatggaaaacctttttagcgtgttttttttgcgcttttttctaacttttctcacacgtttctttgaactgtttttattgtcatgcattttctctttttaaatagttagattagattagacataacgaagattagaaatcggaatttggttcgcccttttcattttttttctcgcgcgcattatttattttatatgaaccagctttttattttttacgaaccattttttcttcttagagaatcggacgaacttttttagatgttttttgggatttttttcatctttatagcaattagacctttttttttcctttttaaaggaattagatctagcatttttttcaccactttttttttgccttttataggaatcggatctacggtttttttttgccacttaggagaaacggacttttgttgttgttgttgtttttctttctttttctttattttcttttattgtgcggtttttctttttctttttatgcacctttctgtctttattcttccccttttattattttttaatcaaaaacgaccttaataccttatttcaaacttatatggactcaaatgtaaatataaaaattacagggactcaaatgcaaaagtatagatccaaaaattaaaatcatataaaaatggaatgctctcgaccggtaggtttcgtttttgcaaacagatctttaatccggcacatcaattttatttttcgtttttaagggtgatttagatctagagtcgaactttcttttttcctttcttatagcaatcggactttttttttatttttttcgctatttttttttgacggacaggaatcggtcgagtcggactttttttttattatttttggatcggactcttttttccgcccggtttttttccctcgtttttttttcaccagttttttttcgctccgtttatttttgttggatcggacgtttttttctttctcccggtttttttgggatcggactcttttttcgtccggtttttttcgctcggtttttttctcgtggtttttttgacggacgatggaagcacctcttattttttattttttattaagtagtagatatatatatatacacacacacaccttccgttctggttttgggtgagaagaagaaatcggatcggattgaggaatttagggaaacggagtgtgacctcggtggccgtgctgtgctctcgacggtggagtggaattcaattggccggggaagaagagaagatgaagatgatggatagccagcccagtt

SEQ ID NO: 52802 - DNA, 1501 bp, Oryza sativa
ctggggatccaatccagggcagtggacgcacatgtaggagacgcgcggcgggggcgccgcccagaaggatacctcgatggggtggccggtcctggtcctggacgtggcggtggtggcgttgccgtggttggtggcgatgtaggcatcgcattcgaggaggacccaaggtggtgtcgtcatcgccgcagtagcgacgtgggtcggcggccggagggactcatccatgatggtcttctcctcccaatcagaccacccatcactctcatctcctcccatgctctatatgcagctactatctactccctccgtttcgttttatttgacactgtcggtaacatgggaccggaagtatcatgactagaggcttgaggcagacgccatcgcccacgtggcctggcaccctcgggggacgtcgggcccgagggtgatgtgtgcgcccacctcttggtctccccgagggggggggggggtcggaccactcctgcctcgcccccgagggccgaggcgccccgacccctcgcgtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcacgcttcgccccatcccgtcaagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctaagccgacgcgtggtggacaagaatgaccgatttgtgaccggtctgacactgctcatgtcgtcagcacacagccgccttcccacgacgtgcccgcctcaggcagaagtggaggtaggtgtgtgtcgtcccgtcaggaggatgttcggaggacgaccgtgcaaatctccgtccatttatgaagagaagaaaagtccagtttggaaagagaggggtgcatgtggtatccccttgaagtataaaaggaggacctggcccatagagaaaggggatgatcttttccagattcagaacctagaacgagggagaggttggctcacactttgtagctccttcatacacagatccaccaaaacacaggagtagggtattacgcttctcagcggcctgaacctgtatacatcgcttgtgtttcatgctcttttgggaggtcgcgatcttcccgcatacacggagagcttgagatctcaccctgagcccccggccgaaccggcaaagggggggcctgtgcggtctcccggtgaggagcgccgcgctccgtcatctggcgcgccaggtagggggctcagcgtgtgttttctgagctctcgcacttttccgtgtgcgtcaagtttttcttgatcagcctca

SEQ ID NO: 52803 - DNA, 1501 bp, Oryza sativa
ccttatatttgagtactgctacacatactaaaatttttttacaaaactcttactaacaaatttctcaaccgtttaatttaactagatggaagttgcaataaatctagatttactcacagcttgccacatcagagtttgtaaacattttgtaagaaaattttagtacgtatagacttttcccttatatttaatccctttgcatattttttattaaaatcctaaataaagattgtagtactaggctctcttttagcatagctctatagatccaagatctaatagagcgggggtatttttaactttacaaatcgacaaatctagatatatgattacatatataacatttgaagaaatcaatttattcatattttaggtgaaatttaactgtaatttaacatacaaatatcaatcttcttccagtttttttttaaaaaaaatcaatatgtttgcgctcatcttcttcctcactcgatcagttccccaaatcccccaccctatccaaactcttcctcccccgatccaattcgactccactccatctccctcctccggatccctaatgcacaaggtgtagaattaaattccggggaaatcgacggagtcggaggtaggcgtagcagcatggctggaggagatgactggtcgaagaggacgatcatggaggaatccctgcagccgccggcccacggcgctgcggcgactacaccttgggtcctcctcgacatccgtgctttcatggccaaccaccgcaacgccaccaccgccatgtccgagaccaggagcggccaccccatcgaggtatcctcgtggacggcgcctccgccgcgcgtctcctacatatgcgtccactgccctggattggactccaagaagttcgccaccgagcccaccatcatcgccgcggaggccgacctcctcctcatccgcgtcgccatggggcgccggaacatccgcttcaagagcagcttccatgactacttcgtctaccaggccaccaccccaaccccgaaactcaccttgctcccgccccctcccatcgacaggttcatcgaccacgagcttggcctcctgcgctgttgcgcctctcctgattacattgttgctgcactctgtaacaccttcgaatcaggatactttgagtatgacctccacatctactgctccggcgctgatgcttggacctgccatccaatctccctccatggcctggtcgacacatcatttacccatatcaataccaaggcaatcaccattggagggaaggcgggcaccatgggctgggtcgacctctaccgtggtattctcttctgtgaccttctccgcgacaccactaagctccgctacttccccctgccgccgccgctcagtcccaacaactcgttaacaggctctccaaggcctcatcgtgacattgcccttgtccaaggtcggatcaagttcatcgagacgcggcttcatgtcaagccaggttccatcatcaacggcaccttcatctctcaag

SEQ ID NO: 52804 - DNA, 1501 bp, Oryza sativa
aagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgcttgcccttcttcaaacaacatcttgcttgtaatggttaggatgaagcctggcatatatcgatcggggctaacgtgtcatctctgggatgtaacacgctagctccagccggggacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccccctcggggagaccaagaggtgggcgcacacatcaccctcgggcccgacgtcccccgagggtgccaggccacgtgggcgatggcgtctgcctcaagcctctagtcatgatactcccggtcccatgttaccgacagagcccccggcgttatgccagggcgatcgcccttcttatgggaagcggccgggcgtgacgccactcctaaagcctggtgacaggtgggaccggtctccatggttgggcagaaacccaacggtctcaaaccatgcacaccggttatggtaatttggctgtcaataatgggcggtctcttcaagactgccacatcacctgagcggcgaatgaatctgggcgagccgatttgcttcgcctggagatacggtaatgtcgcttcggtcggcgagcgtaattaacgcgcgcacgatacgatctatctcgactgccgcaaccgcatatccacctcacgcgccgcaagcgggcgaatgggatcagtggaagcgtgggcgcgagaaacgagggggcgaaataatgggcgcgagaaacgaggagccgggcacagcgttggcaagggtataaaggcactgaggataggatttgtttccttcctttcgccatcattccccttgccttcgccgcttgcgccctaactccttcttccctgcgcccttctttcgccacacgcgctcgctctccatcttctcttcgtccggcgcca

SEQ ID NO: 52805 - DNA, 1501 bp, Oryza sativa
agcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacaacgcggagccggtggtagcagcaccagaggccttggtggcggaggaccgcccaccagcatctaggcgctgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacggcgtgggttcggctccccgtcgtcgccactcacactgggagagaggtcggacgcctttgcttgctcagccatgaggctgatcaagaaaaacttgacgcacacggaaaagtgcgagagctcagaaaacacacgctgagccccctacctggcgcgccagatgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgctgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtcttgacgggatggggcgaagcgtgcgtcagaccgcctgtcgccacctaacccgcgatttgaccggtctgtgactggtcacagaccggataatcgagtgcactgcactgcacttcgtgcggcgtgacacgcttaaccga

SEQ ID NO: 52806 - DNA, 1501 bp, Oryza sativa
cttatccatgggatatttgttgggtggcatcttaaggaagcaattacatatatttagtggtcctgactgacacagcaaatgcctgatgaagtgcaaacccaaatggctgcattgttaatgtgtctgtttacctgatgcttatgcttgcatctcaatttcagcactatgtttgttaaaggcttcaactgcacctatatttcttcttcatgtacagaggccatctcattattggcgttctgttttttcttactacttgccattaggacgaatatgctatagaagaatttgataaatgctcgatccaacatgcaactgcctatttggattaaaggttgaattatcaagccgggcgactaatgatatttttcggtgatcgaaaaattgtaatatgtgtcgaccgttgtttatagtggagacaatatcagcgaagcccaagcggttgcccgatctacccaggaggtggctccgccactgtttatgagctgtgatgtggaccgaaatatataatatgacaagaaaaacaaatgcatatgctttgtgcatggaaaactgaacttgttgtccttttgggttgtcttaagtaaacataatgccaaatgtacgatatagcgcccatttaactttcctctaggtaatagcagtagtgaagccttgaaggtgtcattaactggcattctgagtcccgagaggattagcttgcctgtatttttttatcagattgtgtatatttaggcgccggcgtctgtgcatatcaaattatttggtgttgctgaatgatgctttccataaccaaattaaccgcacatacaaaaaggggaaatggaaagataaggcaaagaaagagatccaaatcaagaatattttttttcaaaatattaaatgttaattttgtcctaggtacatggaaatcgcttcatcaagagaagaaatggatggaggtagacatgccaacgtcttcacatgatggaagatcaaaaaggacagagggcttctttatttagctacggagtcgcggcttcatgtaatagtggtagggacgggatcttcacgcgagtatgacaataatgataggtcttcatggacgagcgatgggccttcatgcgacgatggtgacggcttcacggaactagagcgaaaataatgacttcataaaaagatagcgacaacttcacgcacactaagtggaattgttaattactatgtttggagctctggtgaccgatcgattttggtcacatgacttaagctaattggcatgctagttttatcggatcaggtgaaggaaaaaagttttaaggtggtataaaaatgataaaaatttaacaatcttattcttaagtcagtgaatagatggaagttgaggaattgaggcatatgcctgcctccttcctcctcatgtcatgtgttcctctcctcttcatgtggagtcttgagtcttgacaagcaaagaaggaaggaaacctcctcctcctcttcttcggctccaaatcaaccaaacaaa

SEQ ID NO: 52807 - DNA, 519 bp, Oryza sativa
tttgcaggcggccccccgcacagtgttaaactgcccttcctaagggcggcaagggggccgcctgcaaaatggtagtagccggccgttaggaatgagctaacggctgtttgccacatcacaaaaatcgccctttgggagggcgatttttcccaaagggcggcgggcgactaattttgtaaaattttgaaacacaaaattagttttgtaaatattttaataaaaaaataaaaataaaaaaaattctccaagatgcaacgcactggcctgcctagttatgtgcatgctgtgtgggccgtaactcactctctccggaaggcccaaaccgcagctcaacgcttctctcctctctctctctctgcagcgcttccacgctgcactgccgtctgcagctgtgctcaggaggataaaattgcggaggggatccacagttccagccgcgtgtgacagcggcgtgcggttgccgcggcgtgctgctcgagccgctttacgactgatccgagcagctttttccggcgatca

SEQ ID NO: 52808 - DNA, 402 bp, Oryza sativa
ggcttcaaggaaaggctgttatttttgtaatttattttatttgaactcttttctaaaacgactaggtgagtgcttctcaaacgactcggatgagacagtgcgtctcgtccggtcggagtatgtgcaatgcatcaatctttagaattgaaacagaattggcacccggccaacagcttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaaacacctcacatccgcccatgaccatgggcacggctgttcgaacagtttgttaacctctgcagagggggtacactttacccaca

SEQ ID NO: 52809 - DNA, 163 bp, Oryza sativa
tggtttaaaaatatgtaaatagaaaacacatattaagggcctacagcatcaagtttgctctaggacccttgaaattgtagagccagccttgtgtttttcatgtgtgtttggttggtgggcagggtcgggatacggcggcccggagaagaatattccccttaga

SEQ ID NO: 52810 - DNA, 162 bp, Oryza sativa
ccaacaactacaacaagtcaaagggttctaaccaagggaggaagatggagaatcttaggaaggcttttcaacaagtttgcgccgctttcgagccactaagtgatgtagatggtgaaagtggagatgatgataagggaaagaacgtctccgatgtttgcttca

SEQ ID NO: 52811 - DNA, 1501 bp, Oryza sativa
tccaaaaccgcggaccgggaacgtaccgggtgtacggtttcccgctcttgcacttaaggaccgtttccttggaatttcatccgaacataagacaagtacgaccacatgggtggaatgggacacccctggctaagtaactagcttatcaggggagccttgatgccgagagacatgtggattcgccggggtggtgtcggggaggacccctgggcttcctggcacagtatggtctgggaactaacctgttgttggtctgggacccctctcgttggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccatgcccatggtcatgggcggatgtgaggtgtttcctagcgtagttttgtttgactactgcttgtgaaattgctgttgtgaaaaggggttcgatgtttgaaaaatcagcagctgacgggatcagctaggcccgggtggccgtttgaaaagttgttggcccgggtggccgtttgaaaagctgttggccgggtgccaatcctgtttcaattctaaagattgatgcattgcacatactccgaccggacgagacgcactgtctcatccgagtcgtttgagaagcactcacctagtcgttttagaaaagagttcaaataaaataaattgcaaaaataacagcctttccttgaagcctgcaataaacacttattttccctggcttgctgagtactcccgtactcacccttgctctgtataaataatcccccccagttgctgaagaagatgaagcggatcctgctgatgaggagttcttccaggagcaagccggctacgatgagttttatggtttcggcctagttcccaagtcgcgcctgtgttgtgtggtccaagtcctggcttccgtttcccttttgtaatgcagttgtgagctcgggatctgtccgcagcccaacatgactgcacttctactctataataaagagacttctgttgctgtgatattctgtcttcctgtgataccagcactgtttcctgggactggttaatttggagcgtcacgggctagttccagtcggaactagttcggggcgtgacaagagatggtatcagagcacaggcttggccctaaggcgaaacccgacgtttaggacgaccctatggatactaagttcaaaactacttgcgaaaagctaaggtttcttttgttttctttattttcaatagtttgtttctaaaatggttactgatctttctccctctttcaaaattgtagatggcagtgagcgccagcttcagttcccacggttttggtgagggtcaccacgtcgctcagcttcgtgacctcgcctgtttccttggcttctcgtgtcccgagtacacggggtactccgtggaccgtgttccccctcactg

SEQ ID NO: 52812 - DNA, 1501 bp, Oryza sativa
tcctgtaacgaaggtgatgcagccatttaaccatggagaagagggaaacggatacaatgctcataatgatgttgaagttagtattactccaacagcacaggatcattcttcatccggcgttatgacagatggaaacaattgttcaagctgctgcaatgcagggttggcagagggtggaggcttacgaggcgccatcttttccagtaaagaagcagctgccttcctttctcaaagtaattatctttctggttcttgcactctttcaattgctggtggttgttgcgcatttttatatttgttaattgctagtggctgttccacttctttttccaattggtgctgatggtcaccctttctttttttccattactactgtttatccactcgcataccgtataaaaggttgatcaaacttataagtacatctccttgtttagctggaatcatggtcatgtactgtttttgtaggatggaaggaagcaataaacgcagatcatgtgaagcttgtcctgtgccctgaaggctgaagcaagtaacgtgggatcctgttgagccggcgaagtagcaagggttgagtctgcatcatcaaccaatcggagttactagaactagtgaagttggcagaggggggttcctggcgtgtgggcactactccgtaggaaatgaagtgatggctttttgttagacgagcagggaattaagctgcattttaatttggtttggagtagatgacagccggggttcatgaacattgaatttatttgtttatatatacagttatagttatatgatatgacagccggtgcgtgcgttaacattggattcgttgcaaacatggacaagattagtgaatgttgtgctggttttggttttggttttgggttgcatgtatgtaattgtaatatactccatcatatcatatcaggagtaaatggggtatttactgctccctccgtttcttatgtttttattgtaaggcgtattttgtttcgtttgatcgacgatgactgaagaatagcaattcaagagcaatgttttttttttcatttttggttctggttcgtcaattgatgatggatggatgctctccttgtggagaatttagagaatttaccatcaaattcttcgtatgccacttttttagcatcaaattctcatatcttgactttttttaccataaaatttgttcgtatgccacttttttagcatcaaattcgcatatcttgacttttttaccctaaaatttgtgtctggactattttctcatccaatccgtatgtcctctgtaataaaatctcgcgtgccataactattttctcatccaatccgcacgtcctctataataaaatcaatagtctggctgctgatggtgatgatgctgacttgtgacgagtagtccactgactagggtagacagtactaggacgaggcaacagcgactgcgttgtcccacccacacatcttgcggttgcgcggcggagagagagattgatgatgtctt

SEQ ID NO: 52813 - DNA, 1501 bp, Oryza sativa
cttgaaaataacgtgtttagctgcattatattgccgaccggccggggagatatatacaagacttcactgctaatcttccaaagtcagtcgtcgatcaaggacaaacatgtacgacagcgtcttggacagaaatttcttggaaaactcggaaccctcagctggaacaataccattcgttcttgtttctatctgatgaacaaacagacaagccattaattacaaaagatttgtaaaaatgatgattttagcttaaaaattcaaattgaatagaaacattgatgagattacagtctctcctatgcaacttgtaaaatcatttgcagttgatgatctaaatgaacctgccgtttcgcaaaccaagtatgcagcaggagttagtggctactgaatactgagagggcaaaacaatactgccaagttggaagtggtataatttcctgattggattgcattttgggacccacagcctgatactgctgctggataccatcaagctgttgaaacctcagaccatggtaaacaagctttaaaacccccggctgtctctccccacctttggcccttctttcaactgatactttctagttttaagaataccatgaagttgatggtattgatacagataccaccatgaagtgaagttgatgaaaagtggtgcaccacaataaggtactttagcttccctttcttctggatcaagttcagatatactcttaccttcttcctttcaagccttgcttgcttctgctgctgaaccagatatattgacaagatcagaaccacaatttgattttagttcctgatgtagaagagggcaagaaaagatggatgaggaagagattcatattgcggttgggaagaacttcagaaaggagaaggctaacatcttatgggctgctgcaaggttcccaagggccactatagttcttgttcatgttcactggccttccaagtggatgcccttcagtaagatcttcatacttcttcagacaaatttatttccataagccaatgcaatttatctttcaactgtgttaaaaagaaagcgctacaccattcaatcctaaaaaaggggggaaatttgttgacagtacgataggtgatcttgtacccgataaaagatgatttgttgatttaatattcatgaccatcttagtttatgtgcatcctagtcttcctatcagtagagtaaaaggaagatgcctaattcctattacttgtgatttcccatgtgtaaaacgctggctttcatacactcttgttattctgcgaaatggaagtataataaattgccataaaatagtttttcttgatgaacgtaaaaactaacagcatagcgtgtcctgattgtcatgtgctgtatgaacaatactttgctcctttccaacaactgcagtgggtggcaaagttctatataagtttgcagatgaaaaggagaaggagatgcatcgagccaaagaaacggatgcgatggtcaagatgttgtcacaatacaaaaacc

SEQ ID NO: 52814 - DNA, 1501 bp, Oryza sativa
gccaagatcaataggtaggcatggatcctacctattgacctgaggaactgggtcattcaacaaccatcagattttgctggtgctgacagaacgtttggaataagtgagacgtatgtccaaacgaccatctccagatatccgcgcaggaagaggcgacaccgccggaggacggggaacagtaataatgcaatagtgcctgccgttctagataactagctagactgcctaagtgaaatgtactttataattgaattcattgcactacgtacgcatgttacattaattacagcttgttaaccataacaaggacacatgcacatgacttactgaccgaccgcgtagctggagtattcagcgagcttatgtctgaatatcagtatcgataagtaaacatttgtaagtactcattccgtttcgaaatgtttgacaccgttgactttttagcacatgtttgaccgttcgtcttattcaaaacttttgtgaaatatgtaaaattatatgcctacataaaaatatatttagtaatgaatcaaatgataggaaaagaattaataattacttaaattttttaaataagacaaacggacaaacatgtgctaaaaagtcaacggcatcaaacatttcgaaacggatggagtatacaacaacagtacaacactaaagggcttgtggttttcattactggtgatacgacaggagttatttattggagatcatttaaatgatatttttattgcagattgttttgtagcgcatttgaacttattgtggatgaagggaagctattatgtagataagggaggcttttttttccgattagatgtagctaggtagagctgagtttaattagtgcgtgtatatcaaagctatggcaccattgtatacatttcataccgttctctgctttgtatttattttttaatagaaagtgtctaaaaacgagttaccaatttacactagaatatatataattcttgaactttggttgtttgcaagattattatcttggggtgattgtacataataattaattagtgtgacatgatgtgcgaacgtgcacgtttactagttataaacttaagctagagttgaaggacgtcaggtggaccttttttcaattgactggatcacggaaaaagtacaccgatggtccctcaaccagtcgttgggtataaaatcgtcctccaaccccaaaaccaaaaaccaaatatgctagtccttagctatacaaaatcggtcacccgagattctttggtggttttgacctcggttttagtctacgtggggttaagtcagcataggacccacgtggccccacaatgtcaggtgtccacgtcaccctctctcttttccctcttctctcccttcctcatctctctctctactctgcaagctggccgggacgatgcgggagggcggcgccgcgacggcggccggtggaggcggctttctccgcctcctcgtcccgctcggccgacgtgggcgcgctcgccggcgaaca

SEQ ID NO: 52815 - DNA, 1501 bp, Oryza sativa
  unsure (1)..(1501): unsure at all n locations
gcaaccctgaaaaaaaaatactgatcaaattcataatccataaaaatactgaaacatgttcaagtgttcccttcaatctttacagatgtgtaatttgaataattgaacaacaaagatcatgggagcttaaaatggaacttttgcatgattttgaggctactagtaccaagctggtgagataattgctactaaatctatgccatgattactcaacaatcaaggaagacgaacaagaataagtttattcagcatagaaaaataaatataaatatgagtcagagttcaacctgaaagcaggctatctattacagggaggcaaaaaattgccttgatcatgccactctataattgccttaagatagatattcaccatttaagcaaatgaaagcaattactgaaggttccatgtaaaaaccacatgaaatgttgaggggcaacgcccagtaagacaagcttgagaagcaatattaagcacggtttagaaactcgagctacatctttggcacatactaattaacaattaaggtcatacataaacaacacatcagtaagtagtccatatggtatgtatgcaggatcatgggcacaatgtagaagtgcatatgcgttcgtgcacacggacccaccaacacaagtgcataacatgcaccaagcctgactatgcacaagcacacccgaacacctgtcggactcagcaattcagttgaggcaaatcaatctcctaaaccgacgatctcattcgttacatagcaacacagataaccctaagatgacaaaatcacagcagagccggagaacccttcactgtctccaagtgtaggcaattgaacgagcaggtggcgcgcatggcaaccccatccccatcccatccgaactcatcgcagcatgcggcaaaggagaaagactagcaccaaagcagctgaccccgactagccaagaggagagttagggcgaaaatggtggaagcgtacttgacgaggggttggaggtgggaggggtcgcanaggtcggtccagccgcagtcgaggaggaagcggaagccatcgacggcgagcaggtagcagaggggtccctcaccgtacgcgccactcaacggagtcacctgcaccgacgtccccatccgatcgatccccttcgccgccgccggcggcggcgtcggcggcgagcaagaagtggaatgagagagaaagagtccaagtgtagtagttgggccgctcgagaggcttatgcagaaaaactgtacatgggccgggctgaggcccatatacttcctcttttgtgttggtttccttcactttcctactcgaggccgacggagcgttgcgtccgccgccgccattgtcactctcgtctccatctgcgtctccgtcttcgtctccggccagcgagccccttttcgccggcgacctagaagcgagaaatcccaacaaatacacatccagagaaccggctcggctctgtcgccttcccctttcctgggtgttggcttgtttggttggat

SEQ ID NO: 52816 - DNA, 1501 bp, Oryza sativa
atgtcaagaaaaaaaatctacatacagttaggggagtttgttgacgtgttggaccactctcaattcttttatccatttaaatcgcaaacttatcatatgtcaaaaaaaactacatacacagaagcaagcgtacccaaggccattcgtatgcttgagaggagatacgagatggtccaaactaaaacaaaacacacaagatgattaaagaatagtttaaagcgatacatcggtgataaaaaaaggtggctcaaagtaaaaataactcttaatctaattaactactcaaaataacataatgactctttgcttttaacactatttggaatattgtgggatttgggatacacccccaaacatctttatagactatactcccttcgtcctcaaataaaatttgaatgagatgttatctaatacaatgaatctagatatatctcgatctagattcgttgtactagataatatctcatataatttttggttattttattttagaacgaagggagtacgtttactactaaaatattctccaaaatgttttttttaaaagaacagtgctcatactctatcgaataatcataagttatttttaaagaataatactcatcacaatgcgcattaacattgcttctctgcaatgcgcagagagggagagacggtaaataatcatgcttttctggaaaaaaaatgtaaagaaatgttatcattataactaacacggtttcagtgtagagcatcacaaaatacttctcctacctactatcactaaaaaacccatttttgttgctggatggcaacatagcaccatctgatcttggtagacgcaatattattcttactccctacttttatttcacatgcagagatttgagcttttcttaagagtagcgtgcaaattaaacatattccttctgttttttttatgaactaaggctgcgttctttcaggggagatagaggagattgtccctcgttttccgcacgcacgcttttcaaactactaaacggtgcgttttttacaaaaaatttctatataaaagttactttaaaaagtcatattaatctatttttaaaatttaaaatagttaatactcaattaatcatgcgctaatggctcacctcgttttgcgtatcttcccaatcttctctatctcctcctcaaacacagcctaactaacgtaatacattttgggatgtaggagatattgtttcaaccagaagtttaaaccatttatctgtatttttttatgtagacaagtagtatatctcctcctcaaacacagcctaactaacgtaatacattttgggatgtaggagatattgtttcaaccagaagtttaaaccatttatctgtatttttttatgtagacaagtagtagtagctccatactgaaactgttactcaatcagctcgtcagaaaccaaccaaaaaactataattcagtagtttttgctagcaacagtaacaagaagcataggatgattcagcacaagcatagata

SEQ ID NO: 52817 - DNA, 1501 bp, Oryza sativa
tgcagatgggatgggtacagaacagtaccctagaaccaaccaaccccaaatgaaccgcaagggcttcttggtcaattctcccttctctcaattgaattgaaattataataatttctcagtaggaaccacattttcttttaaaaatattgtatatatctttgtttttttaaaaagctaggtttgtttcagtttaaaattattataatttagttttttgagctagattactataagctactcccttcgtccaaaaaaaaaaggcaaaccctagctattttttggacggagggagtagattataataagatgtgagctgtttttatttctatagattattggatgcatggaggctaatgtctataatactctcatctattttggatatcttgtgtaactgtatataacaagtatataatatgaagtagctaaaaaatatattaataaataaaacattcatgaatatttttatttgtataataggctgaacacgaaatattatctcttagcaaataaagcatcaataatactatcccgaaggagctggatttgcgcgcagctagggagggaggacacgaatgtgtgcatgatcggagaagaaagggaatgcacactcggctagggaaagagccatctccataatcgggaaaggaagggaatgcgcgctggactagggaaggaagggaatgtgcgctcggacagggaaagaggtatctcgatctgtttggttctcgcagtggtgggtaatttacgtaaagtttttaggggtaatgggtcttttgtcacccaataatctataaaaaaaacacctttagaggagattatcatattataccaatatagcttatattttataataatctatctggtttgttttagattactccaaataatttaaatcattataatcctaagctaaatcaaacatggcctaaatttaaactttcaagtttcggtcaaagctaattagttgtacgagtgcgttaaaattatattgacatttttaaatgttttcacttagggcctcatcttttcgtttatgcttatgtttatcagttaaaatttgaatttttaaccttaaatttggagctgattttgaggttttttcatcaaatattatttttcagcctttacttttagatcgctaagaacacatatataaaagttttattcacaaattacttttcatttgcaaatatgtcgttcctcttattctgtgaataagcgaaacgatggctccgtcaatgttactactagctattaaaaaaatatttattaaaagagtaatatgtaatagttttaaatcaaaatatgtgttctaaaaccttataaatatttaagttatgatattttgttgcatgctaagtatggtagtacaatttccatccttcaaagcataatgatcttttttttaaataaaataaatcaaagttggaaaataaaagcactggtcaacagtgacaggtaaataggagcatattgatgcatacattgatacatatgg

SEQ ID NO: 52818 - DNA, 1501 bp, Oryza sativa
ggcccttgggaaccttgcagcagcccataagatgttagccttctcctttctgaagttcttcccaaccgcaatatgaatctcttcctcatccatcttttcttgccctcttctacatcaggaactaaaatcaaattgtggttctgatcttgtcaatatatctggttcagcagcagaagcaagcaaggcttgaaaggaagaaggtaagagtatatctgaacttgatccagaagaaagggaagctaaagtaccttattgtggtgcaccacttttcatcaacttcacttcatggtggtatctgtatcaataccatcaacttcatggtattcttaaaactagaaagtatcagttgaaagaagggccaaaggtggggagagacagccgggggttttaaagcttgtttaccatggtctgaggtttcaacagcttgatggtatccagcagcagtatcaggctgtgggtcccaaaatgcaatccaatcaggaaattataccacttccaacttggcagtattgttttgccctctcagtattcagtagccactaactcctgctgcatacttggtttgcgaaacggcaggttcatttagatcatcaactgcaaatgattttacaagttgcataggagagactgtaatctcatcaatgtttctattcaatttgaatttttaagctaaaatcatcatttttacaaatcttttgtaattaatggcttgtctgtttgttcatcagatagaaacaagaacgaatggtattgttccagctgagggttccgagttttccaagaaatttctgtccaagacgctgtcgtacatgtttgtccttgatcgacgactgactttggaagattagcagtgaagtcttgtatatatctccccggccggtcggcaatataatgcagctaaacacgttattttcaagttgcagaagaattgattagtcgtcattggattggatgcaagctttgaattctggtgtgcatttgctgaatacctgaatggttattcgacatttggccctcatccttctctttccctggacgttgctttcacagaattcttgctccccaggctgtcaatatagtaatgcaaatgaagacatgtcattaaagcgatatgaacagcatataccagaatcattctttctttctaccactgaacaaatcaagtgcatgcgttaagattgaggtttgcattgtaatctccacatcaaggaggcgcagtttcttccagatttctgacttcagaagatcccagttgattcatcacacattattcttactgtaactctttaagcagcaatttggtccgacattgcacctttttataatttttcggcgaattgcatatgcaaggaactttgacaaatttaagcactggacgcatatttcaaaaagaaggttttgtcctactcgatgactttgtgtcatcagcatacctaaccagctagcttttgcacaattcaaactttcaggttagacatcgtggcacaggaaacagtatata

SEQ ID NO: 52819 - DNA, 1501 bp, Oryza sativa
tgattctttgcaggttcatcttcttgtgtgcaatcagctcctgctctcgcagctggccggcgggaatcttggctccgactgcacacgacaatggatggaggttgcataagcatttgcagccatacacatacatggactgaaaactctaagaggaagccagagatgtaaacaaaatggaagccaaactcaatctgaatgaattgagttggcctcgattgtaaaaacgtagggggtaaaatggtgcattaaaaaaagagagagaaatgatttagtgtgtggggaaaaaggttgtaaatttggagtcattgagggaactggacaaagaaactagacgatctgtgccaatacaatcgtggtagatcggatcatcaatctagactctagtactagtgtaggtaggaggaagagggatgcgtacggatggggaggaagttgggaggggagtagacatggagcagcacgaaggcggtgccttgggggaacttgtgcagcgcccacagcagcgtgcccctgctggactcctcccccaccgccacgtacaccttctcgccggagaaggacggctccggcgaatcaccggggtacggagagggggagcccgccgtggccatggctttgttggcctcgcctcgccggcgccgctttggaatccttctttgtgttggactctcttcttgttgcctccctccctgcctgctctcactttaatactccactgctaatctcaaaatatataagcatttagatattgtcataagtcaaattatgaggacaataaacatcattagatgcattgtgaaatatatattttagtaattttatcttttttttatgtgatagtagatgctaatgttcttatttataaacttgataaacttagcatagtttaaccaagaacagactcgtaaatacttatattctactagaacggagagagtagcattctacaaatgttttggttatgttctggtgatttgaatagtaaatatcaagattcttatttcaaaccaaactatggacactaccaacatctaattctttttgccgggtgggccaaaggctggccgacaaattttcattaataatgaaagaaaatgacagtttagacatataaagtgtcatttccaatggagttcaagagtatttttaaatggtagtttctgcaaggtcccttttttcgctatattttgaatgacttcaatgcttgtgaaaatacaatatacatataagagagttgaattgaggttgaaaacagaaggcataggatttgtattgcagttgcggcagacttataggttgcaaatgcatttaccttctgaaattgaattagttatgacgatgtcatttctgcatttactaatttgtcaacaggacctatgttagcacaattgactacaggcacacgtctgctcggtgcattgccgttgacgcttaactgttaattggtgattggctcaattaagagtgcattgtctgagtatgttccataaaaatcaatttc

SEQ ID NO: 52820 - DNA, 1501 bp, Oryza sativa
aataagtgtttattgcaggcttcaaggaaaggctgttatttttgcaatttattttatttgaactcttttctaaaacgactaggtgagtgcttctcaaacgactcggatgagacagtgcgtctcgtccggtcggagtatgtgcaatgcatcaatctttagaattgaaacaggattggcacccggccaacagcttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaaacacctcacatccgcccatgaccatgggcatggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccaacgagaggggtcccagaccaacaacaggttagttcccagaccatactgtgccaggaagcccaggggtcctccccgacaccaccccggcgaatccacatgtctctcggcatcaaggctcccctgataagctagttacttagccaggggtgtcccattccacccatgtggtcgtacttgtcttatgttcggatgaaattccaaggaaacggtccttaagtgcaagagcgggaaaccgtacacccggtacgttcccggtccgcggttttggaaattcatttaattcacaagcaccgacccaggtgtcgggttttccaagtcttttgtaaaactccagttttacccaagttgttactcagattttaagtttgaaggcgaccgtcgatactcgcacagagtgcacgaatatcgaggcgtaactgggtggttacaagggacatggtacagcaattaacaatggaaggatcaaatgcaacaagttaggtaggtccgccaatctgccttgcagacggaacaatagattaagtgcgatcctatcaatgcataatattttgcaagcaatctaattagatttcaaatataggctcaagatgttcaaaggtggcttgccttgctcgagatctggagcttgatcctcgaaatcctcgcactgcgggtcttcgggctccgaaactacacgcaaaacgggacaactcaacaaacggcagaaataaagccctattaatgacctctaagcgtgccattagatagatctcgagatttgagaaattttggaagttgaacggagtcaaacggatttacggttgggaagatattgaatttctaagattatcggatttttggtctaacggaaaaaggatttaattaaatcctttttggaaaagaaaaagaaaagaaaggagggagggaatatagacttttctcaggcggctagggtgcggcccaagagatttggggcggctcggccgagcttaa

SEQ ID NO: 52821 - DNA, 1501 bp, Oryza sativa
tttacccaacaaaatgcctgttattgtttcagatgcctgcttgcaatgctgaatttgtcatatttgtcttctaatcctgaattgtaattaggatcatttttcaagtaaaaggcaaactactattcatatttgttctgaaatacaggtattgtgacaattctctttctcttttgtcatcatcttgtattccacttctgtaagtatacttccacatctattctctctatcaatacttatgccgatatatattgtttctgaaagccaacttccgtatatattgtttctgaatatatacgtatgttctggaacaccaacatgatatatacgtatgtcgatacggagagatcaacggtcgggcaggagcaacaccatgcaaaatgggctgccgaacgggctgccgatcagcagaagagctcaatgtagactgttctggttggtgatgaagaggagatgctcctgcccgtaggacaagagtcgtcaccagagggcgcactaggcgacgaggcaacctggtccggagtatgcgatgatggcatctgtctgctgtgttggacaagctgatttatatcagggccggccaagtcatcggagatcggcgacttgacctcgggggagggaccggccggcagagggcgcaaacgctcaacgtccaaggaggacggagctaccgctgtagaagcacccggtagaagaaaatcgacagaagagcggccaggggaatagctgcaaatgggaacgtttgttcatcgaaaaccacatgacgagatatgaagactcatagcctttgtgagaggccggttagagaaggaaaacataggcagctgaccgaggagagtgtttatgatgagtcgtggcactaagattaggatagcaaaggcaaccaaaaaccctaaggttagaatagtcaagaactttgcggtgcaagatttggaacaggatggagttgtagactacagtagggggtcgtcgattgagtaactatgtggcagtggctagagcttcagcctggtaggatgtaggcatgatgcttggataaggagggtgcaaatagagttgttgatagtgcgaagcatgcattcggcttttccgttttgtcgggaggtgtaagggcatgataggcgaagcatggtgatgtggctagcgaagaacgagttggtggcttggttagcaaactcggtaccattatccgcctgaaagcacttaatgggaaggccgaacagggtcttatcataggcaacagactcaacaagacgctggtgtacatcagacatatggcaaagtggaaaagtccaacataagtgactaaaatcatcaagcaccactaaataatacctaaagccagaagtactcaagacagaagagagatccacacatcacaatgaacaagtttaaaaggagaagaggtactagaatgagaccgagaaaaaatagatgcgtgtatttccctaactgacaagcatgacacaatttatgatctgtcttagtacaaggaagaatagtt

SEQ ID NO: 52822 - DNA, 839 bp, Oryza sativa
gagaggggaagatgggccgagggaaaatcggcccatcgaccctgggggaggcagaatggacttttgcggaggaatttgatttggagggattggattcggaattgaactcgacgatagatcggggattgagatcttgagatggcatggacactagacaacaagcaaagaaacaaatttcgcaattagggtttttaagagataattttcccgctaggcgccacgacggaacgggcgctacaccctttaaggagataccacataaaaatcttaatcttaagaggcattttatgtttccaaataattttatttctctcaatgtaaccattattaattaaagctaagtacatagatcgtacaaaaaattggccattttgatgaaaattccatctgaaaatgtcatcctcgtctatgcacattgaaagcacacaaattatgccatattattagatcctgaccaactaatgctcttctaaaagaaacattaatactacagcaaaacaaccagctagagacgatctgcttactacgatttatcaaaccgtctgtaatgaactcaactaccgtataccacgagcacaccccgcaaatgtagctacgaaatgaagagacggggattaaaaccgtggctactcccccaccccacgtccccactaccatcacatcttttagaaaaaaaatgtttatatcctatttaattttggaacggagtacgtacgcggtcaaatccaaaaccctcgaggtggttccgcccaccgccgccgcttgctgccgccaccgtcgtccaccactgccgtttccccctgtcaccagccactagcgacagtccgttccagccgtca

SEQ ID NO: 52823 - DNA, 1501 bp, Oryza sativa
gggcgtgggggatttttgggagcaagtttgggcagctgttggagctttcctttgaactaaaatcctaaaatttaatttttggggacctgtttaggcatctgttggagcaagtctgtctaatattttgatatgttgtcagtagtgttctcatatttgcttctgagtcagctagataggcgtatgccacttatttggacatgactagatagagaccgcactctatattgtcttaaccagagacttatcttagacctggttgcatactagtacaccaaatgatacatgtttttttttcttatagatttttcttttaaattatttatccgatttataatccgattacaccattgtgttcgtttaaattaaatctttacaacaagatcttacatgactatattttgataaaagaaatatctatgttgtaaattaattttattatatatgtaagttacttttatcatatatataaattacttttcgatttgattaaattacttattatacaatcataatgttgtgagttgtttattttattatcctttttagtcaattctacaatttgtgttgattaaatttagtttttagatagactcacgattttacctccataacggatctatttttaatgtcatgacaaagttacttcctttttgtcttaagttacttctataatatatgtaaattacttttatatgtgtaagaagtaatttagtgaaatctaaaagtaatttagatatactgtaaaagtaatttgtaatttttcatcaaaatataatgatgtgagatcttgttgtaaagatttaattcttacgaacacaaccgtacaatcggatcgtaaatcgaatgagtagtttaagagaaaattttatttgaaacataggtaataggattatattttctacttacttgatggggactagtactatttaaggcagatagggtctctcgttagcactaaaacgagaggcctcttgatttagattttgcccacttattagttattacgatgttgtccagcttctcatcttaagcaaaacaattaatggaacttttttgcttccttcttatctatttaagtggtcgaacaaaatactggaagtggccacatatagtagcctcctcaccgcttgcaaccttgtcgtgtacgatgctaatcgataagccatgcgctgacagaggcatagagcaggtgtacatgaatagctactacgaaaaattatcgcaaaacagagtaaaagcagagtgctatcaggattcagaaatactctctgataaggttgacattactgatcttgtggctcaatcaagaaacacagacccacacgttcaactgagcgagcagttctcagaaggctgcaacagtaatggcttccttcagatgtaggaatacccattcctgtatgtatagtttcctgatgcctctggttccaattgatggttagtgtatatatacgctgctgctgtattttctaagaggggttttacagtgcttgggaggtac

SEQ ID NO: 52824 - DNA, 1501 bp, Oryza sativa
cctgcgcttggaagacttcactgtcaacgtccttggcgcttcatcagacatcttaaattcaacatactgctcctgcacaaccgaccaaggaagagcaggattcgtgttacatatgttccgtttgaaaataatgcgaggaatgtaaatcacgggattatctgccattttggagaaggacagatacagacctcctcccactttttctggagctgcaaaagctctttacagcatgccacacactcagcatggtaagcagcagccagttctttaatcaaggccttccttttgattattcctatcacttcaaaacaccatggcattatatacaagcacaagaatgctggcaactattttacaaatgaaaaatgttttttagattttgcaagcaatgcatcaacagaactcaatatatctctaatactataatgaggccagtgtaccatgtgaaaatcatggagagataaagctttgacatttcataactcactcatgacaatatactagcaaggtagctagtacatgcataacaattgtacttctattcagtatctggtaggataggatacctgctccaatcatttatatagagtcaaattttttgcaacatactagacttactccatcccgaataaactgagatgttggttcaagaattaccatcctatgcacatctctcagaaagctttataagtgaactgaattatggaccaagggctacgaaaattgaggccatggccatggcatttgataggatctttgtgcattcctagttgtgcagcagatgtttatttcgtgtgactgtgagatttccaatttgattcgtggcgaattgttagttagcaatactagtttacaaaacctgaaccctctaaagcaaatcagtatgagtcgtgatttgttatactctagtaccgaataggagtaaccaaatctagagcacgaacacaaaaggtaacaaaaattaaaggtgcgtgagaaagagagagacccttacttcggctgggatcgaagtgttgctcgtcgggcttcttctccccgttggccgtcggctccccgctgccgctcgcgccgtccatgggatgggaggcggaagatcgccgcggttaggcctttgcttagatccaaccaaacaagccaacacccaggaaaggggaaggcgacagagccgagccggttctctggatgtgtatttgttgggatttctcgcttctaggtcgccggcgaaaaggggctcgctggccggagacgaagacggagacgcagatggagacgagagtgacaatggcggcggcggacgcaacgctccgtcggcctcgagtaggaaagtgaaggaaaccaacacaaaagaggaagtatatgggcctcagcccggcccatgtacagtttttctgcataagcctctcgagcggcccaactactacacttggactctttctctctcattccacttcttgctcgccgccgacgccgccgccggcggcggcgaaggggatcgatcgga

SEQ ID NO: 52825 - DNA, 1501 bp, Oryza sativa
caatggtggattcgtcctctttttcttcttcttcaggttagctgtcctggaacagttgttcgtatttgtactttgatctgaaccctctttcttgggatttgctttttgtaatctaaagcttgctgattcatcataaagaatgcagcaccattttcacatgtatccctaaacaattgtagaagtataaagtaatagcatgcaaactgctgacgaagttcacaaactgcgtagtgtggacttacgtccaacaaaaaatgtacacatccgtccaaaaacatcaccatccagctacctactgtaccatccgatttggttcgatgcagccagtacatatccatgtacgaattgcacaactcagctgcaaggatcgaatttttgagtgctttcgtttcgtcgtcagatgagcacactatctaacaaagtgtcactgtcgtcgaacctactgaatcttcagacaggtcttgctgaggtctgctcgaagagttgtttgaactattcttttataagatcgcatatttctgggagaaagagttgtttgaactcttcttcagatcgcatatttctggtcgagagagaaaaaaaagataccagaagataacaacagatctcccgagatcaatgccgtgatgtcaacatggaaccagactacacctgaaaaggcactgaaaaagaaattgaaacgcgtgtgcagagccaaacgtgcaaatatttgctgggtgctcagtactcgcctcaactacaccttatctcccgaatgcaacaaggagcacgtggacgccttattcggaacagcaatgcccataggttcagacttcagactgtttcagtagttcacacggccggttggcctgtatataaatcacgagaggatcgatcggaagtcaagaggagataggagacagcgaaagcaaattcaacgggcaagaagtacgtgtatttgccttcgagttcttcaggattcagagtttcagacgacaccaaggcccaagctaacattaggcgatggacgagcaaaaccagtggctcacggagccggcaagtacatccagtccttccatgtaagctctgaaatcttcgagcaaagcgtatgacgaaatgattattgcattgttaatgtcaggagcctgaagagttaacctacatgtatcatcaagaagagcacgccaggatgcaagagcaattcgctgggacgccgctcgtcgagcaaccagttcgatttgatcagttctacccagcatccatggcgccaaaccagttccatccgtctcactgctccagcttcccggccttcggtggctcgtcggcattgccaagcttggcgttcggagcggtggcgacgaccaagaaggagcaggtgcagcagccgtcgccttcgtcctcgaacgtcctctccttcgccggtcaggttcagggtagtaccaccacgctcgacttctccggaaggggatggcagcaagacgacggcgtcggcgtgttccagcagccgccggagaggaggagc

SEQ ID NO: 52826 - DNA, 366 bp, Oryza sativa
gaagatcacacacttcttcagagtcagagattcagaaacgctgaaaagggtcctagcgtccaatgacccatcgccatgcatgcagcatatggaaaactgattaccagttatggaagctgacgacgacacatcgatctctcactagccgcccatttactctgccattcatgcacgaggtctaacctttgtccaaaaagaattgatatccataattccatatgatatgagctgacacagtgacaacactgaatcactggccactttgaacagcctatataaagcactgcaagaagcaatgcgagtagacatcgagtccaatcacaagtgcataagtaaaagatcaattacaattcgatcgattggcca

SEQ ID NO: 52827 - DNA, 598 bp, Oryza sativa
agctcaattgtccgtgtttgccgtctggctaggtcacccttcaaatttgggcttcagcgtactagcattgcttgggccaatatatggaaaatctgttcattataatgagccacatcatgttgggccgacacagtgaatgagaaaatcccaaacatgaattctaacacattgagggtgtcccctcatatacttttttctctttaaaatttaatgcagatggttatgaaaaaaaaatcaatatagagcatagtagcatctatcccttgattgttatcattatgtcaaaatggagttgctagaaatatgacgccatatgctatttcagccactttgcacagtagtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaaacggaagccaggacttggaccattcatcacaggcgcgacttgggaactagg

SEQ ID NO: 52828 - DNA, 1501 bp, Oryza sativa
gccacttcgccacgtctggcggttatgaggtaggggccgatgtagcggggtgctaacttgccggacatcccaaacctcctcataccacggaggggtgatactcgcatgtatacatgatctcctttttcgaactcaaggtcacgcctccgattgtcagcgtaattcttctgacggctctgtgctgtcttcaaacgttctcggatcagcttaacttgttcttctgctgacttgagtatgtcaggaccgaataccagtgcttcgcccacctcattccagcacaagggagtgcggcactttcttccgaacattgcctcattcggcgacatcttaatgctggcctgataactgttgttgtatgagaactccgcatacggcaaacaacgatcccaagtgccttcgaaatctaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagctaaatctacatacgacatgggtcatgtagagttctgctagtctctttccatcataggtggttttcactggcacgaaatgagctgatttcgtgagtcggtccacgattacccaaacggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaaatatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaattggtgtctttcttctcctgtattctttttattaattcttttatcccttcgtcgtctttctgagcctcccgatttgcgactctagggtaggctgtactgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagggtgtaacatcccggcctagggcttaataggattaatagaatactcatatcaacaagttgcaacttcttttccggaagccaatctccaaagaactccagggttaagcgtgcttggcctggagcaatttgg

SEQ ID NO: 52829 - DNA, 364 bp, Oryza sativa
ggctacaacggctagttttctagtcgttgcagagtagcacggtctgaccggccacatacctcaggtcagaccggcagagcacagagttgggggatttcgcccccaacggctagttttggtgggtgggagtataaatactcccccaccagtagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccatgccgggtcattgcttgttactcttggaggttgccgcctcctaga

SEQ ID NO: 52830 - DNA, 1501 bp, Oryza sativa
actgctgactgggtccggaaatcaggacagcaatttgttttccttaatctgggatttgcagaggcataatcggaattttcgcccaacatgaaagttgtagacaattttgtacagatatccgaagttatattatttcttagatttcattagacggtttgtgagttacgcataaaacagtaagggaacagctataggttatttaatataaatcggtaaaaaattatatattctaggtttcgattttactaaatgtcccttgtaacaatcattagttggatatagtggtttatgcgtagtttttctccacaggtgtggagggttccaacttggaggagttgagttggattatcgaagaagttaaggcaagtacaagatgggcttgagtgatggataaactgtgttgctttgttggtttcatttacccaattattattcgaagcttcctattattaattgtgtggttttggtattatgctacatattcatatttcacttcatgttcaagttaacgacgttattcatgtttcattcttccggaagttttttgtttacattatacaagtaccatgcgtagtcatgggagtgcaatttggatttttattcatgatccttgagaagcgctgatcacgcttgctcggcttaccggtaatgctaagaggatattcacacctgcccgggagggaactacaactctttgcctccttcgttttaaaataaaggaaatcaaatgtttcatattggtttcttcttgcattaaacctgtgtatgttttactagttaaatattgtacttgctgagtattctttactcactcttgtgtttaatttggtttttaggtacctaataatattgatcggcatgggacgggagtagcacccttggactacacattattactgcacactattgaaatttaattttagactatgtttctgcttagcataagttttgcgtagaacttgtaaatgtcatttaaagtttcggtccttattttcacggggaattcatggagctaggatggtttggattatgtggattatatcgttattgagttatcttataactgcttgtcgtggatgtccgtatttttaggggaggctttgctgaaatttctaataattttgggagttagtggttttgaatgtattttggtgtggcactttaggtacgtggttacttggggtgttacagttggtatcagagcaggcggtaggtccatgtgaagtgactgggttacatcaaatataaatcgacataaaattttgaactagatttcctatccaattaaaaatttctcttaggatagaaaataataaaaagtaaaacttggattagatgtaatcatctaaaacttgacacactggtgcacaataggatgggggtgcatgggtcattcctagcatttatgtttctgctgcatatatgtgtgtatgattgtgtttctttgcatgctattgtttgatatagctatgccgcctagtgagtgctcggttagccaact

SEQ ID NO: 52831 - DNA, 1501 bp, Oryza sativa
gtacaaatattgtctctaaaatttatctaagataggtcatacataaagcatatacaaacttataaaatgcatagaaaattcaatttaacttattttgatacaaactcaaattctacagattcatcatcatgcactctctctctgattaagtgaaataaaagtaattacttactttgcatcaaatgcctcaaactattatctttaaaatgactagttataaatgagttaaagtttagaaattcatataaaattcaacttagcttcaatttgagtaaacttaagttctgtagaatcaccaaaatgtgtattcccaggttatgaaataaaattttatatttactgtgtagtaaaagcctctaaataaatgtaaggatttactaacttatagcagactttaaattgtaaaatttgtagaaaattcatttttagcctaaatgaaatgaaccaagtttctatagaaccagaaaatagtgagcttcaacatagtaaaataagatatgacaccttttatacaaattatagctttaatctttaaatagatgacctaggagttaattacctagtgatggttaagcaaaatataggtgtagaactatttataatgcactctagctatgaataaacctaaataaaacttatagaccagtagaaccataattccatccctatccaccaaaacatagaagaacttggctcatattgtaatttctaagttaatataaggtattgctagtcttagactagagcatccctagtttataaagtatgaaccatggtagtaaaaactataaacatgtgaactaaaaatattttagttaaccaaattacttattttttcaacttaaacatgatgtagcatgttctgaacctacgacttaagagtcatgcacatatagaacactatatgcctagaataagttgtaacttgtaaaatctataagaaaatcattacaactccaaaaattgtgaaaccaaatgcgatagtcttacaaaacacatctctatgcccctgtatagtcaaatctaataaaaaccactttgcaataatattttgtagcactacctaagactatactactataaaccgataaaacttctaaaattcataactcccaaatggaataagataaaatagaaattctttcacctaaattcattttagaccagtacctaatcactgtgtataaatcatgcattttagagcattttggattttcagctctttcggtgtttaattgcataacgtgtcctttatttagataattgcatattcggtgaaggagtggattaggtgctaacatttctctgatcaaggcaagtttttctcctcccatcctttgaacacatcgaatcccatgatttgaggaatgaaaaatgtttgtttgcaaacttgcatgtgaacttagactatatcggtatttgaaactgggttaaggtagttatgacctatttgctgcattccctaccttgcataattgtgatccttgatgtttgacacaga

SEQ ID NO: 52832 - DNA, 1501 bp, Oryza sativa
gtacagggcgaattatctgagactctgcaagacgtgaagctgaataaaactgagaaacccactgcctaggtttggatgatgattgagtggcctgattttatttgtacttcttgaatggtggtcgttacgggttctcgtccccttcctgatgggctctctctgttcgttgctagtgacattgccaggacgattcttctatgcagtagtaatttggggctcaacctccatcccccgagcctcctcaactgtattgaggtatacagtaggcgggtttcttcccatcacttttgtatatcgggcattgagccctcgaaagaacttcctagccttctcatgctcatcactagccacgctaggcacaaagcataaaatattgctgaactcccgctcatactcatccacagtcttgcttccatgttggatattgtttagctcatcactcatcatgtccccaaatgattctggataatacttagctctgaactgctgaagaaaaacttccagagtaatagcaccacggtcagggttccacgcttcaacaacttcgtcccatcaaatgttcgcctgactagtcaactgaaaaggcgtgaaagcaaccttctcaggggtcattctagatccactcatgtacttctccatcttgcgcaaccagtctgcagcatcaatgggagtactagacccatcaaatgtgtctaagcgcacggatgtccatctagtgagtgtcattccccgagtagctcgagcagcatcattagatacaaacagccggtccatgtcctcatcttccatctggttcgatgatgccgcctcattatggcaacctctaccacggcctctagcatggcccctaccacgacctccacgattaggaataggggattctgcaaccgagttgttccctacctcttcatcctgattattttcaacttcttcattatggtggcccctaccgcgacctctacctccgcctctcctgcggcctcagttggctaaccgagcactcactaggcggcatagctatatcaaacaatagcatgcaaagaaacacaatcatacacacatatatgcagcagaaacataaatgctaggaatgacccatgcacccccatcctattgtgcaccagtgtgtcaagttttagatgattacatctaatccaagttttactttttattattttctatcctaagagaaatttttaattggataggaaatctagttcaaaattttatgtcgatttatatttgatgtaacccagtcacttcacatggacctaccgcctgctctgataccaactgtaacaccccaagtaaccacgtacctaaagtgccacaccaaaatacattcaaaaccactaactcccaaaattattagaaatttcagcaaagcctcccctaaaaatacggacatccacgacaagcagttataagataactcaataacgatataatccacataatccaaaccatcctagctccatgaattccccgtgaaaataaggac

SEQ ID NO: 52833 - DNA, 1501 bp, Oryza sativa
atttaagtggaaaccaatggatggattaataagatgtttataagatgtttaatggactttaagaatgtcatacaatgatttagaaatatttataagatgtttaatggactttaacacctatttttgagattattttctataaagataattttaatttaattgtgatagggagcctacaaattgatcactctatgcgtggtgcactgtacggggatgtgggatgttttggttttctagtatagatctaacgatctagaataatagtccaccaatttaaatgaaaattgacggttagatttctcaattttattagggtgctacatgatgacttgagagtatttatatggtgccatgtgatggtttgggagtgtttgtagatgtttaatggacttttagtatataatagatagatagtactacgtacatatggtttttctctttatcttatatggtagaaaattatagtttatatttttctcccaattatactatgtactttttttttgactttatcacacaggcattctttttcttccgacgaacggaacctaagcttccaaatcatatgtactgtagttacaatttttcgtttatgccgacgatacatattttcccttttataaggggaggtattaatatatacacctaatgattctaaagtaactggtccaccaatttaaataaaaattaactatagatatagatctaatctaatggtctaaaataacatatccactaattaaataaaaattgacggtgagatcgtttatagaaagtttaatgaatgatatttacgtaaatttatagaatagtatgttttatctttaaataatagaattaaagatcatcaatttttttcaatgtgtaggtttagtttttctgtacgtctgtacttgattgtttttttcagttgtacgcacgtttggagtacttgcaatcatagttctcccgcatatacatatagagattaatgaattagtttcttaaaataaaatatatctaatctaatgatttaaaatattgggtccaccgatttaagtgaaaatcgacggtcggattcgacagtgctacgtggcggcttagaagcgtttgtagaagcgtttataggaagtttaatggacttttagtatataatacatagataagtcaaagccaagtgaaaaaaaccctagctttttatataaccattttgaattaatttatttgcataatattgattggttggattttggatggaggtatgttttactccatgattttatacaattttcttcacatattgctaatttaattacattttcccaaaatagaatttattttacaatctttttgttcttataaatttggccttttggctcttaagattttagaacttaattaggtgaattattttcgtcttgtaaatgaattaaacttgtagtagaacttaattaaaatgaactattttgaatgtatgaaaacaataaccttgaatcatgtaaatttaaatgtctttgagaaa

SEQ ID NO: 52834 - DNA, 198 bp, Oryza sativa
ggaactcagccagacgcctcgtcccggagctcgggctgcagcgttccccgccgggagcggcacaggctcctccaaccccaagactggcgcccctacctctgcacacacctccggtttcggcgccgggaaccaaggcggtggtggcggcggcggcaacggtggcgggaactcccacaatcgctgtcgtcgcggcggaaa

SEQ ID NO: 52835 - DNA, 454 bp, Oryza sativa
caggctacaatacgtgctcgcgtgaatatgtaggctaccttcatagtttatcaaatagcttggaaaaaatatccaagcaatgttgatgggcataatttaagagaaatcgtacttttgaatcaagatataaataatccggttaattctccacccatataaacgagatacatgcatgcacatttgtacgagctaccatcctagtttatataaaaatatatacgatgcccgcgcatcgcaccttgacctttgatatttgcacatcttctctgctggaattaaataacaagctcgccctccctgatccaacctcgttcttggcataaattaacatatcgtttacttcgcttccatgttattcaactacacccatggactgtccgatcaaatggctggctgatttctcggagtggggtgccccctgcgatcatcttgattctcttggtcttgacaagaa

SEQ ID NO: 52836 - DNA, 1501 bp, Oryza sativa
  unsure (1)..(1501): unsure at all n locations
ctagcaatactttgaaggtttatttgtctctagcatagcttgtatgtattctagtcttttcatgagatttagattttgcttttaagggagatgatgtatgacacttaaattctatacttgaattaagcaaatatgcaatgttgatgctagcatatggtttgatttataaatgctctatatatatgctttattgacttgttattcctcaaatagctttaattgttcattgtaaaaaagagaataaaaatatgaaaaaatgaataccgaatccttggaaacagtcttgacgacaaggacgtattcgatgtgagcaaaataatgggtgccgaatccctggaaacagtcttgacgatagggacatacccggaataaaaaagaaaaaatatgagcaaaatggctcaagaaaagaaaaagttaaaaaattctcttggttattttgtgctagaggttatttgagaaagagtgataaatgcaataggtatatgtgtttcgtgtttattcttcaacgtatgtgcttgttaagatgttgcattataaatcgtatgaaatcacgaattttgattgttgattcaagcttaattgtaaaatctttggttcatggttatactttaattcatgcttgttttgttatagatgggtctatcttctttttattacaacacatgacttgatatgctatatgtatgctaagctcttgaacattaatgaacataattcctatgcttgatgaaatcattgtccaaagggggagaagtaatttgaaaatttttttggattttttgaagcaaagtgaatttttgaagagttgttgagaagagcatgttgttggttcaattgggaatttctttcttttaaaaaagagggagaagttttcttttggatttttgagcacgatgtgtacatttgtacgaagtgtgctttttaccaccaaatatcaaaacatttttatgagtttgccaatgtgttcatcaagggggagattgtaaaatcaaaggtgttttttattattattctgtgatgaataattgggcattggagattattggttttgttatttggaatttattctcgaagtggttttggagattattggatttcacnnnnnnnnnnnnnnnnnnnnnnnnnttatgtggaccggtcagaccgggctctggtagccggtcagaccggcgtgtaattcgcggtcagaccggcgcagcccgcggtctgaccggccgatactgtgtcggtttcggtttcgggctgtttatttggatatccgagtttattccatgattatgacttctatatggatactatacgtatgtaatactattgtttgctgctaatgagtcaagttggagatagcttggtctcggaatatagtttctttgtttgttctatgtgtaggtgactcgatgtctcgggagagtatttgcggtgatggaccgggagtcggcttggggataagacgacgtccgtggtggtcagagatcatgcgggatacttaggctagagttga

SEQ ID NO: 52837 - DNA, 1501 bp, Oryza sativa
cacgtcagttaaaactctaatcggattgagatccggtgcagttataaactctaaccagcatcataggactgttatgtattttcagccgtttattttaatgatcaacagttcagattcactgctatagtactcgaacaacagtaaaataagcaatgttttatattacaacacttttgccacagtatcaaattaatctgtaccgtttaagtttgatccaacttagcagctacaactgctaaagttgcagtcaataatataattgcagctgattcggatcaaactccaatcagtcagtgtgtgcttcacattctgtaccaacaagtaacattaactatgatctgacgggacgctttggaagacgattaaaaagattaggcagaatactgtcaattacctgggtaacatcagatgcgtgtttactctttaccttcatacgcaaaagctgtggtactccctgccgaagtcttcatcaagtcataatgccacggctgatcttgattgtacgatttagaaagagtcgtgatgctagccaaccaaaactgcagcaacagacttgtatttttcagttgttcacgtcagagagtacacatgaaaaaaatcgtatcccagtcgaactaagcaagccagtcattacgagtatgagcttccaggtcaaagatgtacgaacaaggcttcttttttccatcaaacacgaaaataaaactcgaaaagtttcactaagtttccataaaataaattctagagtgaaaatcagagaaagaaaggaatgacggtcgaatagcattgcttctagtaagtagtcaccgacccagtttcttgttgaaatatacaagtacaaaatgtaagatttgcaaacaccagcatcgagattatcaaatatgtcaacgggaagaacgaccgtgcgtgcaaaattcatcaggttgctgatgtcggtgaagaagttgaacctgcacggttgcatgagtgcgctgcatgactacaattggctgctaataactagtgctctacatgactaccttccaacaatttgtttaagtctatactaacaaaccaaaggcccactgattcctgacccagtttgtgcagtaagtagtcagctgatcaaacggcaccttggtttgcagaaattacctgggttaatacactcctatcattttagcaaaaggaggcatgagaagctatatgattgactgcttcatgtagcacagaactacattgaaaggtggcagtggatatcaagtatcaacagccgtcagcagattgtttctcctgtgcaaattatattagcataatgggacttgagcaccactaactctccactcatccaattgtccaattgtttaacctgatacacgagcacctgccattgtacgatgttgcctcccaaaacaagctccatactcctagcctctcatctgaggctctgaaacctttcgtctcaaacaaaagatcacataatctgtccccatctcccatccaagaagaactcacataccaacca

SEQ ID NO: 52838 - DNA, 1501 bp, Oryza sativa
aatcactcgacgccgcagcccatcctcatccggcgcggcgcggcgggcgacgccggcgaggctggcatgactcacgagcgccagcgcgcggcgacgagggaagcgggagagagggaaagaattataaaataataaaataaaaatctaagcgcgactcgagcactgcacgaatctcgaggcgcacgtggcccgtgctgcggcggccacgtgggcgcccgaggactcggaagagttttgtgtggccgtggtatcctcttccctccactccactctccaacttctcccgcagcatcgccgccgtcgtcgtcgccgccgccgccgcgaggtgagggctcgtagcaccgtccgggagggcggaggaggaggagagatgagctgctgcgccgcctcgtcttcctctccggttctcgccaacccccgggtgagtacgcacgccctaccccgtcttcgccttgccggcccgccgccgccgtcctctccatcgacggcggcgtgaaattcctgcaggaatccgatgcgttccccttccgctagttcatttcagccgccatcattggtcttagcggacttagggcaagatcaatcccgccgcgaacaaacccgcgcgcttccgatttttctcacaaattcttcggttcgatgtgctcgtggaatcgaatcgtcggcgcgaattcgctagttcgttgggattccgaaagggagggaatgttccgaagagaatcgattttataatatgtctggatttatctttcaccaaggtcccatggtctagcggttaggacattggactctgaatccagtaacccgagttcaaatctcggtgggacctattttttctccattttttttctgactcgctgatccttgctaggatgtggctacatccaaaacaccatttgctgagtcgaggcgtcgagctgaatccatttgctgagtcgagctgaatttatatatgctccatgaaatctttgctacgaatttatgctttgttttcatttcaaggatgttgctgcatcaaaacaccatttgcttagttgagctaaatttataaatccccatgaaatctttgcaacgaatttatgctttgttttcattttttattttaaactttcaggggggattcgctgctagctgctcaacaagaaggaaccacagggtgatcttcctcggttcaaggcagttttctccgatcatatacagcccagcacgccgcgcgtcgtcacggctgtctcggagagaggtgatagcttttgcaggccagcaatcttgggatatcggcagatttgtcaggacgctgtatttcttcaacgggccaccgaatcctctcaaggtttactcactgtattgggattttttttcacctcttctcgttacagttatttcacatttggcattgtgctcatgttttgtctgttcaatctgtagattgtagagtccattcttagcagtttcactggctctgctcctggtgaggtgccaaagaaaatggaatcttctgatg

SEQ ID NO: 52839 - DNA, 1501 bp, Oryza sativa
ccatctgaagtcatctgaattcgtggtgcgaggaccgctacgctattaccgtagttgtacctcgaccatctaaagttaaagcgcgagagattgctacaatttactggttcaaaaagcagcgagtagaattatctctcgaacgccaacggaggttgtagtgcgagagattgctacggtttactggttcgagaaccagcgagcgagtagaattatctctcgaacaccaatggtagttgcggtgtgagagattgctacggtttactggttcgagaaccagcgagcgagtagaattatctctcgaacaccaatggaagttgcggtgcgagagattgctactgtttactggttcgagaaccagtgagcgagtaaaattatctctcgaacaccaatgggagttgcggtgcgagagattgctacggtttactggttcgagaaccagcgagcgagtagaattatctctcgaacaccaatggaggcgctagagttggtttattacatgtgcatctcatgtgggcagcatgactcacatacccaactcgtagcatatccggatgtccgcctgcgatcatttcgggtgatcaagccgacatcgtttgcgagcaattatccgttaacaacccttttctcaaatagcctagccaaagccggcgctatgagataggtcgtcggtcttcgttggtaggttgggtgcgacagctctgcatttgccgagaacgttctcgataatgtatgtgcttgaccacaacctactcgagtgctcacttattcctgaaaaatattttctagaaggcaagatatatagcagagaatatcgagtatatactcaaaaaactgcatggatcttctagtattatcagaatataacgagcagatgtaaacatcatgcattatgtaaaccataaagaagcatgatttatacagaagaaaatagagcgagcccccagcgttagactgtagtcagcctaacaccggaaacactcgcataatagatattgtataaaagacatgctctaggtaaacataataaattatagatctgacaatactgtatgatctgaataggtatgataaattacatataaaatattgcgtacctttgtagatacatgccggatgtatctatgaaattagtagattaatttaaaaaaccaatctaccaattaacttgtcgcgtactcgttcgacatcatatgatctgacgtcttttggtacgccgcttatcttgaggcctggtcgatctcgagagatcaagttgttgatgatgatggttccgatctcgtcgggagacatactccggtcgggttggatctccccacagcgaagtcgtcgagtagcttgttgtcggagaatctatctcttgaacccatctcgtcgaaatcctgaagcaccaaaatcaccctacctggcgcgccactatcgacgtttgatgtcgcgattctggtatttgcatagtatgaggattgttggtactaagatatacgtgagactgaggtaaaagaga

SEQ ID NO: 52840 - DNA, 1501 bp, Oryza sativa
cgcgcgactactctgtacgtatgttaacaatcaaatttggtaatatctgcatcggaaagaagattggattgaagcggaatcaaacatgagaattatcgcggaaacagagtaagaatcggctgaggtttggatcggctaagtccgagtcagactgggttaagtgatacaaccgattccgacaatacaacttgtatccgatatcgggtttgagttgacgtacttcaagatgattgccatacatggatagagtcctgggaaggcgattaattgtatctattaattaagatattttatgtaaattccttagagataaatatgggtaaaagtctgccgcaaagacttatggtatcttagagtttgttagagataatagtcgtgtccggtatgggcatatcttgtaattctcgggtataaatagaccccgagccctatgtaattttaaacacacgttcaatacaatttcggcgcatcgccaccctttcgctttaattttattttgacaagttcttgctttcgtgttgagctgcatcggtttcgatcttcgacaagaggtaaaacttgttatgacggcttacgttctcgagattcgtcgagttatcatatatcttacataatctttgacaatatcgttatctaacctactatcgactaacatctgttagtagaaggcagccgattaggttaaattttgacgttgatttagattatataagatatctaccactctatgaaactcccagcggcttgattgtctagatattgttcttcttttcgtacttaatgctgcatcagttgagtttgatctattaagtcgtgcttagaatcggagtttcagccgatcttatctgatttaactatatttgctctatatgtttcattgacacgttaaatctgccctttatgtcaaaatattattgcatctaattatattaagcttctgtttagtatattctgcctgttttaacatcttaacatagagtcgtataggagtattagccattatatgctagatctatctgatcggctatgctatgaacatatataatcctgttattaatgtatatttcgatctaagtgatttatacggtctcggcatggcgaccgaatctatcccaatcacttgatttaagtatgtatcgatataaaaattatatattgttaatatctacagccgatcgaatagatttagttctttattacctatttgcaaccgccgatcgatttacatatgacatcggctcagagataaatgatacgtcatcggcacttagccgatcggctatcatttataggtttaaactgcggtttctttatatttatttcttgttgattgcaggatcaaatcaactggcacgctagcatacccgaagacgagttttggacctacactggaattaagcagatctcccaggcctcgtgtttttcgtcatcaacgtactagtactagtctattacaagtagtactactacactaatgttataataatactaatattattac

SEQ ID NO: 52841 - DNA, 1344 bp, Oryza sativa
atcaagattggcacccggccaacagctttcaaacggccacccgggcctggctgatcccatcagccgcagattttcaaacatcaaacccattccacaacagcaaatttcacaaggcagtagtcaaacaaaactacgctaggaatcacctcacatccgcccatgaccgtgggcacggctgttcaaacagttttaataacctctgcagaggggggtacactttacccacacgacattactaacccggatcatccagtccgtgcagaatggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtcagcgattttggaaattcatttagttcgcaagcaccgacccaggtgtcgggttttccaagtcttttgtaaaacccaagttttacccaagatgtttctcagattttaagtttgaaggcgaccgttgttacccgtgcagagtgcacgattaccgaggcgcaactagggggtgcaagggaacatggtataacaattacaatgggggggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttagaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagagaatggggcggctcggccgagcttaatgggccggctggcccaagaaggcagcccaaggcg

SEQ ID NO: 52842 - DNA, 1501 bp, Oryza sativa
ctgtcgcggctgcctcagccaccgctgtcgtcgtcatcaccagccgcgcaccgccgtagccgccgtcgctcacccgctgccgccgacccatcgccgcgagctccgccgccaccgccgcaagctcgcccgcccgatctgttcgtcgggtggccaactccgcaggcgcggcctcgtgcccctccgccaccgtcgcggcctccgcgtcgtcgcgcccgtcgctaccagccgcaccctccgtcactggacaagaagctgccgctgtcaccagtcatcgtccggctccaccgtcccccagcaaacgccgacatcctcccaccggcgccgggcaccgccggatgcctccccgccaaatccggcacggatctggcagcctcgtcctccgccgccagcgcctccaaactccgccgccacccccgccaaacgtcgccacccgaacgcagtaccccaccgccggcaaccgccccgccaggtccggccggtcggcacggatctgggcggtttcctcctcccgacgccggcagtaccccctgcccttgtgcggtgagacggagcgaagccccgtcgcagctgtcgctcgcccgctgctgccgacccttcgccgcgagctccgcctccaccgccgcaagctcgcccgcccgatctggtcgccgggtggccagatctgcaggcgcggcctcgtgcccctccgctaccgtcgcggcctcctcgtcgtcgcgcccgtcgccgctagccgcaccctctgtcatcggacaagaagctgcccccgtcgccaatcgtcgtccggctccaccgtcccccagcagacgccgacatcctcccgccagcgtcgggcgccgccggatgcctccccgccagatccgccagatccggcacggatctggcagcctcgtcctccaccaccagcgcctccaaactccgccgccacccccgccaaatgctaccgcccgaacgaagtaccccgccaccagcaaccgccgcgccaggtccagccggtcggcacggatctgggcggtttccgcctcccgatgccggcagtcccccctgcccttgtgcggtgagactgagcgaagccccgtcgccgccgtccttgcggccgcgcgactttgctgccggccgctcgggcagcggtgaggcgaaggaggagaagggagggagcggcgggcgacggcgagctgggcgcctcccgtgtcgcccgagaggaggcgacgcgtgagtcgtcttccgatggctcacttatagaactttattgccataactgtacttagtggattgtacttatatagaaagaaatgattcatgtgcccatccatgcgttctgaaggagccataaaactacaagtccaaaaaaaaaaaacttatatgctactaaaattttcctttgggccaataagcacgtttcatgttacatgactctgccatgcctaaacttaatgcaggtcagctctccctctaataccgactcatggttacgtgagctgctgaagaaaagccagaagaagct

SEQ ID NO: 52843 - DNA, 1501 bp, Oryza sativa
attgggttcaaataatcagagaatcgagaggagaaagacattagatcagtagaggaagcgggagagaaggcaagtctgaggtgcccccgacccgatgcctccgatttctcgactagatccgagatatcatcgcgccaggggactacatgagctgaatcggttaatgtccctaaggcgggagcagcgccgtctccaaatcgaaacctgtaagccacctatttggctcctaggtccatataattcatctagtcctatattgtgctatccgcatgacatgctttttcttattcgattcatgacgtgctgtgctataccacttctaaactgttaaagccgattcctaagcttatatacgttacagaacgttgaagaaaaatcctctttttaatgtgttttgctgtttgtccattttttatgtgaccttcaaaacatacctagttggatatatagcacgcttcttcctttccatggtggaggctatcatggttaagaggagcaagaattattcagccaaacacaacagtgagcagggttagatgttataactacgaggttggagattccaactcattgtctgatggtcttttgggacggttgcatcatttttcaataatacctcaaatgctcaattgacgtttttttttatatactgtaacaagttccctctactgaaattcttgtctgtaactaatggatccaattttgttctctgcgtgtttcattgtgactggtatcaaccttggtcttgttgttttcttcttgtatgtaatatcatgagcataacatgttgcagatcaatttcttgctcaatgtgctaaaagaaaggaatctccctgccaacaagataattctcaatgtgtgaagagaatgagatattcaggtccggaccttccagaggtacgccgtaaatgccagaatcatatatttggatgtctcagaaagtaatttcatattatcataatcttatcaggctaacaatagattataatgtaaattattagtcaatgttctgttttggagaccgtgtcaatgtccaaaagactttttgtaagcagagggagctaatgtcaccgttattgctctaaccacaaaccgttgggttgatcgttagcaaaatattgagttgtgaacaaatcctgcaatactgcaatcttgtacggtcctacatagggatggcaacggaccattccctagtgagggtggttgcaccaaaatttggtttgtcaaacaaactggttctactacaacttaaaaaataatcacatcgtgcacaatacacaaacacaaactgaaaaatgagctcagactccattcgaatgccatatgcattttatacaaccatgtgtagagcaacattatagaatgccactatatatgtatcttttttttttttgctttctctaattgtgttaattatttactcttgaattccaatattgagatttttctaaatgcttgtggatgcaggacatatggcaccatatacattccttgttgccac

SEQ ID NO: 52844 - DNA, 1501 bp, Oryza sativa
ttcatatttttatgtggtttatgtttaaggagtagtgctaactaatgataatttggttagtaggaattggaaaggtagtgtgagatgtaattttttcatgaaaaataagatgatatatatcatttattttgagataatcattttgccagatttctctggagatcagtacaaatctctttttgtttatatcttcatgtagtaaatctaatatttttggtaattggcctgtgggtattgataaaaaaaccaagaaacttagtctagtaggagtatatgttatatgtaaggttctatggcttagcagaaatgatatggtttttgacaaatcaccgtctaaatcttatatgcagatattttttagcgcaacatattcgcttcggttttaagcccaactgcaaaggtgtgatgagtatatcaaacttatgcataacctagaggcaaagattatacagattctcgccaactacagatgtaaattcacaaagaagttttagtaactttgttgtctttgtctagtgttggtggtcattagtttttgcctttttgggtgtgctattacggacttgttggtttatgcttgccgttgaaaggatttatgtaataattggctgcaaatcttcgaggaaaggacaaaatttctttctattatttgaaataatagaatatattggttttatagggtttaatttttttttctgcctggttttataggttaatcttaggaggggtggtatggatgggactgggagaggttggtcggttcggtttttacgaaagtattttacgttatgcgcggtgggtgcgagggggtgggaggccactgcgtctactggagattgatgtttaaataactgtacaccttgtattagtttagttgacacgtttgcaactctaggtgacaaagagtttaaaacaatcatgatagctacaaaaaattaggcgactaataataagttcgaccattcaggatctaacgtcatgtattcagaaactaagtgttactctgcttcgttacatcacatgtagcagttcgacatatggttcagcacgatgaaataaaattaggtcaagtgtcaacacaatccaacaacataatgttctaaattctgccagtggctagctatgcatggcaggacgaccaaaaaccctatatatactcatttaactagccatgttcatcaaacatcccagccaagttttgcatagttatcatacaaacagcaaagctagctagcttgataggcaaacacataaaattcaaacatggccaggagcatggccgtgtcgacgttgctgctactagcagctgcttctctcctcagcctgcaactactccacccgccgccggtggcctccgccgccgccgtccgcgccagaccaaaggtcggcggctactccgccaaaagccggccatgggtgtccaagctggtcgccggattcctcaagaagcagctgcgcaacaggggcaacaagcagcagcagcagcagctcggcggcgagg

SEQ ID NO: 52845 - DNA, 358 bp, Oryza sativa
taagtagttgcactctagcttgcacaaaatttgatcaacaactttttaatctctttccatttgaataaacacccaacttatcatgcaggaagcttattttggagttgttaaggaaaagcatggtgcaagtcctgatttgatgaaataacccattgatggtaaggcttggcaacatgaaacatgttacttaacatctgcgatacagctggtaacttgtagttttgcctcctttatgtacttattaattttaaaattcatcaacatgtataaatttaactatttgcattgttatgtgtaaataaatttcaggcgcttcaatctgcaatgaaacttaatgttttgcctccacgaccagcgg

SEQ ID NO: 52846 - DNA, 225 bp, Oryza sativa
gttctgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 52847 - DNA, 193 bp, Oryza sativa
ggcccatcgaccccgggggaggcaaaatagacttttgcggaggaatttgatttggaaggatttggattcggattcggatttgaactcaacgatggatcggggattgagatcttgagatggcacggacactagatgacaagcgaagaagcaaatttcgcaattagtgtttttaagagataattttcccgctagg

SEQ ID NO: 52848 - DNA, 222 bp, Oryza sativa
ccgagatcctattttgctaatgatgctatactgctaatgtgatctacttatatttatatatatttctatacaaatagttcccttctgacgtcgattgttcaaggaaatgctcttctactgatgtatatttcctccctgtaattctgctactttttatactatagttctattcatagcatggattaatgcctaatgcagagcactgacgataactcatttttc

SEQ ID NO: 52849 - DNA, 553 bp, Oryza sativa
ggggagatgggccgagagagattcggcccatcgaacccgggggaggcaaattagacttttgtggaggaattgatttgggaaggatttggattcgggattgaactcgacgatagatcgaggatttgagatctgagatggcacggacactagacaacaagcgaagaaacaaatttcgcaattagggtttttaagagatagttttcccgctaggcgccacgacggaatgggcgctacactggccatctcttccgcgcccagatgaagcagttacacacggcaggacatgacaggagaagcgaaacggaaacggaaaaaacagaactcagatcctaccgagaatcacacacaatcactcacccggcggtgcctccacccgcactacactctcctccactcgcacccacacatcgccttccatctcactccccccctctctgctctctcctctccactccatatatacgcccgctccccctcccctccccctcctcgtcagctcccatctctcctcgactcctctcttctcttctcctctcctctcctctccaaccga

SEQ ID NO: 52850 - DNA, 1501 bp, Oryza sativa
aaaaatgcccttgggcccacatgtcagctctcatatctctcttctcttctctctctctatcttctctcccagaggggcacgaggcggcgtcggtcaccggggctcgagctcattgtggcggaggagatggtgaggacggcgggagcggccgccgtggagttcgcggcggaggacgccgaggaggagagccgcatcgtcgccgccaactgcggccactaccacggcggaggacggcgacgatggcgggaatggccgccgcggcgctcgcggtgggagcggcagaggacggcgaggacgcggcgaagcggcacgggataatgattatttataggatattgtaataatgtattaattttatagcattaatatatttatttgcagggattaaactatttacttataatgtgccgacaaaattcttaaagtattcatgctgttccaaatgtttctagttttcacttaaaaaagtatagactaatttatcctaatatgttgctaggtccaccctgtcatatgcacacggatttttctttcgttccttgtatctcgctctttgacctgagtaggcaaacaaccagaacaaaattcccctgatctgccgcaccaccacagcccttacgccgccgtccaccaggcgctgtccgccagcaccgctgcaccggttccgaggccgcaccgtgcagagctgctccatcgagccgctcccaagaacggcgttccccatatcctgctgatgctctgcccaagggcggctggcatcttccctgttctctctactgcatcttcatcagctattttggttgtgcccaaagacctctcatctgcaagtgcaaactacgccaggttaggagcactctgttttttatgcacaccaggtgttcgatccttgacctgtatagacacacctctatctattacttgtttgtttcagtgcaaacgaaatatttcatcgtttttgttttatcttccatcctattatatctggcatttatttgttcagatcgtaggtaaaggctgtatatctagagtatcagagctccagttagctaatcacagggacatatttgtagtgcacaaatgttctaaaatttatatttgtaggtcctgttatctcctctgctcctaatcaagattgacatgcaaactgttcttgtggaactgtattttcagttttcaattgtcatgtaatgtccttatcatgtggctgttcatgttgcctcagattactttcatttatccagagtgcttttttcaggcccaacctcttcaccgatgcctgatctacccatctgctgctccgcaatatgtccaatatagccgccgtatgtactggatcacaacgtcaggagtccaggtgcggttaacctcacatcatatatatattctgtagacagactaattttgagttgaacttaaaattatatcaaaaaaatttagtgggtggttgtcaaattaggaacactgatgtactaaccatatttcttatcccatcacagaaaac

SEQ ID NO: 52851 - DNA, 1501 bp, Oryza sativa
tggttctcagtttatttgctccatgtcacgcacaatatgcttgaaagtgtattcataaacgatctgttattcaaatgtcagttctgaattgtcataagaaattcctgtaaattaactgtttagttttttttaaaaggaagacaaaagctttgacttttttatattgataaaggagtttaactgtttagttaccttgtagctttccagttgctgtccatgtccagtatattttcctaatatcttctttttagcgaacgtgaaatattttttttcactaaattgattctctctgttgtaatttaaagccgatcccattgatttgaggctcttaaatatataaatctgcctgtggctattgcgaacttatttgttctttttcctgtgccaggttcaatgaaaatgttgtgaagaaagctgtccacctgcaggttggattcctaggggggttgactgttgaggaataaagcaatccaatggatatttcaaagtaaaatggtctaatgatagttacaggttcaggaaccttatcatcagcaattgagatgggcctcagatgaggaagtatgtccccttcgttccagtcaccaaacattagctaaaaaacgtgtcccctgcactaatctagctgttattttgatcatatgtcataaactgttcaaaaaataagtccactgactgttgtccccagtctatgctgttccatgaaatctgtaatttaatcaaacgttgaagaaccggaacaataactcttatcttaattgcgtccccctggtagtactgttactgtactactaccgaagtacggattgtagttggtagcaagagcaggtcaaagatttcatcgaggaaaaatatttgacacgcctttctctaacacaagcagctactcctattcgtttggtcaaagttgaggtccaatgtgttcatcatctcggcatctcgctcgtgagaacgcaacgacaatgcgctatattctgcgctgacaggtggggcccagaaaggatgaagcgcgtccgtagactccgtacggggaagttgctacgtaccgacgccagctggactttgtactccaacaaacggcagcgatgacgccgaccgacctaccttcccgcatgtggacccgacacgtcagcctctacattcggcctttggacagcgtcctaaagatctcgttattttttatatttattttctaaaagatttaaaatataaatttccatttcaaatattttacatgaaaatactcctcccggtagaagtatatttttaaaactttgaaatgataatttatttttaaattctttttaaaaaataaatataaaagtttaaacaatccaagatctcgctacttccggcccgggccgacctgccgcttcccttgatatgacgcacacgattttactgctggccccacatgtcacaagcacagccacgaattcggaacgaaccataaaccgcacccgcggacgtgacacagccacgctgactatcgtgccccaca

SEQ ID NO: 52852 - DNA, 1501 bp, Oryza sativa
ctcacggtgaccttcccggctttccgcagctgcgcggcggcctcacatgtctgcaacatcgattgatcacgacacacgcacacattctgtcagtgcctactactacaacaaatttactcttgtctgcagcaatactgatggtagtattaccatgacgaagacggacatggcgtgggtcttgagcttggggttcttctcgagcggcacgtcggagttgcgcaggaacgagaacatctggctcgccgacggcgcgacctcgaagatcctggaatagagatatagtagcaccaatcacgcacaccgaaatgtataatgcctcagaaaccaatggttggtgccgtaaactgactctgcgaagaatggcactagtaagtagtagcatgtagtagtacatacttcaagaagaagcggagtccaatgttggcggaatccttcttcatgatggcccacgacttgagcacaagcgcctcctgctcctcgctgaagctgaccgctccccccgacacgccgttgtttccctccacgagagccatggctgcttcgatttgattcctctgtgtggtgaatcgagtacaattcgagctcaattcaactcaactgttggttgcgatctgagtccgaactggagcagagcgaggccgatttatataggtggatcggtcccaggctggagcggcctttcgcgctcgcgaggagccaagaagcatggagacgggatagccatgccatgatgccactccaactctacggtgagacgtacaggggggaaggaacaacagatcgacttggagactacggcggatatccattcgagccgaaaatctgtgtgccggatgcagctgcgagagcgggtagctgtgcctgcgcaaggcaggcatgccgcatgcttctgcagtgtgcgctctcgtctcgcctcaataacgtgggcggccgggcgcgcgaaaaccagcggcggctttaacctttaagaaaccaagtcaaatactccacgctctctcgcctctcctctcggtctcgggtcgtttctttcttgtccaccaagacgcaaaacggtcgtgttcgctcggtcgttcgtgcagcccaaaagtccagtagtgtggaacgttccacaaacgaaagtcacggccttttttgggcccggccagccagacactccgagaagatgtcgtttcctcgttaactgggctctcggttgggccctctacgtggactcgtggagataggtctcgttaattgtttcacttccgccgatccttatcgcggacgacggccggcggggtggatgcggaacgacggcgaccagcggcggccgtgccgtttgcttgcgaactagccgtgagcccatgagttcgatcgggcagtgtacgtgatttgtggacatgccaatcgccaccgtctcctctcctctctccgttcgcgcccccgcgaacgcggtggtctaccgatgcgtgtttctttcctacctatattaggctcccatttgtgttcccatttgccgcct

SEQ ID NO: 52853 - DNA, 1501 bp, Oryza sativa
gtgatgtcagtagtcccaatgccgacaccactcttgtcacgaagtcgtatctcaaataacaactctctattcccagcaggccatactctgtggattcctcccttcttacttttctcatccatgtactgtgtaatagcggggctatacttaacactgggtttgctgaggttcagactagccatggaataccttttacagagatacttctgtgtacccctcgtgatgccctctaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagttcctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatataaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaaacaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctctgtcacgccccgaactagtcccgaccggaactagcccgtgacgctccaaattaacctgttaatcgataccagtcccaggaaacagtgctggtatcacagggagatagaatatcacagcaacagaggtctctttattatagagtagaggtacagtcatgttgggctgcggacagatcccgagctcacaactgcattacaaaagggaaacggaagcaggacatggaccaaacaacacaggcgtgacttgggaactaggcagaaaccctaaaactcatcgtagccggcttgctcctgaaagaactccgcatcagcaggatccgcttcatcttcttcagcaactggggggaga

SEQ ID NO: 52854 - DNA, 1191 bp, Oryza sativa
gtcaaacaaaactacgctaggaatcacctcacatccgcccatgaccgtgggcacggctgttcaaacagttttaataacctctgcagaggggggtacactttacccacacgacattactaacccggatcatccagtccgtgcagaatggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtcagcgattttggaaattcatttagttcgcaagcaccgacccaggtgtcgggttttccaagtcttttgtaaaacccaagttttacccaagatgtttctcagattttaagtttgaaggcgaccgttgttacccgtgcagagtgcacgattaccgaggcgcaactagggggtgcaagggaacatggtataacaattacaatgggggggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttagaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagagaatggggcggctcggccgagcttaa

SEQ ID NO: 52855 - DNA, 1049 bp, Oryza sativa
tcctcgccgacgccgacgccgacgccgacgaggtaagagttctcgcgatggacggtgttcgccgtcggagaagaaggagaaggcggcaaatgggaacacaaatgggagcctaatataggtaggaaagaaacacgcatcggtagaccaccgcgttcgcgggggcgcgaacggagagaggagaggagacggtggcgattggcatgtccacaaatcacgtacactgcccgatcgaactcatgggctcacggctagttcgcaagcaaacggcacggccgccgctggtcgccgtcgttccgcatccaccccgccggccgtcgtccgcgataaggatcggcggaagtgaaacaattaacgagacctatctccacgagtccacgtagagggcccaaccgagagcccagttaacgaggaaacgacatcttctcggagtgtctggctggccgggcccaaaaaaggccgtgactttcgtttgtggaacgttccacactactggacttttgggctgcacgaacgaccgagcgaacacgaccgttttgcgtcttggtggacaagaaagaaacgacccgagaccgagaggagaggcgagagagcgtggagtatttgacttggtttcttaaaggttaaagccgccgctggttttcgcgcgcccggccgcccacgttattgaggcgagacgagagcgcacactgcagaagcatgcggcatgcctgccttgcgcaggcacagctacccgctctcgcagctgcatccggcacacagattttcggctcgaatggatatccgccgtagtctccaagtcgatctgttgttccttcccccctgtacgtctcaccgtagagttggagtggcatcatggcatggctatcccgtctccatgcttcttggctcctcgcgagcgcgaaaggccgctccagcctgggaccgatccacctatataaatcggcctcgctctgctccagttcggactcagatcgcaaccaacagttgagttgaattgagctcgaattgtactcgattcaccacacagaggaatcaaatcgaagcagcca

SEQ ID NO: 52856 - DNA, 1501 bp, Oryza sativa
ggggcaaagtggggagagaaatggagtttctctgccacgactcctgatcatattcccaacgcctagataaagagaggaattattttgggattgcattcaaaagcgacggttaattatacagaacaccatatattgtttgttagagaaaactctttatttaatacctaaagcacttatcagtctacataacgtatgaaatcggttattgtgcccctaaagtacgaaaagcgttccacataaagtattctatagtttctgggaggtacttttaagctagttaaagagatatgatattaggtgtgtgtgtatgtgtgtgtgtgtgtgtgtgtatatatatatatatatatatatatatatatatatgtttatagagataagtgcacgcatgtgtatgaatatttacgtttataccgtgttccaaaaaaacaacatatcaaagttgtttggaagttttttttattttctaaagaaacatgtgaggatggtttgtaagtgttcttttaggcggtgatgcgaccgagtggtattgtttgcatgacagacacgttaaccaatttcagccgaatagttcaatcactaactttctccgatcacgttacttctttcctaagccgctatagttaggagtaaaaatgcatttaatcaattacatcctcatgtcactgtgtgttcgtcgtggtcccggtggccaaaaccactctacaggttatttgaaccaatttcatacttttgggagataatttacccggttgttccatactttataggattaatcagactttttcaacgctttattctcaaacggtagaaatggtaagaagccgttgtgctatggctgttgactttgtagctaaacattgcagagacccgaagttgactcttccttttttttgaaaaagaaaaaaagaacagagcaacttggcatgaactgtaatctgcgctagctgcatatgaaccatgctcaatttacattggcctggtgaggtgacttttaccaacgattcgcattgagtacaccaaaagggttggtcaaggaatctagcaaataccaaatcaaatatccaaagcataggagccaacactcgtgggcgcaagatccatcacctaacggccgctagaatagttggaggctttattttgggggagaataattcgaacttgaccaacaggcaacagctctcgccattggccaaacaaagaggaacaatgatcacgcttcacgcccggcagcatttgacagataatggctgccccaaagaggccaaagctgtacaacgcagctcgtcctgttgctatccaactactgctctggaggtagtacgtttgcgtgtgctctcaccactgccatatgcttaacgtgacaattaagtaattattagcagatgctgcgcgtacgaagtttgcgacagcgttggccatgtgaatttgtatgtgaaatgaattttgctgaaattttgtaaacttggatttctcatgcgagtttgattgatatttgcagcgt

SEQ ID NO: 52857 - DNA, 1501 bp, Oryza sativa
caacggtctggctgcaaattccgattgagttttgagaagacacactttcgcctgagcgccgtgcgcagatacggtagtcgttcatcgatcagatctaagtagtgtctttgactcccgtgtattcgttaataacattttctcaaatagtccagacgtaaccgtgttaacgaccagatttgataattcaagtatcggagatggagataaaaccgaagcggaatctaagatagagatcgttcaggaaacagagtccgaatcggctgcgaccagaatcggcagagttcaagtcggacaaggctagccgattgagccgattccgacaatacgactcggtgcacgtcatcgggttaggttgaagtgcttcatatggattgctatgcacggattgagtcctaagaagataattgtatctattaattaggatattttatgtaattttcttagagataagcttgggcaaaagtctgccgcaaagacttatggtattttagagtttgttagagataaaaatcatgtccgatatggacatattttgtaatctcgggtataaatagaccccgagccctatgtaataaaattaacacacgttcaataataatctcggcgcatcgtcaccctttttactttcgtttcatctcgacgagttcttgctttcggattgagctgcatcggttttgatcttcagctagaggtaaacttgtcatggcggcttgcgttctcgggattattgcttccatctttatgacactctaatcttgtttatgtaagttatcgagttatcatatatcctatataatctccggcaatattgttatttaaccttcagtcggctaacatctatcgctagagggcagccgattaggttaaataccaatgttgacttagattatatagggtatctaccaccctatgaaacatccaacggcttgattgtctagatattgttcttcttttcataattatagctgcatcagttgagtttgacctaagtcgtgattagaacctcaatctcactacgagagaattatgctattgccatgaaaatattgcaacaaacttttattgtggcaaatgcattattctattgccatgtctggtcatcttgtggcaattggtaaattatatcacaacaatttattattgttgttatacttttattttttgttgcaataaacagcgggctatggccacacggaaaattactgtagcaataagggtattttttgcaacagttttttttatggcaactaacgtattctctctggccacaatatattactgttgcgttaattttggacttgttgcaatgtaccagtactattgccatgacttgtaggttaaattgtggtgatagtatttttttttgtaaaacaaatattttttttgagtgatgaaaaatttagacgtaactgatgtggtctcaattttttatcctttggcgggtcctaatttcttttttggcgcctaagtgcaggatgccgggagttgttcttttttttta

SEQ ID NO: 52858 - DNA, 1501 bp, Oryza sativa
gcaacaaggactgcatctccatcttcctcgcgcttgagggcatcgtcaccgaggatcggaggacgtgctggcaaaagctacattcagcctgctcgatcgatacgggaacccggtgctgtcgtacacctatcacaccaaattccgtaacttttcaacatattctggtagtgcaagggggttcaaaaacttcattaggagagacgaattagagcgatcggaatatctcaatgatgactactttgccattgctgcccatgtaatcatcccaaaggaaaagccatctgtcgtcgtaccaccgtcgaacatgcatctgcattatggtgatctcctcgtaagcaaagaaggcaccgatgtcaagttcctggtcggtggcgagatgtttgcggcgcaccggttggtgctggcggcacggtcactggtcttcaaggcagagcttttcgggccgacgaagaaaggcaccatagatgcgatacagattgacaacatgaaagcacgagtgttcaaggctctacttgggttcatctacacagacatttggccagagataggtcatggaaaagacaatgtagctatggctcaacagttgcttgctgctgcagacaggtatggcttacagaggttaaagtttgtctacgaagataagttgtgcaaccacattgatacatactcagtgtcaaccatgttggtgctagtggagaagcaccattgttgcaaactcaaggaggcatgctctacgttccttagttccatgagccctcctattgttgaagatccaaattccagcatatttggtagtgaattgaagaagacggtttcttcttcagagaaccatggaagtcaaattaaccgtacagatattaggattcaactgtggcaaaatgcagatgtctagaaacgttatttccagtgctataaaatttgtttactttgtttctaataattatgtagattgactttggacttgagtttttacgagatggtgtatccttatatatgttgtcaatcattttttttaaaaaaatagaactactgatatttgagaaatgagaagtggacccacacgtatctaggacgtaatagtggaggttcacaaatctcctgacaacgattgcctttctcaggcgagattttttttgttcaccacttacttttttttgcaccaattttgttttttgtaagtttatatacgtaaaatttatattcaaatgtttttttcgcctttcctaggcgagattttttttttcaccacttacctttttttgcaccaattttctttttgtgtaaggttatatacctaaaatttatattcaaatgtttttttcaccacttaccttttttttggcaccaattttctttttgtgtaaggttatatacctaaaatttatattcaaatgttttttttatgtatggagtttactgtatatatttataaatataaagtctatgcacatttattatttttaagaatatattttaagggtattagatttttttaacttct

SEQ ID NO: 52859 - DNA, 1501 bp, Oryza sativa
gtgcgatgtgtgcggccgatctatgtgatgtggatttctttttctgatctgtgtgatgtgtgatgtgtgatgtgtgaatgaatttgtggagatgattttgtgattttgtgaatgatttgtgatgtatttggggatagaaaatgcagcttgatatatttagggattttgtgaatgatctgtggtgttcgaatgatttgtggataatatgaatgatttgtggggctcgaaatcatgcaagcagcaggaaagaaaaaagaacaccaaccggaactaaagaacggttggtaactccaaccgggactaaagatttagtcccggttggtttagtcccggttatttcaaccaggactaaaaatgggcatttttaagtcccggattcgtagtcccggttcgtaaccaggattataggggggttgcgaaccgggattaaaaagggtttgtccaccagtggtatatacaaaatctcgtataggctttcaaaccacatgatttctagcaagtatttaatcaagaaggaagtccaaccctctcacgcaaacacatcttcttgcgcattggtcctgtttggctactgattttgcggttgcgccacagccgacaccaacagtattgcacaaaagcagcatagacgctgccgctgcagtcggcttgctgaacatgcccattagcactattaatgtatctttgtagaaatatcaatcgtaagtgtgccaataaaaaagcgtgtggttgctatctattccgtgttgtactatgttttgaaactaagctatcgagggtaatctttaggcctatatggattgctaccctaccaattctttggtagagtaagattgcagttggttatatttggtttgctaccaatatgaagccaacatgtgaattatagggaagaatgttatatattgatgacaaatctagcatgggcttcaatctaaactaagcataagtactattcaaactaccaaaacaatggtaggtcgtattttggtagcaatcaaaaagccctttattagttcatgtagtggtgttggtgggcaactctaacaaaaatgttcccatatagtaacccccggtctaaaacttaaaataattaggtgttacattattgagctgatgagctgattaactaacaaactaatacatagaataattgataaatatcatagattataaagttaataaataaatcagaagaaaatattaagcaattgtcatttacaaggttttttggaaaaatcatacctttcgaagtgtgtcacaaataattgtattgagctagtaagctgattaaccaatatattaataaaatatcatgattataaagttaacaaagaacttagacaaaatattaagaaatggtcatgaacgtttttgaatagatcatacttcgaagcgtgtcaagaataatccatacttccattacctaaacataagttaaaaaaaaagaatagggtctacaatggagctccactgcagcacacacaaaaaaaataactat

SEQ ID NO: 52860 - DNA, 1501 bp, Oryza sativa
tagccttaatttttttggatattgcataaatagaattgctgatgagagtttaaacgttgttgcactcaatttcggtatatgcagaaaagaaatcaatgaaacataaagaataagtctaatgcaaatactttgctaagattgactcggctagcttagcctatggtggctctacataagtgttaacaggctttattagataagcatgtacacactgggatggtttttgcacaaaattgagtaggggtggatatttgcaacaaagtgatttatgaggtggaatgtcaaacttcaagtggcttttgggatggtttctgcaactttcccaaaattaaatgaaggatgagtgcgattagctaagacgcgagcgtaagcgaagaaatagcttaattttaggaggagtaaaaatatataacttcatgttgagactgatggattatactagtcctatttaaggatgagtaaatttcataaaactacatgtactttgatcaaactattataaaactataaatttaaaaaggtatatcacataaatacatatttaggaccaaatttatcaaataactacagatttaaggtggaagatcaccaaactaccgatgtagtaataaaatgatcacaaaacgacatgttttgtaccatgttaaatacaaaactacaacatttataattctaacataacaatagtagtagggatttaaattgtaaaatctataattttgtgataactctagtattaaatctatagttttgtgatagttgatcttaaattagtagttttctaataaacgttgtgttaaatctatagttctatgatacgacgtcttgaatctatagttttattataatttaattaaagtacacataatttttgtgaaatttacactttaatgatgaattgatttccatcatccttgtgcatgaatctagccaaatcctctgcagtattgtcgatgcagtagcaatggatcagtatcgggcccacacgtcagtgtctgttactgaatgtgcagtactgtaaagtgtaaacctccttccttaaactaatcctctattcccttaaaaaaaatctacagtatattttttttccaactcgctggccgctgccttcctccggtcctccctgagctggcatttttggcaccacaacacaacccccccaccccaccactcttctccctatcgcactccacctccccgagacgcgacgcgagcacgagcagcgcggcggcccaactcccgaggtggtgtaaagccttctcctctccgctaccttcttccaagatcgcgttcctgctctctgaattcgcggtcagtccggggtggggcgcgcgagttcttgcctcagatccgcggcggctcggtttctgttgcggaattgtctaagatttgcgggggtgtttgtttgctgctgaattgccgggtgtttgtgattcgttggctgcagcttgctttcttggggggcgccgccgcggcggagttgggtttgaccggccggtga

SEQ ID NO: 52861 - DNA, 1501 bp, Oryza sativa
ataatatagtgcatgtttgttaactagttaatgaatttatctctcttgtcttgcaatacatgatcatgaattgttttaggtacacttcaaagctctcgaaagaaatataaaatataaaatataaaatggttattccaagtggcgatcatgacatcattgcatatgtgcttcattggttattattctcttttgcattcttgatgaaatcattgttaaaggaggagaaatatacaaaatgcatgcttcttgaaagagggagaattgaattgtttcaattttaaaaatagtcgattttgtgctttgattgcaaattgatgggagaaattctttcttttaaaaagggggagagtttttctttttcacttttgagatttttgttttcatttttcaaaaacacaaaattgcattttgaagatgttgccaatgtgttcatcaagggggagaacgtgaaatcattatcatggttaatatttgtgatgaacaattggctatgcaaatgatttaatcaaagaattagtttgaaaagatgtgtggatgttagtgtgagtgcgtgtgactaatgtgggtcaggttgtgatatttgtgcccagaaatgtttgctttatctgattgtgtgcaggtgacttgaggtcagccttggtcaatggtgaggaccgggattatgttcagggaaaaacagaggtctagtgcggtcgggataccatgtgagaagatgactaaagtcaggattcttggaggtcaacttcggtcaacggtggggatcgggactagactcagggaggagttgagatccagacggtcaaggataccgggtgacgaagttggatacaagatggcatacggtggatgaatactgtatggatgagatcttcgcaatgggaagggttgaggctagaaggatatcgacttttgagagagaaaaattagggtttacttcgaggtttcaatcctagttcgtgagttgagaggggagtgttttaggtacactttgtaaacatatattgatgcaataaagttgatatactttcaagtgtttcgtcgatacgtgtttttctggatcctgacggttggaccggaggcaagtctgcagtctaaccactggcggtcacacccgcggcagggagacggttcaaccggcgacaaggcggcggttagaccggctgcgtgcgagtggttcgaccggcggcaatagaactacgtcgagatttccatcgatttgagggtaacttttattttcggtaaaagcttttggggttttggttttccttgccattcacccccctcctgataggcttggttattcgcgttcgatcctacaaactgcaacgaaccgagggagctaacgagatacaaggttttcacgagtcctatataattagctcggcttctagtctagtggcatttgatgaccctgtggttgacctgcgtggtgttcgtccccggtcggtacagcctcagcgggcacgtcgcgtccaccctcctcgtccggccggcgtgcacc

SEQ ID NO: 52862 - DNA, 636 bp, Oryza sativa
aatgattatttcatctagatgtcttaataaattgtaattaacattcctgtgtttttctgtgcttcatctaaatatatgctcttttcaatcttttgttttacagacgctcctaataaatcaccagatgacacgctacaaacactctacattatcacatgatttaaatccgtgagcccattatcttagatcctttaaaactaaaccattcaattgctaaacttcttcgtgtacgtacaacggtgtataagaaaaaaaaaacttattcctaatctaatgcacgtgtacatatatacgacacaatttctatgtgtgtggaccttttgtattgacaattgttatgcataagaagtttttcaaccataaattttttcaccgagagacaaagtcataatataaaaaatcgtaataacaacaaaaaatgatattttaaataagaggcccgcgcaactgcgcgggctaccttactagtttactaaaaaaaagtagtgcctcgtgacacctctttaaggaccgtaaaattgctcctgtagtatacattgatctgtaagtccaaatttgtgagttttggtcgaaatatatatgattcatcaattcaaaattactaacttttcgtactctggttaatttctgtacaga

SEQ ID NO: 52863 - DNA, 173 bp, Oryza sativa
caaggtcgtttgatgtactttattatccctgtacataaatctagaataacttatatttggaatccaagtattctatgttttgagtttggaaatagtgggcatattagctgtcctgataatcctgcaattctccaaaagttataactttgtcattttattggtactcacatagg

SEQ ID NO: 52864 - DNA, 1501 bp, Oryza sativa
cgtaaatattcatacacatgcgtgcacttatctctataaacatatatatatatatatatatatatatatatatatacacacacacacacacacacatacacacacacctaatatcatatctctttaactagcttaaaagtacctcccagaaactatagaatactttatgtggaacgcttttcgtactttaggggcacaataaccgatttcatacgttatgtagactgataagtgctttaggtattaaataaagagttttctctaacaaacaatatatggtgttctgtataattaaccgtcgcttttgaatgcaatcccaaaataattcctctctttatctaggcgttgggaatatgatcaggagtcgtggcagagaaactccatttctctccccactttgcccctcgtgttggcgaaatctcaatttctcggagcaaaaaagtaagatctcatcaaatcctccccacctatttattagaaaaaaaaatgtgccatcaatcgccatcttctttgctcaccattccggaagctagaaaaggttcggtaactcggcacgaatgagtaacctgcatccgtaaaaacgacgcagaatttcgtcctaccacttcgctgaactgactaaagtattctagtgcagtacgctaattcgaggaacaaagaatcacaacgaaagtgaagccattgttccactattccaaaaccgaactaagctaaccagttaataagcatccagcgagcgaaacatgatctgaagatgattcggtgataccatttcatctatctatctaccaacaaaatgcaaaaacgaaatcaaaactttcaccgcgataagaaacaacaaggtagcatgtcaatgatgtacaagaagcaacgaatcactggcacaattcgcaggagacagcttgagtgagaaagaagcgctctagcgcggaaagaacttacttgccaagtggaagaggagcgcttgcagcagcccagaggtgacagcagcatccagccacctcctcgcccccatgccaccactgccagccaagctactagcaacaagaatcctactgcttgatgcaatctcgccgcagcttctcagatgttcgagtccaattatggctactacttgggatcagtgaaatggtcgaagactcaaaggagctcgagtggcaaactggcaatgggagaggcaaagaagaagacaaggaggaaagaggccaggaaggaggaggaggaggcgagtcgtcgatgcagtctttggcccccttgcttgctgcgtaaaataagaggagagaaagcggcggggcgcgaggtgacaccgtggggtcggcagcacaggacagggacgacgacgacgacaagggttgtgtgcgggagaagccgcggtcaccgtcgcctcgcctcctttctcgcggtgcctgcctctgaccgcacgtctacacgcgcggcgcggcccgccaatgcgttttttcccctctcctttggtgcgtcaactcgccgagaaatacagccc

SEQ ID NO: 52865 - DNA, 1501 bp, Oryza sativa
gatgacgcaagttgactcgagcgtataactgctcatgagtttcaaaaatgacgtaaagatgaagaccaatgatctagcaccacttcattaggatgacgaggcaatgaagcaccttgcctggtcaccggccaactcgagttacttctccactaagagttgccttaactactcttcgccagggaatgacgccttgtttatgtcgggacaagattccgtccctactgttaaataaaccaggggaaaatatattttactctcttggactatttcattggagcagttaactcttaaactattttttttgtctcactttacccttgaactatttttctttgctctctaacaatatctctctttcatttctctctctatattattcatattttgcactggaaattgggtaggatgatagaggcactgtaacttacgtctcaacattttttttaccatttatagaattgtacaaagtttggaaacaataagacatttaaacatgaataaaaaacttcaagcaaacaatcatgattttttttttggaaaaatggtgccatgtgaggtttaaaaaaagtcagcttacaatgcaacttaaaagagaaaaaaaatattatgagtagagtgaaccatttttaatagtttaggggtaaactaagctaagaatagtttacgaatttttaatagtttaggggtaaactaagctaagaatagtttacggaggattaagtgatccaatgaaatagtttgaaaagtaaattggacttcttcaataaattaagaataatttctggaaaacatcatgtttaatggtcaaaattgcaaaaaaaaaaacaccggtattatgacatgtgacactgacacatgtgtctcaatgtttcataaaatctctactctattgatatcatgataaatttcagcataacataaaaaatattttaaaatagtaagaaagaattaagtatcaaccttaacttaataattaaaaattccatatattctatatgtatatatttttaaataaattcacgcttaaattgaataagagtgaggttttataaaactttaaaatcataatatatggttaaatatcaaatgtttgactttatataaatttgatctgaaaacatgatgtcttttaaattttttactcatccttagttaaactagcaaagtcatgtgtattttagttttcatgcggggagatttttccaccgcggtgctagcggtaatttaaccggcaaagggaaatttccccagcgcgcgccgcagcaaaacctgaaaaaccccaaccgaacctcccatcccgccgttcctcatacttccccccctcaccgcgctctagggttttccatgccgcgcctcctccccccaaaaggcgcattgctccggcgatggcttggacggaggacgaggcgattggccccgatgtggcctccacggggctccacgtctcggagcggatcggccgcgacgccgccgctcagcctgacctggaggaaggccctcg

SEQ ID NO: 52866 - DNA, 1501 bp, Oryza sativa
ccgatctccctctcggcctagtccaatgccataagaaatctcttcctccgcaaatatttttaaggcaagaattagagaagtcatccttgcctgtctccaaaagagctatgaagtctagcttctactaaactaaacatgacagcccattttagggttctcgttctcatcaacaccccacttcacggcttacctctttctctcagcaaacaaggaactaaataactaaaattccagaacatcgcccaaaacaacagctgcttggtgcaccgcccccaactccgctgcaaacttcctcgagttgccaaacaagccgcaccccgacaacgaacgcttctgcagatcaacggcttagccgtgcacagcctcgagtatatagcacgcgattggttccggcgtgcccacctcattgggatatgaggagtaggggtgggaggcgtggccgcgtggcgtgaggcctcgagggccttcctccaggtcaggctgagcggcggcgtcgcggccgatccgctccgagacgtggagccccgtggaggccacatcggggccaatcgcctcgtcctccgtccaagccatcgccggagcaatgcgccttttggggggaggaggcgcggcatggaaaaccctagagcgcggtgagggggggaagtatgaggaacggcgggatgggaggttcggttggggtttttcaggttttgctgcggcgcgcgctggggaaatttccctttgccggttaaattaccgctagcaccgcggtggaaaaatctccccgcatgaaaactaaaatacacatgactttgctagtttaactaaggatgagtaaaaaatttaaaagacatcatgttttcagatcaaatttatataaagtcaaacatttgatatttaaccatatattatgattttaaagttttataaaacctcactcttattcaatttaagcgtgaatttatttaaaaatatatacatatagaatatatggaatttttaattattaagttaaggttgatacttaattctttcttactattttaaaatattttttatgttatgctgaaatttatcatgatatcaatagagtagagattttatgaaacattgagacacatgtgtcagtgtcacatgtcataataccggtgtttttttttttgcaattttgaccattaaacatgatgttttccagaaattattcttaatttattgaagaagtccaatttacttttcaaactatttcattggatcacttaatcctccgtaaactattcttagcttagtttacccctaaactattaaaaattcgtaaactattcttagcttagtttacccctaaactattaaaaatggttcactctactcataatattttttttctcttttaagttgcattgtaagctgactttttttaaacctcacatggcaccatttttccaaaaaaaaaatcatgattgtttgcttgaagttttttattcatgtttaaatgtcttattgtttccaaactttgtacaat

SEQ ID NO: 52867 - DNA, 1501 bp, Oryza sativa
aaaagaggttaaatcatatagttcagtcaagtcgttatgccacagacatggtgattagttatgactagtcttgtactgctcaaacagaaggtgcagagagaaagggggaaggttcagagaagaatgaggaaggagcaaggattgatcaacaaaacaaaatagaggaaaacagagtaaagtaacatcaccaagaacaaaaggttgcattgataggaactacagcaagtcattgcattgatagattttcctagtttacacctataaaactagcctgttgaaagaccagatattccaatctagtgcctcccaacagagcaaccttcacaaacaacaacgtgataattacggaaaatgaagcataacagattggcagtcaatcatctcataaaattgctcaactaaccttaacctaatgctatactccctctgtcccaaaagaagccaacctaggaggggtcgcatcctagtaccacgaatctggatagccctttggccagatccgttgtactaggaggggtcgtaagcctagaactagaatacctagaactagaacacgacagaagcaagaaccgccaacatccctttaaatctcctatcccttgccaattcagttattctccattcgtagccatgcataccataatatgttatgcatgaagaaattaaacctgaacttagcctaagacaagattttattagagatgcatgcaaatgtagtgacagttactacgctcacaaaccacaactacaaaactaaggaattcaataaggattgtggaaactggtaagcttaagatggcagagccaagtgttgaaacattaagctgttgctgacagtgtagtttgaaaagttaggggtgtactgcaatggaggtaaacaagatggagaaagcaagtgagcgaggtagagaagatgaagttttataccttgctcgttcttgccgagccccttgcccttccaccccatcttctggagcagcctgaatccgacgttggaggaggtgagctgcgtgtcaacggacgcctgctccagcccctccgtctcgaggttctccgtggggcggtggctcatgggcagccggaactcatcaaaatcatcctccagctcctcctcctcttccaccggagctccatgaggattcctgctgctgcttccgccgccgcgatctcgcctctcctgaacaacagaaatcggtcagatggatctggagcagatcggaacggagaggtgggagtggttgctactcaccatggcttcgtagacagacgcgaggtggggggagggatgctagggttttcgtcggagacgcctcgccgccgccgccgccgccgagacggagtgaggagaggggatcggaggtggttgccgtacggttgggcctgaacgggcttatattgtgctccgtgcggcccactaatattgggccgtaacgtgttggttcggcccacgttgaccacggctcccgccagaactcgactttggtggacttccaaaaaaact

SEQ ID NO: 52868 - DNA, 1501 bp, Oryza sativa
gcgcggtgagcccggtccaccggctctctctcctccctcccacgcgcgcgaccgtcttgggctggccggcccatttagctcggccggaccgccccaattctcttgggccgcgccctagccgcccgagaaaagtctattttccctccctcttttcttttcttttccaaaaaggatttaattaaatccttttcctttagaccaaaaatccaataatcttagaaattcaataccttcccaaccataaatccgtttgactccgttcaacttccaaaatttctcaaatctcgagatctatctaatggcacgctttgaggtcattattagggcttcattttcgccgtttgttgagttgtcccgtttcgcgtgtagttccggagcccgaagacccgcagtgcgaggatttcgaggatcaagctccagacctttagcaaggcaagccacctttgaacatcttgagcctatacttgaaatttaattatgttgcttgcaaaatattatgcattaataggatcgcacttaatatgttgtcccgtctgcaaggcagattggcggacctacctaacttgttgcatttgatccttccattgttaattgctataccatgtccccttgtaaccatccagttgcgcctcgatattcgtgcactctgtgcgagtatcgacggtcgccttcaaacttaaaatctgagtaacaacttgggtaaaactggagttttacaaaagacttggaaaacccgacacctgggtcggcgcttgcgaactaaatgaatttccaaaaccgcggaccggggaacgtaccgggtgtatggtttttcccgctctcgcacttaaggaccgattccttggaatttcatccaaacataagacaagtacgaccacatgggtggaatgggacacccctggctgagtaactagcttatcaggggagccttgatgtcgagagacatgtggattcaccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagtcgtgcccacggtcatgggcggatgtgaggtgattcctagcgtagttttatttgactactgcttgtgaaattgctgttatggaaaggggttcgctgtttgaaaaatctgcggctgatgggatcagctaggcccgggtggccgtttgaaagttgttggcccgggtgtccgtttgaaaagctgttggccgggtgccaaccttgttttaaattttaaagactgatacattgcacatactccgaccggacgagacgcaccgtctcagccgtgtcgtttgagaagcactcacttagttgttttt

SEQ ID NO: 52869 - DNA, 1501 bp, Oryza sativa
taggtgatgcaagctgattccatagaagttcaagatcccgcggaaaaatttcgaggtcggaagagcgaagccgccgtagaagaaatgcgagaagaccacaatctcgtgtgtatcgggggtcggaaaaatctcaccgtacgctggccgccacccgatgatctccttagcagggagaacgccgtgcgccaccatctccttcaggttctcttccgttacgtcagacggcgcccattggctttcgaagctttctctctcttccgccatcgagtttcctcaaatgcgctgatttgattcgagggatggcttgggagaggtgaggaattgaggcggtggatcacgggaaggaatttgatcactttttgaaggtggatttgggtggattggtgaaccctagttcgccggcgcagttctgcactgtagcaaggagtggggaaaatggcgagagttccggcggggaagacgaagcgtcgcttggatctcggatttcttgttaagggtatcggaggtgcaaatgggcctaggcctgaacagtacttcagcccaatacttttaacagcgtggcccattgtgttccttagggacttaggcatattttgctttggcaatattatgctcacaatagtgttgcccgatgctgataaaatcctttttatgcggtcatataattctttggaattattgcaatgcaaattaaaaggtgcccgacagaaaggtgttataccgcttttttgttagctttattaggctacaaaagctgtctgggttaatctggaatgacttgtttttatcatagtcacttccttggtatgttatatacctattttcattatggtaaatagtcatagcctaggctattagacttattcattaccataattttttataatacttggtgggtgatctttagagttttatactcggatgcctgtccagtgtgttcattcgtgaaccttttagagtgtaaaccactcggactctttttgttatggctaaaaagcagtcggctagaatgtctctttaggcgccgcgtatgcttttgccatctgatgcgtggtagtgctattattttgttctcaactatatgtttagtttgttaactaatcacatagttgggggctacacctaattaggtgcatctattcgatgcaccatattctttatcttttcgccctttacagtcttcgtcttcgctactcggtgggccttggcatgaataatctgaagcactcggattgctatctttgagaaggctacgatggttgactgcaaaggtctcgggggctactgtggagattatggatatcccatatctacacggcgatactatttgggctggatataggataccgaatatgtatggaatatcttatttgtatctcgggtttgtttcttaacttgtacaacaaggaaacaccttgagacttagtcggtcacggctgtatttaatctatatctgtgtattccgttagggatattgattatcttttgtaacccggactcc

SEQ ID NO: 52870 - DNA, 1501 bp, Oryza sativa
aaaatagatgtttaatgcaggcttcaaggaaaggctgttgtttttgcaattgattttagttgaacacttttctaaaaacaactaagtgagtgcttctcaaacgacacggctgagacggtgcgtctcgtccggtcggagtatgtgcaatgtatcagtctttaaaatttaaaacaaggttggcacccggccaacagcttttcaaacggacacccgggccaacaactttcaaacggccacccgggcctagctgatcccatcagccgcagatttttcaaacagcgaacccctttccataacagcaatttcacaagcagtagtcaaataaaactacgctaggaatcacctcacatccgcccatgaccgtgggcacgactgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggtgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccatacacccggtacgttccccggtccgcggttttggaaattcatttagttcgcaagcgccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacatattaagtgcgatcctattaatgcataatattttgcaagcaacataattaaatttcaagtataggctcaagatgttcaaaggtggcttgccttgctaaaggtctggagcttgatcctcgaaatcctcgcactgcgggtcttcgggctccggaactacacgcgaaacgggacaactcaacaaacggcgaaaatgaagccctaataatgacctcaaagcgtgccattagatagatctcgagatttgagaaattttggaagttgaacggagtcaaacggatttatggttgggaaggtattgaatttctaagattattggatttttggtctaaaggaaaaggatttaattaaatcctttttggaaaagaaaagaaaagagggagggaaaatagacttttctcgggcggctagggcgcggcccaagagaattggggcggtccggccgagctaaa

SEQ ID NO: 52871 - DNA, 1501 bp, Oryza sativa
atctttagagtttttattcggatgcctgtcaagtgtgttcattcgtgaacctttttgagtgttaaccactcggattccttttattatggctaaaaagcagtcggcaagaatgcctctttaggcgccgcgtatgcttttgtcgtatgatgcatgaatgtgctattattttattctcaactatatgtttagtttgttaactaatcacatagttgggggctacacctaattaggtgcatctattcgatgcaccatattctttatcttttcgccctttacagtcttcgtcttcgccactcggcaggccttggcataaaaagtttgaagcactcagattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaacaccttgagacttagtcggttacgactgtattttatctgtatctacatattccgttagggatatagattgtcttttgtaacacggactccttcccatatataaggggggtccgggtgcctctaggggcatatgttgattttctctaaatcatacaatcaataacacactcggcggattcatccccggacaggagtagggtattacttcttgaataagaaggcctgaacctgtataaatcctttgtcttcaaacccatacacttttccagcttgatagccacccccttttattattgccgaaatctagtttcgacacatagctaaacaaacacactaaaatcttttatcacaaataaaattctaaagaaacgcccagttttctcggtggtgtatttattaattacaatagaataaagtgtaatagaccacaaaaaggtagagtgcaaaccggcatatatataatgttacgaataaagttattaattacactatatatatttgtggagattatggatatcccatatctacacggcgatactatttgggctggatataggataccgaatatgtatggaatatcttatttgtatctcgggtttgtttcttaacttgtacaacaaggaaacaccttgagacttagtcggtcacggctgtatttaatctatatctgtgtattccgttagggatattgattatcttttgtaacccggactccttcccatatataaggggggtccgggcgcctctaggggcagaggttgattttccctaaatcatacaatcaataatacactcggcggattcatccccggacaggagtagggtattacttcttttataagaaggcctgaacctgtataaatccttggtctccaaacccatacactttcctagcttgatagccacccccttttattattgccgaaatctagtttcgacagttagcgcgccaggtaggggaggcgtcaagcttttcgccgatcagtgcaa

SEQ ID NO: 52872 - DNA, 439 bp, Oryza sativa
caactctgatggatgttgtcctaacaaaaatgatcagcagcatatgctgaggcctaaggccaactttagtaattcaatagaatgtcgtagaaatttcacataaatagttcaactcccacattattatggaaaaagttcctcctctaaatcagatcgtaatgaaacacacataaacactcaaagactcatttggaatgcatgtatgttacaggattttcatatgaattacttcaattcccataaaagtcctccatccaaaagagtccttatcttttttttttatttcctctttccaaaagaaccttgttatcattgacagacaaagctaaacttaaacacaaatagaacatcgacgaggacaaccaaccgggattaggaataaattaatagtatcagtccggctgtagcagcaggagaatctgatgattccgacgaggca

SEQ ID NO: 52873 - DNA, 263 bp, Oryza sativa
tactactccataacaatgtctgactaataatatatgtcaaagttgtcttcactatcgtagtgttattttaactactaacgtaatcaaatcacattttactggagtggaagggaaaagtcagcttcaaagcacacacctttcagagtcttctaaatcccttcaaattaaagccagtcccattaaactcgaaacttgtaaaactatgacaaatcatatgtcaatctgtaattttggaggcttctttcccccatttcaaacacaga

SEQ ID NO: 52874 - DNA, 1501 bp, Oryza sativa
tctacgataatgaatctctgcaggcagtcggccactggaccccgaccgagtagtaaaaagactctcgtggctgtttttttaagtagtgcatagtctatttgttaataacgtagatatataggtccgagctagcatataaacaaacacattacaactgtagtatatatggtttatttcatattgtacatgaagtaagaacataagcgtgaaatgagttctatgtgtacgtagacctgctccacgtcaaaagataccataatacagattttggaaggttatgtcttacaggatcagatcatatgctatccaaaattttcagcctctctagcaagattgcaaactaaaactcaaacatagagatttaatcgtctagtgactatccctttcttcggatgcgggttccattgacgttgtgaagagcaacattggatgagcatagcacctcatagtaaatcactacttacttactccctccgtttcgaaatgtttgacaccattaattttttagcacatgttttaccgttcgtcttattcaaaaaattttgtgaaatatgtaaaattatatgcctacataaaaatatatttagcaatgaatcaaatgatagaaaaagaattaataattacttattttttttgaataagacgaacggttaaacatgtgctaaaaagtcaacagcgtcaaacatttcgaaatggagggagtactttgttttatattataagacattttatgtattaaacagattcatgtatggatcttcatatatattttatatgaatgttagtgaatttagtccagagataaagagaccaaaagatatcatgttgtgaaacggagagagtaaatagaaacaaatgaacaattggtactgcaagtttttctcaacttgaatctcagctcaatttgccgagcaaaacttgcaaaatcaagcaggcaacacaacacacatcacgtagcaggtgataaacagaagatcacaacatgggccagaatgcgaccaggccaaactggagccccgtttatatcaggccggaatggcatggcggcccgtactacatgggccgaaactggatctcgcctaatgtgcggcccatactagttgggccgcaacggacctatgcctgacgtgtgggccaatttagttaccaggaaaaagcccattcattctgggccttctattgcctaaccaaaacttcactaggcccgaatcgaaaccaacggccacgatcttgccgtaacctccaccgccacgtgtccacctagctgtcgcggtgggccccacccatgccattcctctccattaattgggcggtcgcttcgccccttccagagtcaagactccctccctctcctccacgtcaagtccacttcgcctccctcgccgcgtctcgccggcgccggccaccgtccgccgcctccgcctccgcgccatgtcgaagtatggcaccatcccgacctcctcgtcctcggacgggccgcccccgggctcctcctcctcct

SEQ ID NO: 52875 - DNA, 1501 bp, Oryza sativa
aaggatcgtactgtagcatactatataacagagaaagcaacggtagtgtttgctttcgtggaacttaatttctctctgtaaaaaaatgcaataacagcagttttggatggaaaaacataacaccatttatttaagtaaaaaggtagagatactctgcctttataaccattatatgaatggtaagttctttttttaattaacgtaaacaggtagagagactctcgtcagtgtcattcccaatggcatttttcctttgtaacgctattttgcaacttcagagttctttgtgatagcttcattaaatttgctcatctaatatctacaggcattgtattttattttcattctgaattttagattttcgttggcatatatgctttccaagctcctaaatagtacatttcgcgtaaaagatttctatatacatttttttctttgtaatatttttataaaactcatattcaaatttataatagttaattcagtcgtttatgtcctcgaataactatagagaaactcatgaacctaacgatttcgggtatctgagatgggacctcggtggtggggatgcaaaggaagttgaagattcctttccttctcacttctcactctcaaacaagaaaaacaaaatccatcttgtctcttgccagtcaaaatcctcagaggctgagtttagctccaaaatttttcttcaaattttcaactttttcatcacatcaaaactttcctacacacataaacttccaatttttccatcacatcgttccaatttcaaccaaacttctaattttgacgtgaactaaacacaccagtaaggtttcagttcgagtgtcaacaaatggaaaaactaatccttccgtcatataatatactagcaaattcaaactagtatcaaattaaaaaacataactggacactaaatacgaaaagaaatattatagtactacgaatctagatagataagtttaactgtccacgtccaaatttgtagtggatgtttccccttatttttatattgtgatactaagggcccctttgaaatggaggattagcaaaggaattttggaggattcattttcctaaggattttttcctatagagccatttgattcattggaagaggataggaaaacttccataggattgcattcctatgatcaattccataggaaaataagcaagaggttagacctcttgtgaaactttcctttgttgagtgtatcctgtggtataatcaaagggctattctctccatttcctgtgttttcaattcctgtaggattagaaaaatatacaatttcaattcctacgtttttcatattcctgtgttttttctattctgcgttttgaagggaagggtgtttggatcctctagtcctaggactaaaaattttagtccctgtttgtctggatgtagggactaaaaaaatcattaattgtactgtacaaagaccatattacccctaaccatgcaatcggcaaggacaggaatcggaacaca

SEQ ID NO: 52876 - DNA, 1501 bp, Oryza sativa
aggtttgtatgattccactgcatacccaatagttagctgcgtgggtatcccagtgttgggtgtagtccacatgttgttgtcttagcatcaactgatacatgatgcacttcttgacaagctcggtgctcatgccagcagattgagggacaccggtgtacctggcaacctcctctgcctcttgatgcaaaagcattccaaataagattacaaaactatattcatcgcctgcggttggataagcatatatagcgacatcactcagcccagcaagcttatcccgatcctccttgcttacgttatccatgtccaagtcggtaatccgaaagctgcttcgggaggtccacaacaccgttttgttcaagattcctgttattacagggacaccacactcctgtagatcaatgtagctgccgctcccattgtggaagatcaccaggaatgtgtggtttaccaggtcgctcaagattgtctgtgtgacaagtggaaccacccctctcatgccctgatccaccccactgaaatcatcctcctcgtcgtgctggtcgaacaaggccatcagcgaccgaggaagctgcagctcctgggcgatggccttctgcagggccctcttgctctgccacaccgagcaatcaacgtggatcatcttctcccaccttcttcttcctggcgatggcgatggcctcatcgtcagtcttttggcgactgctctaaggacggctgaagcccccagtccaccccagccatggaaatacatcacattccccttgcttgtatcctccagcaattcaattaccctgcctgctgcttcatcgatgctgcctgctatgatcctggtccactgcaataattaatcattcattaataccactaattaattcaaacctgccctagaactagagagcttctcggtcggtgattccgcgatcaatacaggcaaagctgaattagctagttttaattattttcattagtatatttattccctccgtcacaatgaaacaagttcacagtgtggagattatggatatcccatatctacacggcgatgatatttggactgaatataggataccgaatatagatagaatatcttatttgtatctcgggtttgtttctcaacttgtgcatcaaggaaacaccttgagacttagtcggttacgactgtattttatctgtatctacatattccgttagggatatagattgtcttttgtaacacggactccttcccatatataaggggggtccgggtgcctctaggggcatatgttgattttctccaaatcatacaatcaataacacactcggcggattcatccccggacaggagtagggtattacttcttgaataagaaggcctgaacctgtataaatcctttgtcttcaaacccatacacttttccagcttgatagccacccccttttattattgccgaaatctagtttcgacagttggcgcgccaggtaggggccgcgtcaagcttttcgccgatcagtgcaa

SEQ ID NO: 52877 - DNA, 1501 bp, Oryza sativa
aaagaagatcgattgagattatatgatcgatgaagctgcccgcaattcaacactaattgaagagagccgggctacgcagatcaactcaacatgccaccagcgaaggaggtaattaaatcagatcggtgatattgtttttatttttgaatgaaagttatttcacgaccacgcacgtgaattaaacaagacactttactgctattttagatttccaatttggacgcaattttttgaaacacgctttcattgtcatatttggctttagaagtgtttttttttctaacatctcatttgcaaacaatcctctcggagcaaacttcttctatttgtggaagaaataaattgcaaaaaggataattttaccaaccttagaacataacatgaggtaccatattttatactataaattttggcacatcaagtattatgtatctcaatgtataaaagaaataattttagtgtaaacttttgataataacaagtaattggtcaagaaccgtaaaatttctcacactccacctgttcaaaattcaatgctatgtttggctagttgcagagagaaaaaatattgtcgaaactagatttcggcaataataaaagggggtggctatcaagctaggaaagtgtatgggtttggagaccaaggatttatacaggttcaggccttcttataaaagaagtaataccctactcctgtccggggatgaatccgccgagtgtattattgattgtatgatttagggaaaatcaacctctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagttaagaaacaaacccgagatacaaataagatattccatacatattcggtatcctatatccagcccaaatagtatcgccgtgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcactaccacgcatcagatggcaaaagcatacgcggcgcctaaagagacattctagccgactgctttttagccataacaaaaagagtccgagtggtttacactctaaaaggttcacgaatgaacacactggacaggcatccgagtataaaactctaaagatcacccaccaagtattataaaaaattatggtaatgaataagtctaatagcctaggctatgactatttaccataatgaaaataggtatataacataccaaggaagtg

SEQ ID NO: 52878 - DNA, 1501 bp, Oryza sativa
acgggctcctccctaggcacaggggtcgcggccctctgctaggagacagctccagccgaaaaagtggacgccgtgagtagggatactccagggcacccattgctgatgctctaaagctcaactcccaaagaaaaacttgcttacaaatcatggcagtgacaccgtcggtactctgtccaagaccgttagaaaccgttaatgaaggatttattgtactactactccgtagtattctactactactgtatcgccagcgtttagatgaagattcaagtaatgtaggagtacactggaaagaatcgtactcgtgtagcttcatcggggaactggccgataaatgctcgcgaaggggataacatgccgtggtggaccggcgactagtggatatgcaagcaaattccgtgtttagttaaggtggtgtttggatacagtgacttaactttagtccctctatttagacactaatttagagtattaaatatagactacttataaaactaattacataaatgaaagctaattcacgtgacaaattttttaagcctaattaatccataattagagaatgtttactgtagcatcacataggctaatcatgtattaattaggctcaatagattcgtatcgcgaattagtccaagattatggataggttttattaatagtctacgtttaatatttataattaatttccaaacatccgatgtgatagggacttaaaagttttagtcccatctaaacagggtctaagtctcaacttctaacttttcatcacatctaaaatttttctacacacataaactcccaacttttttttccaaactatcaactttcctcaaacttttaacttttttttaggaactaaacacaatcttaagctggaattcactctgggtgaactgatgaatggacaggctcaggtactagtactggaggttaagaatatcgaattccgtggtgaaacaaagactttgctcatgattttcaaaaatcaaattatggactcctcctagtttcttttgtcctgatggtcccacatccagccttacttaacctttaaagacagaggcacctgctgccaagctgccttttgcacctgcaggagctttggatataaaaaaaaaggagcaaaaggagagaattctccaactaggctccagtaagtgccacctagtaatccatcattaaagcaatcaagcctcctcctctccctaatcccatttcacaccctcaataacaccacatccagctgcttaagctaacaaatcttccattataattcaagattcccatcacctgcccagtccatttctcctctactactagtaatactcttctctcttctcacagggagtgtgtgtgcctccatgacagtgctcgctctccctgagccgagagagtaaaggctctctccttcacacacctaccgcctactctcccactcttcttcccaccccactcgtgtgcgcgccactgccgccggcgatggcgccaatgccgg

SEQ ID NO: 52879 - DNA, 1501 bp, Oryza sativa
tggcggtccggcgagtgatgatagcctcgagctgctcggcgctgtatgattgtgtcgcgaagatcgatggggcggcgacgaggtggtgagcgaggtcgttccactcggcactctctatgatgatcgggaggcgagtgaacggaccgctcgtcgtgacccctgctcctgcgattggatcctgcgccggtgatgctgaggcttggatgacggtagtcatgagatcagaagtgggggactcggctgccagtcggcgtgtggacgctttcggagttaactgggaccgaagccgcaatcatggtcttcgtctggttcaagatgttgacaacgtgatcagattgattgagctcgttttccctgaggagggtgtcgaggagggtgatcgcggcaaccgcattctgttggggggtgcggaaaaccggtgtcccttcaacatcttgttggccgatgagatcacgcgctcggcgccctgcttctaaagctcgctgccgtcgatcctcagcctccttcgcggtccgctcacgctcctgctgctcacgccgtagccgttcttgttcttgtgcttgatgctcctcctccagtcggcgacgctcagtctcgtgacgcgcttcgttctcccgggcttggcgttgctcctccgtctcgttattggccatgaagacgccgaagtagagaggagtgtagttgtcatctaggcttccgtcgaagtcgtcgagatccgggtcgttgtagcgagaggtaaactcgtcgtactccacgatgtcggtggggcgcgagtggacggtgggagagctgtagtggccgtccagctgatccgtcgaaaccgtgccgagtggttggaggatgacgccgacttccctgaagctaggcgaaatcggtgttgaagccgacttccgcctaggcctacgggatggagatgctgtcgtgatggagacggccgccaaatcgtcggggagcttcatcaggatcggtgggtaagccccctcgtcttgatctggtgaggttggtgaagatgcgatctcgcccgagtggtttgaagccgactcgattgagatggtcttgaagtaactttcagccgcgtttgggagtccaaacggggccgaaatctggttctctcccgactggtccgactccgagtcaaggagagagatcttgccgaagttgttggtgacgaagtcgaggctgccgaaccgaaacgtctgcccgggtgggaagacgaggtcgtcgatgccggagacaggacccattgcactgatcggcgaaaagcttgacgcggcccctacctggcgcgccaactgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttggagaaaatcaacatatgcccctagaggcacccggacc

SEQ ID NO: 52880 - DNA, 529 bp, Oryza sativa
ggggggtcttgagaccccactaccgccccagggtccatggagacccccctaagcccccactaaaatttttcacgagatgtggtggctggagcttcgtcaggttggctggagggaaggctggaggttgaagacgatgttatttcgtgatttgggcttgtttcgaagagcagcccacgaccacgagcgcagtcttcaagttttgtctagcccactccaagcaaaggcccacggtggcagattccagtcggcccatttggctactccccctcccggcctcccgcctccccaattccccaatcccactggccacctcctcctctcctaaatccctaaccctaggcgaataggcgcaggcggcgggcggcggccgagcaggcggtggcgtccggcgaggggccagacgggaggcgtgccaggcggtgccccggtggtccagtgcatgcccggagcaggtggcgacctccggtgagctgcaagctggcgagcgccgagcggcaaggtgccgtggcggcgtccagtgagccggcga

SEQ ID NO: 52881 - DNA, 1501 bp, Oryza sativa; identical to SEQ ID NO: 52876

SEQ ID NO: 52882 - DNA, 1501 bp, Oryza sativa
cgtggagagtttaataaaaattaaatccagctatagtttatttggaaaattttattttccacatttaccttgatttttacgagccttttttcttcaacatcgtatacatgtatacatgtatagttgcgattttatattttaattaattacataatataaatatttcttaaccttttcttaaatttctcatgttttttcctattgcagcgcacgggcatttttctagttcaaatattaagtataagagataatcccttatatgccactgaaaattggtctaatcccttatatgccactgaaaattgactcttcccttatatgccatttgtaacaccctgaaaattcgacaaataaaacgaaactcaaaattgagtactttcaaaaacttttaaataaatttgcatcatgccgatgttgttggttcttttgttgtgcatcatgatggatgttacggtcattattgcttgccaaactataaaatgtcgcaaatgaaaattaagctaaagctatacaactaagtaatagttataaaattatgatatttattatgaaccctacatataatggagtgtttcactggaataattaagttgatatttataacttgcattgaggctctcatggaataaaatttactcgcataaaataattagtcatgtaaataaattgagttctatatataaaaagggcttatatgagtactcgattcaatatttagaccgatattgcaccaagtctcacagtgccttcatggagtaagaattaattaaatagattaaacttatctatatgcaatactttgccatacaaataaactcgaccaatgtgctaatgtattattaaaggtcacattggaatatttaattaatttttaaggaatatcaaagcctagaagttatattggataatttttggataatataatggaaagcaaattcatttgggaactaatgaataacaaaataaatattcaaatcaaacatttgaattctcaaatacaaaatatatagagctacatttcattcaaattcctatccaagtcacttttacagattagcccccttactctcttcctttatcttctccttccttttcttttgctactgttcatgggccaccaggtggtcgaccagagacctagcccgaccgagccgccgaatccacgcgcaaaagctgagccgccacgaacgcgccgtcgccatcgcgcgtcacccctagccctagccaactactaccttagctcccatgtgcacgcatcgccatggccacgtccgccaccatgcggatgccggcgggtaagaacggagccttcctctccagctagggccggctagaacacacagtatagacagaaccttaatggagaaggaatctagacagccattgagtgcaccagctgccgatcctatcctccacgccatcctggcctatccccaagccaagcccccataaaaacttcatccctatctgccttttcctcgaatacatttcatcgaacacc

SEQ ID NO: 52883 - DNA, 1501 bp, Oryza sativa
gcggcgacgacgacgaagacgacgccatggttattcggggggcgagtttgtaggatctgcagatcgaaagaacgaacgaacagaagaaaaacgaaaacaaaacgctcttagttggggatcgaactagaactctcagggcaatgcgaacagaaggaatccaagactgctttgcaacacaaggcacaagcaaaaaagatgcaggattcgatggatggattacctttggcgcaaagagagatgggggcgccgggtggggaggcaagcaataagtagtagggtcgccattaggaggaacgcccccacaccgtatttaaaatgctcgcgaacggcagcatcaccaagctagccgaaatcctccgccttcgccttcgcatctggagttctggacagagtccgaaatataggttaacacgtggaaggcaacggattgctcgctgagtcatgctactcctagaaacggaacgaacaaaatcggcgcggctgtaaaactgtgtgctgcaagggtctgaaaagctactttcagtgctgcagttggtaggaacaacaacaacagagtactgcacgtatcttatgaccatggaaatgagtgggattaatgaccgtgattagagtgtgatccctgaagccagcgagagagtgctagctatctcctggtggttaggttttgagttttgacaatttgcaacatgccacgggccacacagcaacgtgacctcgcgtgacatcgtgatcggagagtgctagacgcgatcttctcttgtactaggactgcttattttttgcactactggcgtgtgcacgatggattgaatgctcacattgccctgctaacggatctggcgcgtgcgacgcatgaagagctggatttttcacaatttagtccttttaaaaaatcttatttcataaataaacccatgaaaaaacttatccgaaaaataatcctttttaagacgccagaatacgacggcgccagtcctcctgccaccgtggcggggcagcgctgaggtggggggagcgcgccaatgtggttggcgcccctccctccccccattttttcctctctctagtgtagaggagagatatgtacaacttattattattattattttcacacttagaagcacacaataaccaaccatacaaaaattaaactcaaatagatgaaatatgtgacttataaaattttctaaagctataccgaaaagaccccccctcccccgcgttctccctgcttttcgttgttttggtttttcctgtagtccccaaagaaagtagattaaatttcgaacactcttagacttttttacatttttcacatcctataaacaataaaaaaagttagggttcgtgtttctttttgttacattcgggtgtcatttcttgaaacagtcgtaactttctcatacggacttggaatcaggcaaataatatatccacggatatcttaaaaaaaaagttacatccgattctcccccgctttgctgggttcgaggaaattaaa

SEQ ID NO: 52884 - DNA, 1501 bp, Oryza sativa; identical to SEQ ID NO: 52879

SEQ ID NO: 52885 - DNA, 1501 bp, Oryza sativa; identical to SEQ ID NO: 52825

SEQ ID NO: 52886 - DNA, 1501 bp, Oryza sativa
cttttgacttataaactttgtgtctataaactttagatgtatagaaatactatatatagaaaatatttgaattcaaattcaattttgaatcggatataattcaaatttgaatcgggtatataaactttagatgtatagaaatactatatatgaaaaatatttgaattcaaattcaaatttgaatcggatataattcaaattcaaatttgaatcggatatataaactttaggtgtatagaaatactatatataaaaaaacaattgaatttaaattcaaatttgaatcggatatataaacttttggtctgaggtgtataaactttagttgtataaatgtaataaaataggaaaataacgcggtgtcaaaaaaagtaaggtagagggagggggaggcctacccgatcgctctgggctagcatttccggtactacagtgcatttctcgtttccctgtacagctcattcttccattcagtaaggtggtgacaggcaatactgggccacaatcatcctcgggccttcactaaatcctcctacatgtacacaaatatgagtttgtttttgtacatccctgtaccaccaatgattcggtgaacccgtgccccatgcgttgtttctgtaccacgcgagaaaccgatgttggctcagctactcacctctctctttctcacttttgatgaaagtgtgaaacacacacaaagagatgatgaactgacggagaatgaaaatgaacacttgtatttcacgctgcaaaccagcgcgcacaacataaacacttgggggctgttcactttgatgaaaaaaaaaccttattaaattttggtattattaaaattttggtatagttgccaaaattttcgcaacttaccaaaattttggtatgatttcttatatagttgtcaaattttggcaacaaactaaatatagcaactttttgataattttatcaaaatttggtaagattgaaaataacatcacagtgaacaggctcttgtatttcacttttggcaccacaccacatacaccaccactccgtcctgttcggctgcacgacccggccaagacggtctgcaaccatgtcttcaccctcatgcgaggcaaatattactgcatgaagagctccactaactgacgcgcatacaggcaagattttctccaattaatcctgcttgactgctcttatctgatgaccacgcacaacacctgctagttgatccactcttcacgccatgcatccgtgcttcacttggccacagtgtcaagccaacgtgcacctacgggctgccggcatgcactctaatcaaactaacttatgcacacacgtacactacggaataactcacacagtaaacaacaagattaagtctaacaaccgaaacagaaagaacacgcccatatatcccacgccgcccaccgaaactcggacacccactccgccaccgccaccgcctcatccatggcactggctggctccatggccgccgccgccgccacctccaccc

SEQ ID NO: 52887 - DNA, 1501 bp, Oryza sativa
attttgaaaaatgaagtggcagattgacttcagcttgcagctgacagaaaattctcagatcctcggcgacccaaagggattgcatgcgttgtctgtgtcaccagatggagctcgaggagggaggagagtgcgaggagcaggagacggctcaatgaagtcttcttcttttttcttttttcggttagtctctcgatctcgtggtgaacttgtgatcgtcttgatcagatcagacgagatgagatgcaacatatctctgcagtatgtgttacactgtcatcttttcatgtaaatgaaatcctgaaaccaaaccagcaatgttgaaggtggtgtattgatcttggattgagggagttttatctgaagactgaagtggtctggtaatcaatcctttttttccgaacccgaccgggtctctaccaaccgttcgatcaaagctgcgcggtgcagattgagtgtctcaaaacgtcagcagtttaaaactccgaaccccgttgcatctctaccaacccttcgatcatgtcgttcgaaggcataatatccattcgatcaactgctccttgagaattctcagcgacttgcaatttccatgcaactactactaagcaaaactgtcaacaattagcttgtatgtagatatagattggctgctcaaatcttttcgcgattagagctgttattattgcgtgacgaggcatattctagacctttttggacgatgcaatttctgttactatggttgtgggccttacaagcccactttagtcaactaggcccaggttgttattagtttgggcccactaggcccaaccaccatctcttccgtataaatcggggaagcctatcggttagttaggagttgagttgaccaacttaactacctttcgccgagctcgcggagagaagaagggattccagtggagcacgcgatttcccatctgctcgatcccctcctcctcctagggtttcctgctcctccgcccgcctcgccttgctgctgccgttgttggttggtaatctctctcctcctccatcgtccccttccccagattcgtcgtgctcagtttggtgacgatctgtcgtcaccaccgggagggaaaatccccactgttttagtgaacttgttgggtcttggctggtggtggtggggtgatgctggtaggggagtgggctaggaggaatagatcggccgatgcgatggattgggagttcgatctaactccattccctcccaattcgggctaggagaagaggtgtcgtcctgattgagagggattgttaagattgcgtgcgtcagtagatgaagcgaatgggaggacgcaaggggacttttgaaaaattaaatatgttgttttagtcttttgaattgtgatagcttcgcttgcctggatcgagatgtgtcattgtcgtgcgaagaaattaaattactcgatgccatgctgttaaaactccatttttgtgttactgattttgtctgatctcaaattggcatatgcaggtgcga

SEQ ID NO: 52888 - DNA, 1501 bp, Oryza sativa
caaattcaggtatacaaaaagaagtccattaaattcaaattatttttttagaaaaaaaattcatagaaagagtttaactggattctaacaaatgtgagtctttcattttaaacaggtctagcattcctagagaagaattacaacacaactcaatcatataaaatgcaagaaaacagagacaacataaaatcaggtaattaatgaatatgttacaagcactcaatcatattttcatcaaaattgtaaatgttatacaactatggattgacaacaattttttttaaaaaaacagggaacaaggggcacttgtcagatataggaagtaagattgagaagaagaacacaacaaatcagacatgtaaatataaataaatgtataaaattgtttgacaactttcatactgcattaattattttgtgaaacaaatttaatagtttatatgattgaaaacaggtttagcattgcttgaggagaattacaatacaacactatcttatagagtgcaagaaaacatggacattacaaaaacaggtaagggaaaaattatgaagcaaattgcaggtatgagtaatagtaaaacaaaaaaaaatagatattttcctcatatttattttcaggtaacagtaaagacttctcagaaacagaagctaaacttgacaagaccaaaaattcagaagcagacattggatgtagtgctttgaatgaatcagagaaaagtaaaaaatttgcagtaatatttatattatttttaagagaatttttttgattaattaaaagttacactaacctataatactggtatcaaatattgcaggtattatagaaaacaatgacaaaggaactataagttgtatgaatatgcaagaaattaattcaggtaacaagttgaaaaaattcaatcatatttctttcatattcaatcatatttgtatgaatatgcaagaaattaattcaggtaacaagaattgtagaatagcactatttctttcatataatttcttttatgattagaattttcaaaatttctgcagaaaatggagctaacaatgcaaaggttgattatgaaaacaatgttctatctctgttggaccaagactacattgcagtaagtatttttactttgacaaccttaagtttgatataatttcttttattttctttgacaatcaagactacattgattttttgttttttttatcaaataggattcatttatatcatacactagtctaatggaacatattatttcatcacaaccaaaacgttgcaatgaattgaaggtaaatttttttttgaaaacaaaagtactgatttgttgttcatttatgtatttatgtgttcaattaagtatattttttgaaaatctttcaaaaactgtttaattaaggttgaaggaacaaaaaaatgatacaatagagactggaattggacaagattatcaaaaggttgacgaaagtttgaattcacacgttgaatatcaatcagaacaaagatgcttga

SEQ ID NO: 52889 - DNA, 1501 bp, Oryza sativa
agcgagataaaattgatggacgcttgggtcggataagatccatcgatatttttccatctcctacacatcatttgtttcctcatctaatccctgcactttttgtatgcaattatcattatcagactttttttaataacatattatatgaaaatagtattaaaaataaacatatttttaattgttatttagagaagagtgcacggtgactattttgtgtagacttgatcctgagtgtaggatttgattaacctattattggttgcaagaataatattgaaagaatatttttttattatatgtatattgttatatgaataatccaattattttagttaaagcaagcattggtaaaaagattgccatcatcgagtttgggtcattacataaagatgctctaattttctaattgtgttagctacaacgatccatagaaacattatcattgatatgggtacgcttgaaaaatgtctattgtcattggattattttttttacccgttgcaacgcacgggcatttttgctagttattataagatgataaaacatgaatagtactttatatgtgacttatgtttttattttttttaaaaaaaaattaaataagacggacggttaaaattgtgcacggaaaatcatggctgcacttggaatcatagtaaaaaaaccagaccggcccaacggttcaaccggaaaaccggaaccagtgcatgtcacggttcggtttacagaaaagacagtcaatatatttgaaccggtacaaaaccgtcgaaccagcaggttttctgttgaaccggcttaaaaccggagcggttggaccgaaaaccgtgctagctgcatggaaaattttaaattttacattgaaccggtaaaaaacatcgaaccagaaggttttctgttgaaccggcttaaaaccggagcggttggaccgaaaaccgtgctagacatgacttaaataccggttcatggctaattattttttacttcataattgactttaaactgctaaatagaataggtatttcattcaaaccaacaaatatctctggcacagttggtttggtgggaaagttcaatgaatgcagcgccacaagcatatgaaagtcaattatgacttaaaaaataattagccatgaaccggggaaccggcggtctgaccggtgaaccaacgagctcaccgggtcggtccccgctccggttttttccgaatgggacggagtactgacatatggatccgagaaaaatgccggcctagtcccaccgtcatactcatcgggggctcgcccgtctccgcagagatcgccccacacctgagaaagtgagaagttgaatcccttcgccgccgccgccgccgccgccgtcatgtgcggctccgccgcccgagccctgaactccgtctcccgcgcggccttctcctggaaaccagtgagtaagatggtttgcaaaacacttctctgaatctccgatactgactaatccccctttctctaccagacagggttgc

SEQ ID NO: 52890 - DNA, 1501 bp, Oryza sativa
actgcaaatgcgagggggagaggagaggagaggggagaggcggttggggggttggtttttagcgagaggagcagctgcagcttcagctccagcggcagcagcaacagaagcgcggagagagagtgtgtgtgggagtggggcgtattatacgtcgacgtcggcagtaggaatacgtatacgtgtatacgtactctaatttatttcgtgtaatttcttccgtcctaaatgtaggagtattatatttcacgtttagagtaagatttttttttccaaaacgcaataaagatatgaacacgtctctaggcatacgcacgtacatcatagtagaatgagcatatctgtatgactgtaacgatacatttcgatatcgacggagtcatccgaataaatacctcccagagattatgctggaatatttttaatattaacaaagtcaccatgtacatacaaccgctcacatttagtatatcgcataacacttgaaaacaatttgccatgaatacaataacttatggacctatgtttaacctctgtaactgattccaaaaaaaaaaagctagtaactacccaggtcacgattatatcaagattttaaaactatgactaagtttataaaatgtaatggttctataacattgtgatattaccttttatgcatatgatttttttataaattattagtggataagttttaaaatttaaactaaatcatatctaaaacgttaattaaatacggagtgtttgtaaacagggatagtatagcaggtgggagaattgctcggttgctttttgactttatacggcttgggcgtccaatgtacgtactcctttgctgctactcgtactaatcgtatcaggttttcactggtgaaagtgattgattccactgctttgcaatattgaaaacgaatcacagttcacagccacatggtttttttctcgattatcgatgattacacgtttccatgatttacttggtaacaacatcaaacatggacggtgcctacgaatgtgatgtttgcctgaaaataggtggcaaagtctgggtatttcacatttgttgttgaaaatactttaatccgaaatggagtaatgttcaacatttttcttaaattaaaggctttcgtccagctttttactgaaaacataggagttcgatatactggtaaaatgtgaaaattacgcaattgaggctgtgtaagataaatctacattagtgtcctatttggaatcatgatgatttcataactaaaatgtctcaaaaaattttaccagttcagttattttctatgtagaaaaattaggaattttccatccacaaaggtagggcatacaagtggatcccatgataccttaatttctctagtattacatgacagggcatggttgctaggttactctctaagatatagaaaaatggtgcaagttggattattcaacagctaatccacctgaaaatgatgaggaaagcaggcacatgcatgtgcaatggagtgactac

SEQ ID NO: 52891 - DNA, 1501 bp, Oryza sativa
tgttttccaatgtttcttaaaggacactatgcttcatccaaaaaaggacactgtgcttaaacaaaaacatttcaatgtacaagttcggtggagacagccacaaggccacaagacaggcgtggcgctcagcattgaagaagttcatgcaccaacgttctaaaattttatatgatcagacttctactacatgattgcctagattttaaattcggtccctaattccaatttgagctaaattaagtcacgggcatatgcatgggcacacacctccatcttttattgttcttttccacacttgctttccaagccaagccaattccgttcggttcatctctttggcctcgtcgctttccaaggcagccatgcttaacctaactaagaacctccagaacgttgctgatgagaaaaaaaaaacattattactccaccgcgctcacgccaaagagatgatccaagctttgatcattcactgtagcctgcaggtcactatctgaatctctgaatttcgtaagatccactatagttaattcggtagttgaacttcggtcgaagtgggattaagcgcttcttaattattttgggccccaaagtttctctcagactctgacggctgaaaagattattacactgtcgatcgagaattcgagattgtagcgaattgacaacctgatgaagggatcgatcgatagtgaggtgtgcaatggacacaggaatggcgggccgtcggtttgttgagatggcctctctcccgtcggatactgtcggtagtagctttttgccgtgttctccgtcgccgtaagatggtgtcgtccatgtgaatgaacactgaagaatgaagatctgaagtgaccgtgtagcggttagcagtctgcagcaaacaaactgatcgtgatcggaaactgagggaggtgatgcataaatcaattcaaaatgtaaccgcgtgattttagatctcaggttggaatctgtaaatagatggatgaacagagtatctgtagtctgtacacgtataaatggcttcaggcatggaggagaggagcgatggccgatgggactcacgccgcgcggcacacggattgtggcgatgggctgagcaaagagtcacggggccccgcttcccaggtgggtcccgctctttggccgggtgggccacccacccaacgaccgtttcacgcatggcgcaccaaaacaaaaaccacacgcgtcccgtcgaacggcatacggggaggagaaaatacacgccgcggcctcgtcgtgtggacgccgaccaccggaggcgcccgtgcgtgggtcgggaccacggtacaccgagtccagcaacgttagcgaggcgcaaaaacaaagggctcccatataacgcaagctgcaagcacgcagccacgctcccattccgcctctcctccacctcgccaccaccaccctccactccctcgtcgtgacaggccggacccaccgccgacgatggacgccaccggaccaccgccgccgccgaccgcagtag

SEQ ID NO: 52892 - DNA, 1501 bp, Oryza sativa
caagatatgcccataccggacacgactattatctctaacaaactctaagataccataagtctttgcggcagacttttacccatatttatctctaaggaatttacataaaatatcttaattaatagatacaattaatcgccttcccaggactctatccatgtatggcaatcatcttgaagtacgtcaactcaaacccgatatcggatacaagttgtattgtcggaatcggttgtatcacttaacccagtctgactcggacttagccgatccaaacctcagccgattcttactctgtttccgcgataattctcatgtttgattccgcttcaatccaatcttctttccgatgcagatattaccaaatttgattgttaacatacgtacagagtagtcgcgcgccgggggagccgtgcgactagtcgcgcattaccccccctcacccccccccccccccgccatagagggggctaactacatatgtgtaggcatggtggatagccacgtcggctgtcgaacacaatcagacgtgcactggacctactataatacattaaaaagtatctaaatattgtatttacaatattctggacctaaatgtgacctcgctttaaacatttaggaccatgcatgtacttgttagcaactttttctctaattctaataacaatgaaaatcacatatatttggtgtacctgaagaggaaaatagtttaggatacaaggctagaagatacggcgagtttgtagaacaagtagggaagatgagatgtagggaagaagatcgacgaggagctgaaccggcctcaaagttatcgtcgtagtcattctggcgttctattttttcgatgccctaccaagcgcaactccctccgtccttaaaaaacaaacttaggatgagatgcgatatattctaaactaaaatccggattataaaaaatccgaacagtacaaattcatagtactacattcgttttttagtatatgaccccgttcttttttttgacaaatgtttaaacattcatctttattttttaatatatgaccccgttatatttttgacaaacgtttaaacattcatcttatttggattcttttgtacaaatataaaaagagtaagtcatacttagagaacatttgacaaaaaatttaatcacaataaaataatgataattacataagtttttgaataagacgaattggtcaaacatatgtaaaaaatcaacggcgtcatatattaaaaaacggatgaactattatgatgtgtcttaacttgtcttaggtttgtttttatgggaaattaagagtttgtatttgttgttcagtgtgcttgcatgggcttcacttgacatgtggccatcccatgccatctgcggcccaattcagtttctaacactgatttgacttttttttgtattttttaatttgatagcctatgtttagatttaagaaaaagtagaaaaaatatgaattaccccctgaactatcgcgatcgaccgaattac

SEQ ID NO: 52893 - DNA, 700 bp, Oryza sativa
tcgaacccgagggaggccaaatagacttttgcggagggattgatttgggaaggattgggattcgggattgaactcggcgatagatcggggatttgagatctgagatggcacggacactagacagcaagcaaagaaacatatttcgcaaatagagtttttaagagatagttttcccgctaggcaccacgacggaacgggcgctacaagccgccattagcaatggtggcgctgaagaaattgggtggcggcgagggtgatgcttgattcgtggtggctgcggcatgatcatggtggtgtgagctcgccagaattgctggcttgggatgtggaaaaagagggaggaggatgaatgcttcactaacatatgggacccactgccattatttttttctatctacaatgccacctaagcgcatataggacaaaaacgtttacaaaaccacttaaggagttgatttgtatcggttttcggaaatgggaggcattataccccgttttgctagtgagggatgcgattcgaccaatggctagacaggagggagaaaacataaacttattccaccaacaaatacaatgaccaactgtagtgaaaattgggctaaaaggcctatagaacacctcgtgattatcatttgggctaaaaggcctaaaattgggctacatggcctaaatagctcagatctagaatacgcgtcgcagc

SEQ ID NO: 52894 - DNA, 1501 bp, Oryza sativa
atgggaaataagtgtttaatgcaggcttcaacgaaaggctgttgtttttgcaattgattttatttgaactcttttctgaaaacaactaagtgagtgcttctcaaacgacacggatgagacagtgcgtctcgtccggtcggagtatgtgcaatgtatcagtctttaaaattgttcaagattggcacccggccaacaactttcaaacggccacccgggccaacaactttcaaacggccacccgggcctagctgatcccatcagctgcagattttccaaacattgaacccctttccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgagaaaccgtacacccggtacgatccccggtccgcggttttggaaattcatttagttcgcaagcaccgacccaggtgtcgggttttccaagtcttttgtaaaacccaagttttacccaagttgtttttcagattttaagtttgaaggcgaccgtcgatactcgtgcagagtgcacgatttccgaggcgcaactgggtggttacaagtgaatatggtataacaattgacaaaggaaggatcaaatgcaacaaactaggtaggtccgccaatctgccttgcagacgggacaaacagattaagtgcgatcctatcaatgcataatatttttcaagcaacataattaagttcaaatataggctcaagatgttcaaaggtggcttgccttgctcgagatcttgagcttgatcatcgaaatcctcgcactgcgggtcttcgggctccgaaactacacgcaaaacgggacgactcaacaaacggcgaaaataaagtcctattaatgacctctaagcgtgccattagatagatctcgagatttgaggaattttggaagttgaacggagtcaaacggacttacggttgggaagatattgaatttataagattattggatttttggtctaaaggaaaaatgatttaattaaacccttttggaaaaagaaaaggtagagggaggggaagtagacttccctcgggcggctagggcgcggcccgagagaaaaggggcggctcggccgagctaaa

SEQ ID NO: 52895 - DNA, 1501 bp, Oryza sativa
ccgggctaacgacatctttttattttctttttttttcactcggatagaaaaccaaactgcccatattaactatgctctacttacgttgtaaaaatataggcacatatatgtcatcgaaacaccaatgagaagaaaaaattaattaaagtatatattatgtaatagttaaattagacttgcattttttaaaataaaaacaattctaattgtgactagcaattctcaaaagttacctactccttataaaaaataatgatatgtcaaactgatatcactaaatttatcatgaatgtgttttctctattcgtataatatttaaatatcaaagattgtatatattcttttcacaccatactgatctactttatcttctacttatgcttcatttgatctagctggatggctgtagctggatggctgagcttattcaggatacatgaaacgacacatatcattagtgcaagattaattaaatattgaatataataaagccaaaatagatttatttaatttttaaacttttatataaaatatattttaattatacacaagttgcttttaaatatatacgatgtaggttatggttgtcaatttaattatagtgcataaaatggttcagatggatttagatattattatcaaaagatatgtcttttgtaataattcctatatcaatgggtagataactgggaaaacaaggagcaaccaatctgataagtactctagaacttattgcttatttactaaaatgtttaatgtgtagtatataatatactttatgaataaaaaaatatcctaatatataatcatatgccaccacttatccataagtatataaattctatcaactaatcgtcaagtcatattgcttacgaggtattcattcatagtgcacctaataattagctaccatccaacgagcacttatgtcatgaagcaccatatataacggactatgctaagtggagaactatcaacaaatgataggtaaagtaaagcatgccaccaagccacagcaaataataatcgattacaagtatattgtcagtataagcaatagaattctacacttctacaagaacccttaatatatcacgtaatagatctcataaattagaaaaaaagtataaggaaaaatataaaaaagaaaatatctggtcatcaatttacacttcaactggtagatccattattttcaaccattatattggatatattcgagctaaaaaccaactaatctctccctatgtacgtacctatacaagagatgtcaaaaaggaaaaaaaaaagaagaatgtatatatgatctgctccgtctggttgtttttttgtttctttctttgcagcactaaagttttcctcaaattatgcatatatatagtgaaactctttacgatgttatcgaaaaagtcatgccaccgtggcatcgcttcatgccatcccacaaaacttttttaaaatatttttttaactaatgatctaaaacgaaatcatagacact

SEQ ID NO: 52896 - DNA, 1501 bp, Oryza sativa
acctgcaatatttgataccagtattataggttagtgtaacttttaattaatcaaaaaaattctcttaaaaataatataaatattactgcaaattttttacttttctctgattcattcaaagcactacatccaatgtctgcttctgaatttttggtcttgtcaagtttagcttctgtttctgagaagtctttactgttacctgaaaataaatatgaggaaaatatctatttttttttgttttactattactcatacctgcaatttgcttcataatttttcccttacctgtttttgtaatgtccatgttttcttgcactctataagatagtgttgtattgtaattctcctcaagcaatgctaaacctgttttcaatcatataaactattaaatttgtttcacaaaataattaatgcagtatgaaagttgtcaaacaattttatacatttatttatatttacatgtctgatttgttgtgttcttcttctcaatcttacttcctatatctgacaagtgccccttgttccctgtttttttaaaaaaaattgttgtcaatccatagttgtataacatttacaattttgatgaaaatatgattgagtgcttgtaacatattcattaattacctgattttatgttgtctctgttttcttgcattttatatgattgagttgtgttgtaattcttctctaggaatgctagacctgtttaaaatgaaagactcacatttgttagaatccagttaaactctttctatgaattttttttctaaaaaaataatttgaatttaatggacttctttttgtatacctgaatttgactgaaccaaagcagtacaagttccatcttcgaaaattcctgcaaaagattataaaacaaattacaagcataattttttacttttaattattcttctaattattcttataattacctggtaattgcttcattgtcttaaatctctgtgcttttttgtcggtatctgtttcaaaacctttcgaaaccaaaattttttattttttgatcaagattagtgaaaaaaaagtacttaatatgaaatttacatagcaatacacttacctctcgatgtctttacttcttgtaattgcttttcatcagccttctttagatcatttgatattttcaaaatcttctcttctgttcctgaagatagaagcattcctcttcatgaatttttttttttggccagatgatgataaatattttttttgattaagcaaatcaattttctgtacgtcatcaggcaagaaaattaatcatgctaagttaaaagaatgattaaaattcttgtcctgatgatgtgcagagaattgaggtgtttttttacttatctgatggccacatttgtttttatgtcttttttttcatttttctaaatgaatcttttgtggttcaagtaatattagtatgaagttttggacttcttttgcaaacctgattttgaattaacagaatcagtactagttccagcttcaatttttc

SEQ ID NO: 52897 - DNA, 1501 bp, Oryza sativa
cactttgaatttttgaccctccctttctttactttctgctatgtgctattgctccattccatgtaaggctgctattattattcccctcttgagagagaatgaccattctagcccatgctgttcatcttgatggtgttggatgaatcaagggcagtttggtattcctgcaattttttacatttgttgtgtgaatgggttcctgctgtgtttgccggattcctgctgccaaaggccattgggggtccttgtggttgtggctgtgggcaactaggtgcactgttacctctgcctgaggttacaggtgtgagaagaaatgtagtgcacattactttcctttcatctttcttggtctgtaaaaatttcaaattagtgggatcctatgccattttattaagtactggctttgctactccatagctttccaaactgttgtttgtttcttctaaaaaaatgcctatgctaataacctgtaccttttgatacggtaacagtacaatttcaccactgtactttgctttttcttgcatttaaagtttgcaatttgcaagtgaaatgtcaaccagataatcttgtgttggcgtacatgtttgagttgtaattaacttgcaactttgtttttttattacttacctcatgagttctttcttctttctttcttgcagaagtaaggtgagctcagaaggatttggtaagggatctcattatgcagacttcaaaaaccaggttagtttttttgtcctagaactttcatgtatcttgcctcttgctcttgttttcgcagcaggtatgcagttctgctcatgcatgtgcgtgtctgagacagtggttacaccatgaccagacagtactaagtagtatccaaggttgtgtgtattaaaatggatctgatgtagggggggccattgcagattgaattttccatgaattgttacttgccaaatataccataaatcttacaatgcactagtgtacttgatctttgctaagtattaggccttttcttttggaagatcattttttttcatcggtagcaacttagaacagtcaaaatgagaacattcctgtgcttatttactagtattaccttgcatgttgctggatcttgtacacaaccaagtgaaggttgcctactggtgaaatagtttttggatgtactactcttgattagtcttgtgtaagccaactgttttctcagattattgtactgctcctgttatcaatctcttcatcatctggcatgtgaactaatagatctgtatctaaaaaaatccgcactaatagatggtatttgaaaacattgtcttcaaagttggtatatcagtacactcggttgttcaacaacttcatgcttagtgtactgtttgcggttaattacagtacttacaatcattaaacttctgtttccctcaatacctctattgttgtttttttttttgcggggaatacctctattgttgttgttagtctgttgatcttcaagacaattagataacatgttttt

SEQ ID NO: 52898 - DNA, 1501 bp, Oryza sativa
tttaaattcaagttaggcagtgaacattttctttgtgaagtggtctatatcactacattttatgttatttgtttgtagactctttcatatataacaattcacattatattcaagagccaaaagtcttgcaaaaaattaatgtttaggacaaggtttgattaaacatttgaacttcgacaatcagttttatatttgaaaatgattgtaaaatctttttcacgaacgcgcaaaagaattgcacgtcaatatattagagcgaaattttttttatacacaacataatcagccagaccggtttatgctaggggaaggaagaaaaagcaaaacaaaaaagtagctaggaaggaaaaaaaatactacggcggctaatgagttataatattatgatggtaattttcagtgttccatttatgtttttaaatctagcatttgagaaactactggtggtcaaagttgaaatttttgattaaatcttgttctaaatatcaaatacttgtaggggtaagtttggatcttcaggtgtcatataacagcagcaaaggtcaagctctgcctcgtagaggcgatggacatggagcagagctggcatgacggcgctgctgtagccgcagcaaccatctttggatttccagcaatacacacagagccacggagtagcggcaaactagcaatcaattagactctgatccagtagagctgtcattatctgttggatgattccgattttgcagccgtctgcacagcaggggaagtgctatgtcttcattaattagatgttatatgcaacataggtttgtactgtcttggcttgactaattatgtatgttcacatcctcaactgtataagaataaaacacaattagcatctgacctgttgttgcattatattagtacactatactactagatattctatttttaagggtgcagactgcagagtatgtacaacacactacaacagtatggagtaatttgcaacatgcatgtccgctaaccagcccatgaaattagcgccaattgaaatttgatacaaaggtggaattttaagaagcgtgcaagtatgaaaacctagcactatagtatccgcaggagacctaacttgcccattgattcctatgagacagattacaagttgtttaaccagtggagcattgctttatttcttctatatccaggtgatctctatactaaactgtaataaaagactttgctagtctaacttatatatatatatatatatatataatttttgaaagaaagtttaccttttatattatcctgatctcaaaaaaagatgcatgtgacaaataaaaacataaccagcttctcacatccacatcctgccaattttaactgaacaagaggcgcctcctgtgcagaccctgtcattagtcaggatcagaacggtagaatagtttgttaattattcactaatctctagtactatagttgtatgtattatatatcttggcatgaatatatgcattatagtattccattg

SEQ ID NO: 52899 - DNA, 1501 bp, Oryza sativa
gtcatgtaatactagagaaattaaggtatcatgggatccacttgtatgccctacctttgtggatggaaaattcctaatttttctacatagaaaataactgaactggtaaaattttttgagacattttagttatgaaatcatcatgattccaaataggacactaatgtagatttatcttacacagcctcaattgcgtaattttcacattttaccagtatatcgaactcctatgttttcagtaaaaagctggacgaaagcctttaatttaagaaaaatgttgaacattactccatttcggattaaagtattttcaacaacaaatgtgaaatacccagactttgccacctattttcaggcaaacatcacattcgtaggcaccgtccatgtttgatgttgttaccaagtaaatcatggaaacgtgtaatcatcgataatcgagaaaaaaaccatgtggctgtgaactgtgattcgttttcaatattgcaaagcagtggaatcaatcactttcaccagtgaaaacctgatacgattagtacgagtagcagcaaaggagtacgtacattggacgcccaagccgtataaagtcaaaaagcaaccgagcaattctcccacctgctatactatccctgtttacaaacactccgtatttaattaacgttttagatatgatttagtttaaattttaaaacttatccactaataatttataaaaaaatcatatgcataaaaggtaatatcacaatgttatagaaccattacattttataaacttagtcatagttttaaaatcttgatataatcgtgacctgggtagttactagctttttttttttggaatcagttacagaggttaaacataggtccataagttattgtattcatggcaaattgttttcaagtgttatgcgatatactaaatgtgagcggttgtatgtacatggtgactttgttaatattaaaaatattccagcataatctctgggaggtatttattcggatgactccgtcgatatcgaaatgtatcgttacagtcatacagatatgctcattctactatgatgtacgtgcgtatgcctagagacgtgttcatatctttattgcgttttggaaaaaaaaatcttactctaaacgtgaaatataatactcctacatttaggacggaagaaattacacgaaataaattagagtacgtatacacgtatacgtattcctactgccgacgtcgacgtataatacgccccactcccacacacactctctctccgcgcttctgttgctgctgccgctggagctgaagctgcagctgctcctctcgctaaaaaccaaccccccaaccgcctctcccctctcctctcctctccccctcgcatttgcagttgcagagcaagaagcagagagagaagaagaggaagcagaggaggaggagtccaagaattgaagcaggagaagaggaggtggtggtttgattcaagaagaaggagaagagcaagagcaaggatgt

SEQ ID NO: 52900 - DNA, 1501 bp, Oryza sativa
gtataaatttgatgtgtccctggagagaaatttgtgataagattgaatgaatattttaattattgaagcttgccagcacaacagacatgcatatgggagccgactataaacaagaaagagaaatataaacagttatgatgagttggcacattgtttgcaacatgatccatcaaataatttcctgccaccttgcatatagagaatgatatgatttattttgttcattagcataatcatacaataacttttctttatttttcatttttttaggccacctttgcaatactatacatatatgctagtttgctgtcctttcacactgaactaaaaatcatcctctataatttgtttgctcctagtgtatatatattgtaaaattgtacacaacatagatgcaggatttattggctgtcacagcttaataagtaggatcatatctataactgattaatgctgacacaacttttttgttagctgatgaagcactcaatagagtaacttatgactgaaggcaagtctccactaactatgctgagtgctatggccattcagacaagcagggtcctgatgaaggcccggccttgcaagttgcaactaatctcctctcctaatcccaacaggcaatcactcatatgcttgtggggttgtgtcatcataattcagagttcagataatcactgttagttacaacttcagtgttttggatgatcacttgcagtttgttatgactagtagtgctacatatcttcagtgctacatccacctgatcctatcaagccttaagaatacataaatacacataagcacacaagtccaaaataaatcatactatgagtaattggatgccttcaagaaaatatttctatattagcagtgtattatatataatggagattccagttgtattattatttcacacttttctgtctccaagctgtccacagtcctcttcccactgatgagagagagttgcaagaatttgcaagaagcaccaagaaagtgtacccaaagaagcatcttcagctgctctcaccagtcaccactcccatccaagagatcccagcctctactacaacagcttccaacttccaagaacccatttttttcctttcctcctcctcctcctgctctggctggctctgggctggccgtgccctcctgtcagtcctagctccagctagaatccctccttgttcatccaccaccaccatccacatgattgcatttgtgcagattcctggagaattaagctgtcctctcatgccgatctgacacaccttgttgttgttgttgctgctggttgccgcacaaccgaaaggggggattatttggccctctttctctttcctttcgcaggaagatttggtgattcttcttctgagggctcctctgtatgtgctctttcccatcccattgtgccattttttgtaggatagatctggggatgttgcagatctgatcggtaattttctttggttttcttcagaaggatttgggagga

SEQ ID NO: 52901 - DNA, 1501 bp, Oryza sativa
ttcccaacgcctagataaagagaggaattattttgggattgcattcaaaagcgacggttaattatacagaacaccatatattgtttgttagagaaaactctttatttaatacctaaagcacttatcagtctacataacgtatgaaatcggttattgtgcccctaaagtacgaaaagcgttccacataaagtattctatagtttctgggaggtacttttaagctagttaaagagatatgatattaggtgtgtgtgtatgtgtgtgtgtgtgtgtgtgtatatatatatatatatatatatatatatatatatatatatatatatatatatatatatatatatatatatatatatatatatatatgtttatagagataagtgcacgcatgtgtatgaatatttacgtttataccgtgttccaaaaaaacaacatatcaaagttgtttggaagttttttttattttctaaagaaacatgtgaggatggtttgtaagtgttcttttaggcggtgatgcgaccgagtggtattgtttgcatgacagacacgttaaccaatttcagccgaatagttcaatcactaactttctccgatcacgttacttctttcctaagccgctatagttaggagtaaaaatgcatttaatcaattacatcctcatgtcactgtgtgttcgtcgtggtcccggtggccaaaaccactctacaggttatttgaaccaatttcatacttttgggagataatttacccggttgttccatactttataggattaatcagactttttcaacgctttattctcaaacggtagaaatggtaagaagccgttgtgctatggctgttgactttgtagctaaacattgcagagacccgaagttgactcttccttttttttgaaaaagaaaaaaagaacagagcaacttggcatgaactgtaatctgcgctagctgcatatgaaccatgctcaatttacattggcctggtgaggtgacttttaccaacgattcgcattgagtacaccaaaagggttggtcaaggaatctagcaaataccaaatcaaatatccaaagcataggagccaacactcgtgggcgcaagatccatcacctaacggccgctagaatagttggaggctttattttgggggagaataattcgaacttgaccaacaggcaacagctctcgccattggccaaacaaagaggaacaatgatcacgcttcacgcccggcagcatttgacagataatggctgccccaaagaggccaaagctgtacaacgcagctcgtcctgttgctatccaactactgctctggaggtagtacgtttgcgtgtgctctcaccactgccatatgcttaacgtgacaattaagtaattattagcagatgctgcgcgtacgaagtttgcgacagcgttggccatgtgaatttgtatgtgaaatgaattttgctgaaattttgtaaacttggatttctcatgcgagtttgattgatatttgcagcgt

SEQ ID NO: 52902 - DNA, 174 bp, Oryza sativa
attcctgcagccctgtctcgttaaaattcgaagttttttttttctaacaaaacgatcattttcgtatttttttccatgttttgtttttacatgtgcttcttaaaatcccgcgtttcgttggtactgcattccttttcaattcagtttgttaactggaattccttttcttttagt

SEQ ID NO: 52903 - DNA, 500 bp, Oryza sativa
atttgagttcttaaatgatggttgtaggttcctggtgtcaaacctgatgatgttattggcacactagctgtcagcagtgtatctgcaggctacaaggtaataaaactttctactgtgattatttgtgaacattttattcatgaattgttcttcaatattctcaatggatatttcataagtatctctcttcatgaatcgttctccagtgccgtctttaatctttcacatcatttacaaaagttagtacttataaactgctgaggtgttatagattcactgaaactgtttttatttgttttgaaatgattgatattttgtaaaagttgattcataactaacttttccaattgcacatgacaaaactgaatgtctggaattaagtcataggtatgttgaattttgtaacaaaaatgcaagaaatacagtgtaactaaaatgtgatgccgttgcagtgtgttggatatgatatcttattgtgtactctggtccttatttgaagg

SEQ ID NO: 52904 - DNA, 1501 bp, Oryza sativa
tatatatatatatatatatatatatatatatatatatatatatatatatatatatatatatatatatatatatatacacacacacacacacacacatacacacacacctaatatcatatctctttaactagcttaaaagtacctcccagaaactatagaatactttatgtggaacgcttttcgtactttaggggcacaataaccgatttcatacgttatgtagactgataagtgctttaggtattaaataaagagttttctctaacaaacaatatatggtgttctgtataattaaccgtcgcttttgaatgcaatcccaaaataattcctctctttatctaggcgttgggaatatgatcaggagtcgtggcagagaaactccatttctctccccactttgcccctcgtgttggcgaaatctcaatttctcggagcaaaaaagtaagatctcatcaaatcctccccacctatttattagaaaaaaaaatgtgccatcaatcgccatcttctttgctcaccattccggaagctagaaaaggttcggtaactcggcacgaatgagtaacctgcatccgtaaaaacgacgcagaatttcgtcctaccacttcgctgaactgactaaagtattctagtgcagtacgctaattcgaggaacaaagaatcacaacgaaagtgaagccattgttccactattccaaaaccgaactaagctaaccagttaataagcatccagcgagcgaaacatgatctgaagatgattcggtgataccatttcatctatctatctaccaacaaaatgcaaaaacgaaatcaaaactttcaccgcgataagaaacaacaaggtagcatgtcaatgatgtacaagaagcaacgaatcactggcacaattcgcaggagacagcttgagtgagaaagaagcgctctagcgcggaaagaacttacttgccaagtggaagaggagcgcttgcagcagcccagaggtgacagcagcatccagccacctcctcgcccccatgccaccactgccagccaagctactagcaacaagaatcctactgcttgatgcaatctcgccgcagcttctcagatgttcgagtccaattatggctactacttgggatcagtgaaatggtcgaagactcaaaggagctcgagtggcaaactggcaatgggagaggcaaagaagaagacaaggaggaaagaggccaggaaggaggaggaggaggcgagtcgtcgatgcagtctttggcccccttgcttgctgcgtaaaataagaggagagaaagcggcggggcgcgaggtgacaccgtggggtcggcagcacaggacagggacgacgacgacgacaagggttgtgtgcgggagaagccgcggtcaccgtcgcctcgcctcctttctcgcggtgcctgcctctgaccgcacgtctacacgcgcggcgcggcccgccaatgcgttttttcccctctcctttggtgcgtcaactcgccgagaaatacagccc

SEQ ID NO: 52905 - DNA, 1501 bp, Oryza sativa
tttgtttgatgtcaagtttttagaaacgatatagtctttatgtcctttttgccaaattctgtacaatgtcaatttgttaatcgcaaactaaatgttatttattttgatataactagtttaggcatcgaaccagacaaggttttatattaaaccgttgcgcctaactcaacaaactacaaaaatgctatttattttgatataaatagttcaggcatcgaaccaaataaggctttatattaaaccggtgcacctaattcaataaactaccaaaacaataccacatagcatggaaacaaaataaaacaagatattcgaattcgtccccctaaaatcatctcctatccaatccccatatctctcccacccatcggtgatcaccatggtgaatatactggtctctgagatgcagctacccccaactcgcccacctcctcgctgtacgttgcctcactgccacaatgtcagccccatcgcttgaaaacccctcctcttgctccaacacaaactgtcgccacctgtaaaccccgctctacctaggatgtgctatcgctgatgaaggtggagctcatgggcgtcctcgaccttgagaaataaggatgaagaaggaataagaggaagtcaatgtttcgagcttgatggcgtctcaccgaagcagaggaaggggcggtagatggagtagcatattaggggaaggaaggaatgaggcgatgccaacaaaagaaggacggaggtgattccaactctgttggagtctaaaggaggaggaagacaattttaccataatttgggtggaggggtgttggccctatgtaatggatgggaggaggtattgggagtggtggtacaccgaatgcgtcatgcgtcacagagtatgaggcaatacaatttcgtcggattttcatgcttggcatgattcataaagtgctccatggtgacgacaaatcttatagcttttgtgctataaaatttatggtgtcgtttggatttaggaacgatcaatgttaaaatcataatttactcctattaaataggggtggttatgtttattaccatgtctagccctaccaaatttatggtagtggcaacattacggtatcgtcaaaactttggcgagttgtttgatgtaaaaaaacactcgagtttttattgtctctttcgtacaaactttaacaatgccaatttattttggtactataactgatttgggcatcaaaccaaaccagaccgtactaaatcgttgcccctatataaaaaggaaaaattagaaccatgccattataattttacaaaatttaagatatgtcatcctgatccacatgtcattgactcacgtgggtactacatgtcattgactaaaaacatataaaaactaccgaaacaattccaaagagcgcggaaacaaaagatattcgaaatccatcccccccccaacaaaacccgtctcccatccaatcccccgatctctctctccccccacacaacccatcggcggtgatcgcca

SEQ ID NO: 52906 - DNA, 1501 bp, Oryza sativa
cgatgagcagtcgtgcaggaggcactcccccaaaaacctgatcacccatctcaggcgaaggtgtggtttcggaggcactgcttcttccaatctctcgtgcgcgcaagagatcagaagcggagaagcgagagcaactcaggcgcggagaaggagaaactaacaccgggaaagaagcgaggaactcggatcggactcgcggcctccttatctatcaggagaaagaacgtggacgcgctgttgcggagggaatcgtggaacgtgggttagtggctgcaaaaggatagcgacgtgacgcacgcacgccgccagccagccacgccctcgcctcgccctcgcccacgccccggcccggcccggcgcgcgcgcgcgtgtggcattccgacccccacctcaactggtcaacagggagcctctaataactccctatttaggttgagatatttctcgcttaaatccagaggtggtattattatccttaacatttattatgggcctttgagatttaatagaataaattgggcctagcccaattattctaacaaaaggttagtgcaaatttacaagcatcatataaataaaaagagaaaaatatatattatcaccttactctcattcatgtgatgccaaagcatctcattgtaagtctccacactggagtactgaaggtaaaagtggtttgcaattcgaccaagttctgtgcaataaaagttgccgctcttttcacataaccgcaccatcatagctttatctagcgcacatgcagcatgaataataaacgctctttgcttggcaaccaaggaacaatcaccaataaccttggcaaatatgaaactgggagttgcaaaaagattcaatttagattcaaaaaccagagcatgagtatcaatagtgcaatgaagtaccataacaaagacaattatcttgcttgtcgcatgatagaaatgatcatcagtaatacacagaatatgtcacactaccgcaactgctaatgcataaaaagttagcatacaacacagtagtcaactcacactacaaaatacgtacttccagaataagcttatgcaagtcgtcgaagatgtgaacaagggaagaaaaggatacctcttcccaagctatcccatacaccagaggattagtcttcatccttataaatatgtatagcgaaacagcacagccacacaggcctccgtgacatttgttacagtgcccaaggcacctcagaattcaaatcatctttcaaacagccaagaaactgcaggataaacattgccacgaagattaaaattaaaccagaccagaagaatgtacaacatcagccaactaaccaccagccaaaaccaagacacaaaggaagggaaaaatacaagatgcatctccaaatttatatacaggccttacaagtacatgcattatcctacccaagtacccatctgaagtgcttatgtatttgtgccaaagagattatgatgaatctggtcagtttgaatatttggttggtttc

SEQ ID NO: 52907 - DNA, 1501 bp, Oryza sativa
tgtgacatattctgtgtattactgatgatcatttctatcatgcgacaagcaagataattgtctttgttatggtacttcattgcactattgatactcatgctctggtttttgaatctaaattgaatctttttgcaactcccagtttcatatttgccaaggttattggtgattgttccttggttgccaagcaaagagcgtttattattcatgctgcatgtgcgctagataaagctatgatggtgcggttatgtgaaaagagcggcaacttttattgcacagaacttggtcgaattgcaaaccacttttaccttcagtactccagtgtggagacttacaatgagatgctttggcatcacatgaatgagagtaaggtgataatatatatttttctctttttatttatatgatgcttgtaaatttgcactaaccttttgttagaataattgggctaggcccaatttattctattaaatctcaaaggcccataataaatgttaaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgagggcgaggcgagggcgtggctggctggcggcgtgcgtgcgtcacgtcgctatccttttgcagccactaacccacgttccacgattccctccgcaacagcgcgtccacgttctttctcctgatagataaggaggccgcgagtccgatccgagttcctcgcttctttcccggtgttagtttctccttctccgcgcctgagttgctctcgcttctccgcttctgatctcttgcgcgcacgagagattggaagaagcagtgcctccgaaaccacaccttcgcctgagatgggtgatcaggtttttgggggagtgcctcctgcacgactgctcatcgccatgtctggagttgctgccgccgctattggcggaggtggtgcgccgccgccgacaggagctggtgcgccaggaggaggtgccgtgaacgactacaacaacggaggcaattctgcctcaccatccagcggagggccattctcggggtataatcttctccttctactgctgttagcgttactcctgttcccattgttagcgctatactgtgtgcgctatgttcttgttcctgttctacatgatgcctttagcatgttatcgcattattggtatgttcctgattctgacattcatgatgcgcttagtatgctactggttatgttaagatcaccctacactgcttatgccatgatcatagtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 52908 - DNA, 258 bp, Oryza sativa
atacccacctaaggttgcataatagtggaaacctgtccattgtgatcggagatcccgtgaatttggatggtgaaacaaactattgtgtgactgagagaagagacccttgaaaggggctcattttcatgatgtgcttctcttctttcctgtatggtaggatggcttatgtcttaatgtgatccgagtggcttttccaagcagagatgttgacctgcagaacatctcagaaggaacacacctatatgagttcgactgcta

SEQ ID NO: 52909 - DNA, 1501 bp, Oryza sativa
gcatatgcataatgttatcagcagcattttatgtccctggagtgcaggagctaccaaactgatgaggtcaagtgactctttttttaattgggctcatctcacttgctcctcttcttggcctccccgtaaagaacaacgcctgcgactgttatcccgtagcctagcatccccatgaaggttaccgggtttctgaatatcaggatggaaaccacaacagcaacagcccctttcgcatttccaagaacctggtaagaatcaagcaacgcgttgaacattgttagctgcaaacatatcgacatgtgcctgaatgttaggaagattgaagatcatcaaagcatcatgctaacagtgcaggtaggagggaaggttggattacttggagagtgagtgggctagtgtgcttggtgactaggaagtttgtgaggttcacaaagtaggctaacgaggaattgcaaagcagtatccagataaaactcggatcctcccgcgcaagcgcagtcaccatagtgagcacattgcgctccatgataaacgttgctggaatcagcagaacgacggccaccggagccatgtaaccaagaagctccatgggattgagcttctccctgcatatcaaattaggtggaaagggaataaaattagctgaccaaattagttagaccaaaatgtgggtagcacaataattcataaaggattgcgatgtgatgaattattactcctccgatgacagcaagatcccctgcaggacagtcttgagcgccctcgcggcggttgcgccgatgcacatgatgaaaccaaacagatggaagcttggctcaccctgaaattgttgagattgttcaagaattggatcgtctctgttcaagcattgcaggttgggagagcaatcaaggcagatccagtgaggaatcgcggccgccttaccccggtggcgatgacgacgccggcgacgacggggatgagggcggcgtaggtggcgcacgcctcccggcgggccgcgacggcgtaggcgaggacggcggtgaagaagggcgtggtggcgccgacggcctggttgaacgacacggggaggtaccggagcgagacgttcccggcgaccacggaggcgcagaacaccgccccgagcagcgccaccctggcgagctgccccctggagcggcgcggccgcgcagcccgcggcgcggcggcggacgcggcggcggcggcgtaggagaggagggcgcaggcggacatgtggcaggcggtgaggaagaccgggtagcggaacccgtaggtggagaggaggaacttgttgaggaggagcaccccgatgttggacgcgtaccacgacgccaccagccccgccgtgaacagcctcccagccgacgccgccggtgaagacgcagccgcggcgtcggcggcggcggcggcggaggaggaggacatggggaggagggtgaggttctcctgctgctgctgctgccccatctcgactcgagctccgattcggactggctctgcc

SEQ ID NO: 52910 - DNA, 1501 bp, Oryza sativa
ctcttatgagaccgttacgaaccaattgagatccgccgcagttgctattgtgatttgttaattaataatagcaactgcacgtaatctggatcgtccatttctcaatctacgtgtctaccaatagcatcactatcgttgtgtgtgtatttttttacgattgcatgaaatacatatatgtacatatattactacgcacgccattacaaactgaagtactcacaaatacacccctaaagagatggaaactttatttttatcctgagaagctaatattatgaatcatcattgacatgggtaccttaacaacatatacacttcaccaatgaggcccacctcctggtgatataattgcctatatattgtgtccatatcagatctacctttattttcttaattccatatctacaccaataatatggggtcaaatctaatattttaatgggaagaaaagaagatattgttttaggtacatgaagggattaattatcagaatgcttgcagtactaattaaaatgcttgggggttgtggtgtcttggtttttgcttaagggtggttgtcctttcagtgttgttagttatctttttcatggtacgtacctgacctgatggtcgtttgtcggtgatctaatggagctgtttgtttgaatattttgaggtatcatgcatgcaatactttcaagaaaggaataataattaataataataatctcatctggggaggcatcatcaacacaactactataatgttacacgtcgacacctgtacgacagcttctcattgccattcagaaaagtactctctgtattcttctattactatgttgcccagaggtgttagctaccatgatattccatatgaaaaaaaaatgatatctagtattcttttcttgatgttcacatataattggatcgatccactagctatgtaggagtactactgatgtacacctagctaactttggtcaaatcatgctcagtttttaaatttaaaatatcactatgtatggtataaaaattaagcaatattaactacttttccttttgagaaaatagaaaaaaatgaagtaagtctgcttctgctgagaccaaaataactaagctatcatatatattcttggcattttcagatctcatgttggttccctgctatagtaaaatatatgtgaaccaccatcgttctcctgatcgaagcaacaaacaattgccaacttgtgctgcagtttgtgccttgtaaacaaattcagaggcatttacatggaagcaagtaattaaagaacaattaaaggaagggagcaatgggattggaggataccagtagatctagctagtaccaatataacgatgcatgttcatcataaccaagagttttgctagcattggtcgtttggtacatctcttttgatttttataaggtatgatcttaaaaactgcaccttcaagttgatttcaaaatatgctgttaatgtctataataggaagagtgcgtcagagccctttataa

SEQ ID NO: 52911 - DNA, 1501 bp, Oryza sativa
cgtcattgctaggaccggtcttgacatttcaggggccgatagaaattagggtctgatatttttctgagtgtatctaaatagctcagcaactcagattgttttttttcttttcctagataaattttattatgtatagactaggttatgtgatctgacactcgactctctctttctaatataaactcttcaaagtatcctacaagatacccttgtatatattaaagatattttagatccaatgcgtgatttacttatacattgcacacgttgtatgcatgcatttacttcctgtgagaagtagagaactgagaattggttcatttagtcgggacatactttttttaggagtgctacaaataggacatttgatatttttcaaaacatcggacggtgttgcactgtattgttgcaaaatgtttcacatgttgcactcctcaatgagaaatgattcagtgaaaaagtttcagatatttcatcaatctaggaaggtgttgcattgtattattgtaaaatgtttcacatgttgcactgctcgatgaaaaatgtttcactgaaaaagttttagatgtttcatcaatcaaggaaaattgtttcatcgcttcaacggaagtgtttcaaccaaatgcaatcgaaacatattgattgtaacatgaagattcaatatatgcaacatcaaatcaaaacaaattgaaacaccttaatacaatagaatgcaacaagctaaaatagtaggatgcaacatccctaaaactccaacaaaacaaacccacctccatcttcttcaactccagtcgccggctcctgagaaaacccacctccgtcttcttcttcttcaactccggttccgacccccgaggaaacccacctccattttcttcttcaactccgggataccgtcccccgacacctccgtcttcttcttcaactccgggcactgccctcggacaagtaacgacacgaggtaggtgacctcgactaggaccaatcgctttagcattagaaccccgccggcgttgctgcatcgcctccatcgccgtgtggctcctagcaagctctagtgcctccccctaccccgtgtcgtcttgcccccgtcgctaccactgtgtggccaccaatgattcgtgtggtggagatagccaacaatgctggtgaagcagcaagagaagaaagagagagaagaatgaacatgtggtagagaatgtttggataaagccgacgttcgatattttacagtgtccggacatccgtccgaaagcattttcgacttttttttgtttttgctacacatcactcgtgtgaaaaaaaatttgtttacactcaaattttcgtccttcagatagacttcaagatgtgtgctctattttattttacatatcttcccaatcttgtttttcatttttttgggctgctatataacggaatcccgttttcgaacaagatgatcccgagtaggtatcaggtgtgatacctatcaggtatcagacgattctacacaacagga

SEQ ID NO: 52912 - DNA, 416 bp, Oryza sativa
  unsure (1)..(416): unsure at all n locations
gtggccatgatagactccnnnnnnnnnnnnnnnnnnnnnnncataggggactttatggtgtccgggctctaaggtataaaaaacacaaattctctcaaatttttaaaaatttacaaattgtaagtagatatctaggtatatgaatttaattcatacaaatacctaacaacaaaacaactcaaactcaacttcatttcacaattcattattacatacataacgaattatatgtttagatgttatatatctagaaccaaaatctaaaaaaaaaagttcaaactcagttcaaacttgtttgaacttgttagtaaagaagttaatattcatatctaaacatttaaaaaaaacatttaaacattcaaattgggtatatacgcaatttgaatcttggagcccatactccatgtagcaccagt

SEQ ID NO: 52913 - DNA, 1501 bp, Oryza sativa
agaagaaaagaagcattgatcgatccaccttatatgaagtgaatagcaggatcaaagccaataataggttcactgcttcaaacctctacaggaaaagagaagttaagaagaattactgcaagatcatagaactaagaagataagtgatgttaacatgtgagaaaaaaacaacctgaatcgtagctgctcctagggtgatcatcaccgtgcggaagatcactgctccagcaataccataagagagcacccggttcttgttttgaataccacaaaaatgtgagaagaaaaggatgaaatagacatgggcattatataccaaactaactactaaatcatacctggtattcctgtggcactttaaaatacttgaagaccagaacaaaaacaaagagattgtctactgacaaactctgttccaataaatatctgttatacaacagaaacatatcaaattgttacacataaaatttaaaagacaggagatgaggacaaaaagaagaagcatagttaaattcagaaataatcatttaactatttgtaaataagcaagtaagagacgttcaaaatcgcaactgggcaaactaacttgcacaaaccaatgaatgagcccatacatttttaattttcaccaactcttttcctagatggctttgctaacataatagtgccggcgggaatcctacaattgttctggtggatgggtaaatgctgacagttccataaaacatttttcagtataaaaattcagttgtgacgcataacacatacccagcaaaatattcagatgccttcccaaccccatccctcagggcgatgctaacgccgaagaaaaccgcagcaaggacctgcaaaaggtcaatttactgaatcaagcgcagcactgaaaatcaactgatgaagcgttatatcgtcaaacactaaccaccaaagtaactcttctaatggctgatcctttctttgtgattccggtttctgatgcaggtttcgtgctctccttgtcggtagtgcgaacggggggagtggaacttggtgcctcaatttctgctcacagttatacataaggggaaccagaaaacttaatttcaccacagataaatatatgctcggtgaggtataaacaaaatcgttgcgcgttttatgattagaaatcatctaatcacacctttgactctctatgagtcgtcgaacaattccaagctcaaggtttcaactagaaggttaattggtactatacttaattagcacggatacatggagctagctagtcaggtaggagaggctggagagtgggagacggtgaggacgacgcaactcaccggagctgagggagaggccatcctcctgatcagcacccctggctctcctccgcctcctcccaccttcgccggtgcgacgcgacgccgcggccaccgtgaccgcgggataacgccccggcgacggggggagcgccacgtgtccccggcctatcatccatggggcagatagcttctcgaaggaacgg

SEQ ID NO: 52914 - DNA, 1501 bp, Oryza sativa
gactcatcagtagtagtaaacgagtatatgagtctgatgacgaaaaatccactcttggccgatggtgccagatctgtgttggcgcgaactaagtcgataaacacaacggcctaggagatctgcttagctctagtgcaggttcaaaatattgatgagatgcgggcgtgccagttagtttgatcctacaactgacaagatatataaataaaagggtcgatcggctcaaaagtcgatagagcgatattagccgatgccgatactagtggatgttgatagagttttgatcaatcagctatgtgtccaatatagagtttgacacttgatataagaaatgacataaagacaatcaacgatgacaatgtaataaaataacaatataattcaatcgaaaccccgatgaatgatacgatagagtgcgtgctaatgcgatggttaaagcatatatcggctggaggtccgatgtcattaaatccaaacgattagataaacagtgaaacctttattgcgatcagctcaatccaacttgtatgtaatccttataagccaatgcaatgtccagataactcattggctgaaaccccgatgaaacccttgttggcaatcaagaagcttgctggagattatggttccaagcacgacttagtagatcaaacttaactgatgtaatactaagtataaaaagaaacataatatctagacaatcaagcatttgattgattttcagggtggtagatacattatataatctaagccagcaaagaaatctagctaatattgacaaaaccctagatagagatcggtcgatgcaagtagaagacactgcgaatctatattatataatgtatatgataactcgacgtcttacatggacaagattagagtgtggaagcgatggaagcactaatcccaacaatgcaagccgccataacaagcctttatctctcgccggagattgaagccgatgcagcccaacttgaaacaagaactcgtcgaaaagtaaagtaaaaagggtggcgacgcatcgaagttgtattgatcgagagatagattaaaataaccgcatatgtacatatttatacccatagaccgacataagtccctataggacatgacatacaattttataaagataaaagaaaaacataaagtccttattgaaaactaaacacacttttttaaaattaaaaagaaactaaatgagctctgcctaattaatatatagaattaagccgccatgacatggtcttcatgattcctttctaaacttggcctcaatcagttgattgtgctttttacttaaccgaatctaccagataatcttatcaaatttttacattaacacttgacgggtttggttttcataatgcggaaatcggattcgggtctaaacccgcacgtgagcccccactctctccttccccttccaccccactcgtgtcgtgtggctgagcaccgtacgacgcctcccccgcccgcctctccccgacctcgtcgccggcga

SEQ ID NO: 52915 - DNA, 189 bp, Oryza sativa
ttctttgttgcctaggaagcaaaagttaaagggaaggtccatgacattgacgtatgggatgaagcacataagaaaaaggatgagcgcattaaggcggtagtggtaaatttctttccttgctagttgttatcacaaatgtagtttggttcatttatgataaactaattcatgcatgtttaattatgtagg

SEQ ID NO: 52916 - DNA, 442 bp, Oryza sativa
aggattggtgagctgcgcatgctagcgtactggggatggaattgaaactgcatggagttcgctgatttcctgtttctaagagcagagatgagcacatactaatttaccaatccttggagggagaatcagctgtaacctggctctgtttgcacctaatcgctcttgcccggatgccacctatttccatggccacatatatgcagttagttacatgcatgcaactagacagggatgaaagcctttgtactgcttgcaaattggaaggaagaataggcacaacataaatagcatttgctcttcaagtgtttcttgtggaggtattgattgcaatttggaatgcaagagccaacaggtgaattggcatactagcttagataggaaggagatagcaaatactcacctgtttgttattctgtctatttggtgaaacctaaaaggataa

SEQ ID NO: 52917 - DNA, 595 bp, Oryza sativa
tgacatgtgtaagtaacatatcaacatcatttcaggttaagaagagtccaaatataatttttataaatatttacatgcatttaggaaagggaaacacatataagagataagtcttactaattatctaaaataatttgtgcaagataaaatcacgggaaaattcttgtaggctattctcactacattcaactcactgtaattttggtataatttaataactacatttgatacctcaaataaatcagacaaaccagtcaaaaactagattaactatagttcttaataggctaaaacaatagctaactaaaatatgcattaaactgcatagaagtatatagaggaaatagtttattcaaatactaggacatttatgatgagtaaatataaattttctataatttatcttctctgtttagttctcctaaaaattcaaactatttttcaaagagctcatcttctcataatttctgtaagtaatctatccataatttttaagtgcaaccaaagaaaatggaaactaggtacatacacctacctccagtaaaatccacatgaattgatatgcaccacaaattaatctatgaattaacaaaga

SEQ ID NO: 52918 - DNA, 1501 bp, Oryza sativa
gggaacttagcttttaaagataagtatccttccttatatactattgtcagaaggaagaactcttcaattgctagagttattggttccgttccgcttaatgtttctcttaggagggcattagttagtcagaatcttgtatcttggcataatttgtgtgcttctattattcatatccagttgaatcaatcttctgattgttttatatggaattataatcagaatggatggttctcggttgggtcaatgtatttagctttgattaataatggctgtatcgagagaaataagataatttggaagcttaagatgccgcttaagattaagatcttcatgtggtacttgcttaaagggatggtattaactaaaaataatttggctagacgtaattggaatggtagtttaaggtgttgtttatgtatgaaaaatgagtctattattatctttgtgcaaagtttatatggatagcagttcaattctcttttggtttataccttcctattagcatatctcatattttttataggtggcttttaggggtggacaggaaaaagagtaaacttctgttggttggagcttctgcaatatgttgggctctgtggttgagtaggaatgatatgatttttgacaaatcattatctatttcatatatgcaggtaattttcaaggcaacatattggctccggtgttgggtacaattacaaaggtatgatgaagatgaagaacttctaaaagttacatgttgtaagctcgagacgacggttatgcaactttttgccaattatgaatggagattctcaaacttcaataaatatgtactccttttcatataagggttattccttttattagtttgttgttttcaatttatttgaattacactagtttcttagtttctagagtggtagtttgtaataattggttgtagctcttttaagcacagaccggatgttatatttcattattaaaaaaaaaacttaaagccagcttattttaggaaaaaggaagaaggctaaaaatgattattatgcgacgaagggaatgccatttgaactcggagtctcggacgatgaaagctactttactgaaacagtaaaagaaaaaaaaagaaagtaaaatcagttaatgaaacaagtactgtagagagagagagagagagagaggaggggaatttcttgcctctcgctcagatccgttcctccggcgaaaagcgacggcgactttgttgacgctgcggcctcttcccgaccgcgcagcaaaggtgaatctcctcccttcctttgttcatcctgcggtttcctctctccctcttggctcttgctctcttctctacggttttgatgtgcgcgtgccctgtggtccatttgggtgattttgaatcgggcacgtttggatccttggcaaaccaaatcctagccttgcttcatctccagcgcagtgccttgtgatccgctgggctgctgccttgtcagatcccgccaacattgcgccgctgttctgccag

SEQ ID NO: 52919 - DNA, 1501 bp, Oryza sativa
taaacaaactaaatctaacttcataatgaagagatcataaatgattgtttatatgtattaaatactatatatttttgaaagctaacaaaaagtttgaaaaaagttatctaagcaatggcaatgaagaaaaattatagagaaacattacttttgaaacatgacaggtgtcatgcagttaatattctgcctatataaaattttcaaacgcaatatttttatataaaaggtaaatttgtgaaaaaattctgagataaatgacaattcatttgttttaagggagtgttcttttcggcccatgggtttttgtagcacgcaaaatgagaaatatgattagcatatgtttaggtaactattaattattaaaatcttggaaaatgggatttgtttggctttttaagcaccttcgtgtatagaaagtttccgcataaacctattgtttaacaatttgcgtgctaacagaaaacgagaaatagctaagctcaattagctctttagaacatgggctaatttgtcatggactaatcgtttgttccagcaccaatcaaactaataagatagtaaaaaaataagtttgcttttcattcgctccatatatgggaacgtaaaagcaataaagactataataccttcacttattgagttccaacataattttatgtatatctcatattttcataactttttgctactggaaatacaaaacaaatgtcttttgagtaaatggttatttaagtttgtcagggttatggataacacatacccaatagtaatcgactaagctcggcagggcccaccacatatcatgtcttatatggaaacaaacatcgtaaatagagggagttccggataagaaaggacaaaatatagttatacatggaaacgataaggactactcggattgtatccgtattggtctccctagttttacatggatagggggtacctataggtataaatacaagccccctaggaggagagggaacaagccacaaggcacaacatagaagccacaagacacaatatagaagccacaagatgcaagccaacacaccccaccagatatcgacattaaagattagtctagacaaacccaatcggccaatccagtacctacggaggctggcaagagggatctagcgccatctcttatgtcgatgagatcatattcgaggaggaagactaccctgtcatcaactacgagttggtgttcatgccgccaagtcgacgacggttagatatgttatcccaattgttgtactatgtggttttctatatcaatcccatataaacaggatgtagggctattacctgtcagctaaggggcccgaatctgtataaaaatccctgtctccatctcttttacctcaatctcgcatataccctggtaccgacgattcccataccatcaaaataccctaatcatgactatcaaacgttgacagtggcgcgccaggtaggggaacttggtgcttcaaggtttcgacgagatgggtttaagaga

SEQ ID NO: 52920 - DNA, 487 bp, Oryza sativa
aaaatatgatttgtgaaaatttctcctttcttccttatctagaattctttgcaaattgtttcattgtctactcccctctctctttcaacttcagtagttctgagacattgaaacttgaagacgccaatgaggtctacttacggaggttaagtaaagtggatcgaggaatatgaaggtgatgatcgatctgaagtgccaagtgttcaagatggaatgaagtttggatcctaccttagaacctatgccgccaaactatctttgaagaatagttagtagggtagaacgtttgttgcttgctttgtgtgtaggtatagttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaataga

SEQ ID NO: 52921 - DNA, 1434 bp, Oryza sativa
cgcagccgccgtccgcccccttcgtcaccatccgccgtccgtcgcccgcccctccgtgtctctcgccgccgtcaatccgtgagagacagatgaagagtgagatagagtgagagagagaagagaggaagagtgagagagaggggaaagtggaagagaatgacatgcgggtcccataatttttttattaaaaaacgctgattaggatgccacgtagaccaaaaccaccgcggattgggtcgagggggggtaattcgtccggtttgtatagttgggggtgaagaatatccagttttgtgattcaggagggtaattcggacaactgcgatagttcgggggagagggtaattcatactttttcctagagggaattatcaaagactaaacacaggaaatgcctagttcagaacataataagccataattatacgatgttaaattaaaatgctaagcgaatgatggtgccactatctatatgccactctcccaaaattttttacacaaacaccacaatagagatatttttccctaattagtgtgccatgtcagcaagagtaacttgagatggcctttttgcccctgggtcaaagtaatactactcttctcgttccaggctttttttttttcctacgcaacagtttttggtttccagcagctgtttcatcaagtggccgagcaagcaggcaagcagaagcagcggtttgtgaatgaaacccacgcgccatatgcccatattcatggctgatcctgaactgaattcaatgtgccccacagcttagcactagcttatcatgcatccatcgatccagtcagtggcggagccaacgatgccatcgagcccaagtgacgatgtatatttcttacaacattttacaagtattttcgataattgacaatggcgatctgatgaaaaaaaatcagctttagttgcagcttttctcactaagatattggaactgtaaaaggctttagttagttttttctctcatattatatgaaaccaagggcaaaatggtcattttaagtctctcttgcagacatggcatactaattaggaaaaaaaattctctctcttgtggtgtttgtgtaaaaatttttgggagagtggctaatctagcctcggcaacttaatttggctctattggttgcttctcgctttagagatcccaccggtatcagccaaattgccttgccagattagattagtcaaggcgaatgagagtctattattgctatttgaaaagtgcctagctctttgattgtttagactctaagtttctttacacactttgagatgcatcatccctagtaatgtttagaaccctaaaaactaacctggaactagtcataattagaaatagtatcggggtttcagccgatcttacatgatatgcctgtttctttaattgttacaagtgtatctgccacctatacagg

SEQ ID NO: 52922 - DNA, 1501 bp, Oryza sativa
cgatgtttaatagtcacgactaggatattttgatggtatggggatcgttggtactagggtatatgcgagattgaggtaaaagagatggagacagggatttttatataggttcgggtcccttatctgacaggtaatagccctacaacaattgggataacctatcctaccgtcgtcgacttggcggcataaacaccaactcgcagtcgatgagggggtagtcttcctcctcgaatatgatctcgtcgacatcagagatggtgctagatccctcttgccggcctctgtaggtactggattgggtttatctaggctaatctgcgatgtcgatatctggcagggtgtgttggcttgcatcttgtggcttctatgttgtgtcttgtggtttgtcccctctcctcctggggggcttgtatttatacccataggtgcccctttgtccaagtaaaactagggagaccaatatggacacaatccgagtagtccttatcgtttccatgtagaactatatttgtccttccttatccagaactccctctatgtatgaggtttgtttccatataataagacatggtatgtggtgggccctgccgagtttagtcgattactattgggtatgtggtatctataaccctgacagtagcccccaacttcaatacaaatgaacgagttgatgttctcaatcgaagactttggaataactattgtcgtgctcgcttgaccgttctcggtgtgatcagaaataacgctagattcctcttatcagtctttgtaggcactatattgggtttgtctaggttaatctccgatgtcaaccgagaaggtacggagcatgcgactaagtctcctgtcttgccgtaatcgagaatttggattgaagtcaagaaattccatctcgacgggtacaccatcgcttcattccatattacttgtcaagctccatcaaccgttctcgagtaatcgagaaggtgcaaagtttgcgacaaagccttgaaaatctgacttgactgttttgatgtctgactttcctgaaatcaattctcagaacagaatattaaatagaaatagcccctgagcgaacgctcaaagggcaatatgtatggaaaaattgaaaataaattgaatatatgtgcggcaataaaaaaatacgctcgctagagtttccctcagcaaacggagtttggtacccttcctagcccccaactgttttttatggaaaaactattttccacaaagacagcttgaatcttataacaaaccaagctaaagttgacaaatcctagcctccggccgtgaagttggaaaagtcaatttccgattacacggcttggttaatacgcatccattgagcattcttacatgaccaggttttacatggttgttcggctcttataatccaacaagaccttatctgctctgggcgtccccagccgaaattcccttaggtttctcggaggtttgttagaacatcgtaaagggacagtaggactgacttcaagacgaa

SEQ ID NO: 52923 - DNA, 1501 bp, Oryza sativa
aaccaataactctagcaattgaagagttcttccttctgacaatagtatataaggaaggatacttatctttaaaagctaagttccctaacctatctttccaaaatcttgttttttccccattattcacaatccaataacccatatttaagaaagtactcttgactttcatgagatctgacaaaaatgagaatcaccttgtttcctatcaacttgggttatagactgattataaagatattttctcttcaataagtcctgccaaaccgcttgctcatttattaactttgtcgatgtttaatagtcacgactaggatattttgatggtatggggatcgttggtactagggtatatgcgagattgaggtaaaagagatggagacagggatttttatataggttcgggtcccttatctgacaggtaatagccctacaacaattgggataacctatcctaccgtcgtcgacttggcggcataaacaccaactcgcagtcgatgagggggtagtcttcctcctcgaatatgatctcgtcgacatcagagatggtgctagatccctcttgccggcctctgtaggtactggattgggtttatctaggctaatctgcgatgtcgatatctggcagggtgtgttggcttgcatcttgtggcttctatgttgtgtcttgtggtttgtcccctctcctcctggggggcttgtatttatacccataggtgcccctttgtccaagtaaaactagggagaccaatatggacacaatccgagtagtccttatcgtttccatgtagaactatatttgtccttccttatccagaactccctctatgtatgaggtttgtttccatataataagacatggtatgtggtgggccctgccgagtttagtcgattactattgggtatgtggtatctataaccctgacagtagcccccaacttcaatacaaatgaacgagttgatgttctcaatcgaagactttggaataactattgtcgtgctcgcttgaccgttctcggtgtgatcagaaataacgctagattcctcttatcagtctttgtaggcactatattgggtttgtctaggttaatctccgatgtcaaccgagaaggtacggagcatgcgactaagtctcctgtcttgccgtaatcgagaatttggattgaagtcaagaaattccatctcgacgggtacaccatcgcttcattccatattacttgtcaagctccatcaaccgttctcgagtaatcgagaaggtgcaaagtttgcgacaaagccttgaaaatctgacttgactgttttgatgtctgactttcctgaaatcaattctcagaacagaatattaaatagaaatagcccctgagcgaacgctcaaagggcaatatgtatggaaaaattgaaaataaattgaatatatgtgcggcaataaaaaaatacgctcgctagagtttccctcagcaaacggagtttggtacccttcctagcccccaactgttttttatgg

SEQ ID NO: 52924 - DNA, 1134 bp, Oryza sativa
tttagaaataactgaaatttgaaaattaaaaagtgtaatatgaaaagaatagtcaatcgtagtacaaaatacgagattaattaaaattagaataataaataaataaatttcgaaattagaaaaatcaaaatatgagttcatgtatacaatttatcaacaactaaattcatcataaaaataaaaactattaaaacaacacaagattaatgaaaaaccgggataaaaattttataaattctgaaagttgacaaataaaaatgagagtttgagaatgaatattatttacaaataacttaaataggaaatagatgaaataacaattcatatagactacaatacggaattaactaaagttagaaataaaaataaattaaattatgtgattagaaaaactaaaatgagggttgagtaggaatataaattataaataacagataagatattttaatagaacatattacatctataacataacggtggtaagtgaccataaatgcaaaagggacatcagacaaaccataaagatagggttggtagaggttgatgggatattaaaaataaaaaccaaaactcctaatgattactagattcaatatttagaaaccaaaggatgattagaaggaaagattttgggtaggctgtaaattaaaagagaacggtggtgatggttgacaggacttcttggaagtaaaaagaaaacgaaaatccaactataatcatgttccatttcataaatcctaatgataataaagaggttgaaagttagtacaccgtagaggagtacaatgttgacgtttaaagggacttccaaaactacaaatcaaaattcgacaagacaatgaactagacaaactatccaatttttaaagtataataaaagctgtggcaggtcgggcaggagaaaaggattggcggctaacgtgacatttaaaaattataaaataaaaaacttgacaatgataaaatttgatcttttgaaatcctaatataactatatggctacttaacaaattttaaagaaaaatatatgtaaacaaaatattttatacggatgcttgccgcgcaattacacgggccacactcaactatgtaattatgaatcaatctaataatagcgtttgttaagacacatga

SEQ ID NO: 52925 - DNA, 217 bp, Oryza sativa
aggttgggcttaaaaagcccaaaaccagacctccctccggtaaggccggcctggacaaaattctggcatgggccttaatctctgaaaaattccaaactataataataaccagattattgaatcttcccatggctgacaagtgggcccttatacagagagacgctgacgccagcatgacgctgcggtgacgcccaaaatttcggggaatgggaccaaa

SEQ ID NO: 52926 - DNA, 1501 bp, Oryza sativa
  unsure (1)..(1501): unsure at all n locations
atccagataaataattaccttagttgatataagaggtgacggtgttacacctacaaatacaatgtttaaaagactaagggggtgtttagatccaggtgtataaagttttggtgtctcatatcgcgtattatatagggtatcgcatggggtgttcgggcactactaaaaaaactaatttcagaatctgtcagtaaaccgcaagacgaatttattaagtctaattaatccatcattagcaaatgtttattgtagcatcacattatcaaatcatgcagcaattaggattaaaagatttgtctcgtaaattagtcgcaatatgagcaattagttattttttagcctatatttaatacttcatgtatgtgttcaaacatttgatgtgacatgatgtaaagttttgggatgggatctaaaacaatgcctacaataatcttcgctttatcacatctcgatgtatgtatctaactttattaaattctaatatatttgattgtttcaaaataaagtctttgcggcgataaatgggtgggggaagttatgttattttttaattggaaaccccggcgaggantaatagagaaatgatatatcttaacataaagttaaacaaatcaaatacttcatctgtatcacgatataagtcattctagaatttttcacatttatattggtgggaatgaatatacacaccaccgcaccgtatgaagtagggaccacgacacgttaaaataaataaaaagaaatcccaaacactctcgcctcgtctcctctcacaccacacgcctcgcatcgcatccccacctccgccgatcccgccgtctccggccatctccgccgccggcaaccaccaccacctcctcctcttcccctctcccccttccgcccaattggttgccccgaccaaaccctacgcgcggaagggctcgctcgctcgatccggtgcgggcagcgcgcgcgcggggctcgacgcgggcggcgacggggggcgggctcgatccggcggagcagtgggcgctctcttccacgatgcgtctaccctcttcgcgcgagcacgacaaggtttgcagtagcagagaattttgtttcgtgtttatcgattgggcatcttcggcgcgggagaccggggagtaggttggtaggtaggcttgccgaatccagcattttcgcgtgccccctcgtagcttccgccctgctactgctgctgcaatcggtgtggagagagataattgggggcattgtgacctgcattcccgcagggcaggggcaacgtcgccatcgtgcgcggcaccgtcgtctagtctcccatctttttcaagaaagaataatcgaagattaatcttgaccaattcaattcatttgtgctgcaggttctttttgcggggtcaacaataatgaggagaatttgagttggtctggaattactctgggatgttatcattggcgaaaagtatagatcccttttggtagctgaggagagatctcaattttttcagagagtaga

SEQ ID NO: 52927 - DNA, 838 bp, Oryza sativa
tacttgtgttcctaaagacatgagaaatctgcttttgatgggtgcagcatctctttgttggtccatatggctaagcagaaacgaggtaatttttgataacaaggtggtgtcttctcctttgcaggttactactttagtcacccggtggctacgctcctgggccatcctccacaaacagggacttcgggatactattgcggtggtatcgcaacgtttggattaggtggcacaggagttttttacccaggagcatgggtggcgatctagtctacggattgatagccactagtttctatgttttgtgatggggaagtgttcttaggtccagttttttggttgtgtgcattctatgcagaggccgggggtggactcagttggaatgtatcatcttggtgtatttaactgagtcttaataaagcttccattatctaaaaaacaaatatcggccaaatgaaacacattgcatttagaaaattttaacttcaattccatctttctacatcacaagtgtaatccactgatctaataagtaataaccaaatatacaattaggttccataataaggaaagcggtataaatcatgtgaagatgttgaggacaagctatagaagcttgcagattatataagaaaggataaaaaagatcaggaatttcatgcacaagcaaaccacggaattatgtaaggagctaggcaacaaacctgtctccaaagtggaagtgacttaaactgatctcctagatcatgcagcctctgtgaactacaacatataaggggcagagataaatgcttaaccaacttaaaacgaaagaagaggaagataacaaaaaaaaaagaaa

SEQ ID NO: 52928 - DNA, 1501 bp, Oryza sativa
tgaaaaggaaatatctctataataaatctataacccaagttgacaagaaacaaggtgattcccatttttggtctggtcttatgaatgtcaaaagtactttcttaaatatgggttcttaaattgtcaatcatggggaacaaattagattttgggaagatagatggattggtaacttagcttttaaggataaatatccatctttgtacgtaattgttcggaggaaaacatcttctattgccactgttatgggatctgttccgcttaatgtttctttcaggaaagctttagatggtcagaatcttgtttgttggcatgagttgtgtgcctctatagtacatattcagttgaatgattcgtctgatagttttagatggaatttccatcagaatggcttattctcggtgaggtctatgtacctagctttaattaatagtggctatatcgagagaaacaagtgtatttggaagcttaagttgccacttaagattaaaattttcatgtggtacctgcttaaaggggttgtgttaactaaggataatttggcaaggcgtaactggaatggcagcttgaggtgttctttttgtttgaagaatgagtctattcaacatctctttatggattgtcattttgcgaagtttctatagagagtagttcagttctcttttggttttaatcttccagttagcatatctcatatttttaatgggtggcttttggagttgataagaaaatgagtaaactgatacttgttggagcttttgccatttgttgggcaatatggctgagtaggaacgatatggtttttgacaaatcaccatcattttcctatatgcaggtcattttcagggcaactcattggctccggttttgggcacaactacaaaggtgtgatgaagatgaagagtttctgaatgttgcatgctgaaagttggagaccacggttatgcaactttttgccaattatggttggagatttacaaatagacttcaataattgtgatctccttatgttaggctgatttctttatttttctcttcggtgtgttctattcatttagatttacactatgttcataaaaactactatgtaataattggctgtagctcttttgagtaaaggccgggatattatattccattatctaaaaaaaacaatattactagctatatactcccttcatattttaatgtatgacgccgttgatttttcgatcaacgtttgactattctttttttcaaaatttttttgcaaatataaaaatatttatgtcatgcttaaagaatatttgatgacgaattaagtcacaataaaataaatgataattacattaaattttttgaataagacgaatggtcaaacataggacaaaaaatcaacggcgtcatatattaaaatatggagggagtacagaagacgaagtaatataactaaatgcatgcaacatttcaagtagggcgctagctgcgagttcaatttaccttgggaagtccggtgaccagg

SEQ ID NO: 52929 - DNA, 719 bp, Oryza sativa
ttgacttgtcagtgcataattatatgaaatcatggaatagcattttgtagaaaaaaagaaaatgtgagtcctaggcactgttggcatgattgatagaaaactgtgtacattctttatgatgcaaggtcaggatcatgtgatgagtattaaaatcaggttatggattttcttttcacattatattatctgtgcattcttatgtaatagctttcttgtttatttgacatttatagttatccggtttgatttccctatctatctattgtgataaaaaggatacatggcagggtaccttccctggcccttttcgtcatacttgtttggcttcttgtctcatatgctctttttgtcttgctatatgcgatatgatatgatcatcggaccatggctatctaacagttctagatgctgaaggatgttggttccatggcccacaaatcccaattagttttttaaggatgttagtttaatgtgcatgtgtttgtattctatgattacaataggcttatccttactaggaaaatcctgacacttgtactgttattggttattttaagagcacgataacattattcaggtattcatctgttactattgttccagtatattatgggcatcacatgtcttgactggttatatctgtggcccatatttatcattctgatgatttaacatttactcatgtattcctctatcagggcatcacacgatgagtgttg

SEQ ID NO: 52930 - DNA, 1501 bp, Oryza sativa
aggctagagttgatgcacgtggttgatggagattccatatggcatacgatggagttattgtgtgcgtatgggatgcggagtcgaatttggaaggagtccaaatttggtatgagtggttatgtaaagtttgtttcttgtactagagggtttcctaaggtgtttaggactcctagtatgagtttggttcgtggttttaggctgcctacctcgggtataaatagagggggagcatgatgcttcccggtatcgtttttgagagcaattgagttgagttttgagttagagtttcgagtttagtcaaaatttctgtagggaatgctgttggtgcactttgtaaacacagagagaatcaataaagtcgtcaactactttaagagttcttcgatttgtgtttcaccgggtttcggcggtctaaccggcgatataccggcggtcagaccggcggcaagcagcagtcagaacggcggtggcgaggcggtcagaccggcggcggcgacagcgagcggcagctgatcttggtggtcagactggagatctaatctcggttagactgacggcaccacttggtcagaccgacagatcaatctcggtcagaccaacttccgtcgattttgagggtaacttttatttccgctaaaagttttcggtttttgggtataccaaccattcaccccccctctggttggcttagttattgtgattcgatcctacaagtggtatcagagccttgtttcttctttagatttttatcgatctagagtttttgccatggctactcctgttaggttttcaactaagcctcatgttttcaatggaacggatttttctcattggtatagtaggatgcaatcttacattatggctgaagtttatgatatttgaagaaaagtttctcatccttatgtgattcctgaagctattaatactgctgctgaaaaatttgtttttgaacaaaattgcaaagctcgcaacattcttttgagtggtatttctcgttcggattatgatcgtgttgcgcattttcgaactgctcatgaaatttggaatgctttgaataactttcatcaaggaacaaaaaacattaaagaacttcgtcgtgatattttcaaaaaggagtacattaaatttgagatgaaacctggagaagctttggatgactatctttctaggtttaataaaattttgagtgatcttagatctgttgattcttcttatgatgctaattatccacaatctgagatttctcgtcactttttgaatggtcttgatatgtctatttgggagatgaaagttacatctattcaggaatctgttaacatgtctactttgactttggagaagaccaacaacatcaagccaaagggttcatcccaagggaggaagctggagaatctcaggaaggctttttaacaagtttgcgccgccttcgagccactaagtgatgtagatggtgagagtggagatgatgacaagggaaagaacatctccggtgtttgtttca

SEQ ID NO: 52931 - DNA, 877 bp, Oryza sativa
tgatgggtaatctttagagtttttatattcggatgcctgtcaagtgtgttcattcgtgaactttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattattatctttgagaaggctatgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactgtattttacctgtatcttcatattccgttaggaatatagattatcttttgtaatccggactccttcccatatataaggggggtccgggcgcctctaggggcagatgatgatttttcccgaatcatacaatcaataatacactcggcggattcatccccggacaggagtagggtattacttcttttataagaaggccagaacctgtataaatcctttgtctccaaacccatacactttcctagcttgatagccacccccttttattattgccgaaatctagtttcgacagttggcgcgccaggtaggggtagcgtcaagcttctcgccgatcagtgcaa

SEQ ID NO: 52932 - DNA, 1501 bp, Oryza sativa
taagcggaacagatcccataacagtggcaatagaagatgttttcctccgaacaattacgtacaaagatggatatttatccttaaaagctaagttaccaatccatctatcttcccaaaatctaatttgttccccatgattgacaatttaagaacccatatttaagaaagtacttttgacattcataagaccagaccaaaaatgggaatcaccttgtttcttgtcaacttgggttatagatttattatagagatatttccttttcaataaatcatgccaaaccccttcctcattaattaacttaaacaaccatttacttaaaaaatatttattttgtatctccaaattatgaatcccaagacccccctggtccttgggttgacaaacaacatcccacctagtgagcctgtattttttcttatggtcatccccttgccaaaaaaaccgcgatctataataatcaattttacgaagaacccctttcggcacctaaaaaaagatatcataaacatggctaaacttgaaagaacagaattaatcaacaccagcctaccaccaacagataaatgcttgcctttccaactactaagttttttctcaattctctcttcaataagtttccaatctttattagaaagcttcctaaaatgcatcggaattccaagatatttaaaaggaaaggtacctaacttacaaccaaaaatatcagaatattgttcataacattcctttgcctgaccaaagcaaaataattcactcttgtgaaaatttatttttaggccagataacttttcaaataccgataaaatcagtttcaaattctttgcctgttgcaagtcatgctccaaaaagatgatagtatcatctgcgtattgcaagatagacaaaccatcatcaacaagatgaggaataaccccattcaagagtcccgcctctttagccctcttaatcaatagagtaagcatgtcagctactatattaaaaagaataggagataaatgatccccttgcctaagacctttgtaagtttgaaaaccattaccaatttgatcgttaacttttataccaacatgaccaccttgaacaaaaaaaagctatccactcacaccatctagaagaaaagcctttcattctcaaagtttgttgtacaaaaggccatttaactttatcataagctttctcaaaatcaatcttaaaaattacaccacttttatctttgcgatgtaattcatgtaaagtctcatgtaaaataaccaccccttccatagtatttctcccaggaatgaacacggtttgagtaggcctaattaacttttgagcgatagctagtaatgttgtatgcgttacttacgtcgtttttggacatatggctatagcattcgtctttcacttttacagggagcgctgaattgtatagagacgatcgaggattctctgtagcgacaaccacaattgtggcttcaaggagatccaattgcatcgatccagaacatctctacacgt

SEQ ID NO: 52933 - DNA, 856 bp, Oryza sativa
acaaattactcatcagtctaaatgtaaaccatataacttctgttccgaaaactgtagcctcatgtgttccctatatgaactggtcatcatcattcatatattgggtgacattaaagaatcaaacatgcatcatatcatgagctacatgactagtttgagtattgtgctgtccaagttattgacttcgaaataaactaaatattattttttataggacatggattatatgtacatgttgttgtgttcaatatgggtgactatgggaacgagaggcaccagggaaaactggagatttttttttatggacagcaaaagagctccataacataggatcaccagagaggaagagtcaccgttattattcacactaatatatgttacctcagcgtgagacggcagctactagttgagcctcttcttcatattgtgtgtgttggcttcacttggacaacacatggattcattaaatctagatggctgccaaacatatatagaacaatggatcgagtaataaagaaaggagttgcttcatagctttgtgtttgttgctcaatgtagccacgttaaaccattagttagagcaggtacaaatcagggttttcaagtacttttgatttcacttaaaatttcggccgtttcggtagcactgaaaaattcccagaattttgtgattttcggcaccttttgaactgaatatttttgaaatttcaacacaattttattgaatttgaataaagtttaaccaaattaaaaaagagagagaaaagcgaaaattttggctgagataatgacttccaaggggtccaaaattgtcgaaatttcgaaccgaaattatattcactgggtataataggga

SEQ ID NO: 52934 - DNA, 348 bp, Oryza sativa
atttcaaattcgagttcaaaatttggcttgaaagtcttaaaatttgggtttgaaagttttgacatttcagacgaaaattttgaattttcagttgaaagttttcaaaaatttgagttgaaagcttcaaattttaggttgaaagcttcaatgttttgagttgaaattttcaaatttgagctgaatgtttaaaaaaaggggttgaaagttttcatatatgagtgcatatgttaatcacgttacctaattaaaaaaatagaactaataatgaagaattataacagtagtcacattgtagattgatttgcctcacatgccgtactgcctctttgcctcgattcctatactagc

SEQ ID NO: 52935 - DNA, 1501 bp, Oryza sativa
tacctaacttacaaccaaaaatatcagaatattgttcataacattcctttgcctgaccaaagcaaaataattcactcttgtgaaaatttatttttaggccagataacttttcaaataccgataaaatcagtttcaaattctttgcctgttgcaagtcatgctccaaaaagatgatagtatcatctgcgtattgcaagatagacaaaccatcatcaacaagatgaggaataaccccattcaagagtcccgcctctttagccctcttaatcaatagagtaagcatgtcagctactatattaaaaagaataggagataaatgatccccttgcctaagacctttgtaagtttgaaaaccattaccaatttgatcgttaacttttataccaacatgaccaccttgaacaaaaaaaagctatccactcacaccatctagaagaaaagcctttcattctcaaagtttgttgtacaaaaggccatttaactttatcataagctttctcaaaatcaatcttaaaaattacaccacttttatctttgcgatgtaattcatgtaaagtctcatgtaaaataaccaccccttccatagtatttctcccaggaatgaacacggtttgagtaggcctaattaacttttgagcgatagctagtaatgttgtatgcgttacttacgtcgtttttggacatatggctatagcattcgtctttcacttttacagggagcgctgaattgtatagagacgatcgaggattctctgtagcgacaaccacaattgtggcttcaaggagatccaattgcatcgatccagaacatctctacacgttgatacccaactaagcgttaattagtttactcaattatttccatacaacgatctcggtgaaaaaggatatttgtgtgctactatgatctgtactatctaccatatgtgctcctacgttgtatgattcttttttttttcgagggagatctaacctatagatggttgtacgtgtggttgtacactcaaacataattattcaatccctcgaatagttgcctgttttaattatatatgtgagttgcatgtcaaagttgttatttttaatgaaaaactataattaattacggcacgggactcggatggcatatttgtgaaaccacaaagtaaaaagcttactgcaaaaaaaaaagctgaggagagcttgcgcaggaagatagcttccgccccttcaccacttgaagataggagccaacggtctactaggttccagggtgaagtgtcatgaccataacttgtactcaaccccaaaataaatactactacttcgtacttcctgtgtttcacaacccggtctcttttttcaactcacctcccttattttccacgtgcatatactctccaaactactaagggttacttttttttataaaagtttctatagaaaagttgctttaaaaattatattaatccattttcaagtttattttagttaatacttaagtaatcttatgctaatacga

SEQ ID NO: 52936 - DNA, 1501 bp, Oryza sativa
tatgcgttacttacgtcgtttttggacatatggctatagcattcgtctttcacttttacagggagcgctgaattgtatagagacgatcgaggattctctgtagcgacaaccacaattgtggcttcaaggagatccaattgcatcgatccagaacatctctacacgttgatacccaactaagcgttaattagtttactcaattatttccatacaacgatctcggtgaaaaaggatatttgtgtgctactatgatctgtactatctaccatatgtgctcctacgttgtatgattcttttttttttcgagggagatctaacctatagatggttgtacgtgtggttgtacactcaaacataattattcaatccctcgaatagttgcctgttttaattatatatgtgagttgcatgtcaaagttgttatttttaatgaaaaactataattaattacggcacgggactcggatggcatatttgtgaaaccacaaagtaaaaagcttactgcaaaaaaaaaagctgaggagagcttgcgcaggaagatagcttccgccccttcaccacttgaagataggagccaacggtctactaggttccagggtgaagtgtcatgaccataacttgtactcaaccccaaaataaatactactacttcgtacttcctgtgtttcacaacccggtctcttttttcaactcacctcccttattttccacgtgcatatactctccaaactactaagggttacttttttttataaaagtttctatagaaaagttgctttaaaaattatattaatccattttcaagtttattttagttaatacttaagtaatcttatgctaatacgaactttgttttgtgtgttggccaatccctcctctcgaaaacagccttggtgtattcccatggtcttggaaccagctacgaccatccccccttttttgttagggttaatcagatccatgccattgcaacttttatggttttgaaatataccattactattcatctacttagagtaatgccatttcaattttactgttatttgaaatataccactacttaccccttcaatgtattttctaaaacttttagaccaatttacccttgtcttcttcctccgtctcctcttcttcttctccaacatatgcatcccctttcttcacccagtgatgccgaccagccggtgcactgatgctgctctctgcgcgagccccttcctgcggggcattttcacacgttgggccgtcgacgcgatgggtgacagactagagctgtgggagatatcctcgtcagcgaggaggcggaggtcgggtacgaggtgctgcagctggtgctcgaatccctcccgttgccgtgcccgtcgcaaagccaagccgtccgaggaccaaccaacgaccggctagtaacttaggccaccaatttgattccgctgcatcttaattcttctatgggaaatcaagtgctttggtggatattgatacatgcaacactgtagcaaca

SEQ ID NO: 52937 - DNA, 173 bp, Oryza sativa
aaaaccagatatatgttcaattttctttgatattgtgttgtagtaatcttctatgctaaatttcgagttgccagccatcatgatgttccctttcaccctaggctcataatatcgcgacgacttagcaatgatatgcgctatgatgaattcaacgcttaaatcctaatggtgtt

SEQ ID NO: 52938 - DNA, 1208 bp, Oryza sativa
catagcaaccaaatctaacaagtgaagagaactaccccactcccgagaattaacatagtcaaaccagctaacttttccatccacataactgcgattgactcccattccacagaaaaatccaccatgatgaatctcaattgtgaaatgcttcgaattagggcctacccatggcaaataaaacaaaacgatcaacaaccaactaaaaccctagctgcaaccctaactacccaaatagcatttcataaaaaaccctacttcccagctacaaaccatgcagatgagtgctacaccacaaggaagtgcggtacttacggtacacgggcgccgcctcagcttctcccctcaagctgaggtccatcgtcgcctgtgcgccgacgccagcgagggagccggagcacgccgctgcctatcgcccgccgacacttgcgcaggtggatgcgccgcccgaatcgcagccgccgccgatgatccccggagtcacctactcgccgcttcccctccctcctgagctgaggattggggaaaaataggagagaggcatcggatttgggattttagggtggtgtctaggctttactgtagcaataaggggtatattgcaattattccaagcctattggttgcggaggagggtatctgcaaaacgggtgcttgcgtggcatgccacgtcggcagtctgagccagaagtggggtttgaacctgccatgtatcattaaactaagatggtggatttgactctgcaatttacaagattgtggacctaagtaacacccgcgctcaagtttaaggaccggccatgtattttactcaaactaaaaatatacactggacggcacagttgatccatcatcctctaaaaaatatagcaaaaatgttggagaaacatatcgtcacgttcaaaactaaatttcaccacgaagaaattgagaattcactgcttcaagagttgaaaataggtagaaaactaccaagctttagtgacaaaggaaaataagcagtgaaatcttaagagcgtcagccataggtttactcagaattttacatttcagtgcaattgaagtacttttgaaagaaaatagaatagatcacatgttaacttgatcaaagtccaatttccatttattctgcattctgaactttttttatgttgtatatctacagtaatgaacattggaatcataaaaaaaaactgaaacaagctggaatg

SEQ ID NO: 52939 - DNA, 1501 bp, Oryza sativa
gagtttatttgtgctaaggcatggctgcagttattttactggtttttttagaaaattacctctctccagggtacatgttgcgaaaatgtaccggaccagctattcttgcttgagcaggtagatggaccatcaagtgtatcataatagtaaaaaatgagggtaggaatattttctcaagaagacatatggtctcagctatttctgcctctagtttttgcatatcacttacacggataacaggcgaatatatttgcttaaaaaaattgctcacacgaatcagtgctgcactaacattttctggtaatatccttctaacagcaagtggaagcaattgttgaaggataacatgattatcatggctctaagtccgattatctttttctcattaacctggacattgcgccgtatatcagaggcataaccatcagggaacttaactccatttaacactttgcaaaacaatttcttctcttcagaattcattgagtatggggctggaggtaaataaaatttatcttctacttcaataggatgaagatcacttcttatgcctagagcttgaaggtctaaccaagaatttaagttgtcttttgacttcttgtcagtacccaagagtgtattgattatgttatcacatacatttttctcaatgtgcattacatcaagattatgacgcaaaagcaagtccttccaatatggaagtttgaaccaaatagaccttcttttccaaatattaattggctccccctccttacgctttctctttttcgttaccttctttccagatggatccttcccaaaagatgtttgcatcccttctgtctgcttcaaaatttcctttccagaaagtggaacaggtgctgactcaagctcaacaacaccatcaaaagaatcagcatcaaatctaaatgggtggtttgcatgtagaaacctacggtgtcccatgtaagaagtcttgctgccatttttcaatcgaagagagcgtgtaaattgatggcactcaatgcatgctccctcacctgaggtagtacaaccagccacatacccaagaccaggataatctgaaatggtgcataatatagcagcacgcaactggaaatactcacccttggaggcatcaaaagttctaacaccatggacaaacatatcgtacatatcatcgactagtggctccataaagacatccatgtcactaccaggagcatatcgaccaggaattaacaaagaaattatgaagtttggttgcttcatacagatccatggtggaaagttgtatggaattataataacaggccaaatgctataagaaatattcatggatctgaatggattaaacccatcggtagctaatgcacatctaatattgcgaggatcagaggcaaattctgggtgcttatggtcaaaatccttccaaagaggagaatctgctggatgtctaaccaaaccatcttgtgtgcgctcttcatcatgccatcttgttagagctgctgttctagagcat

SEQ ID NO: 52940 - DNA, 1501 bp, Oryza sativa
ttatacacacacttcttcctcctcccttctccttctatatcaatagtgatccagcgtgatgggggcttgaacacccagcactcacgctatatctgcccgtgcacacttataatcttatatggcagctcaaaggcaaacaaagctatatttatttatatagatttaactaagaactcaatgaccatactccttccgtactcgtaaaggaagtcgtttaggatcatgtttaagtcaaaccttgggaatataaatcatgaataactctcaagttgttcagtttgaaaatgtaaaaattatatgaatagatttctcttgaaaaatactttcataaaagtatacatatatcacttttcaataaatattgagtttgaaaatataaaaattatatgaatagacttgtcttgaaaaatactttcataaaggtatacatatatcacttttcaataaatatttttatagaaacaagaaatcaaaattgtgttttggagaccgtatcgttgtctaaaacgacttcctttataattacatagggagtatcttatttagcgctactgctaatcgtttgttaaggctccactaaatgttacaaaaatgctatacgtctgaccattatgtccgactcttgtacgaccgtaacactagcgaatgcatggcgtcgatctctacaggactttgcctcacggcgttacgtgcccagctgatttcccgtttagtcgtacaccggtcgaacaaacaagtcggacatatagcatggttctaaatgttatgtgtaaaaggaggcttatttacttcatccttttgagcgtagacttatctatcaaaaggtgatgaagggaccacgcgaagaatatggcattcaatattaaggtaattaaataatttgtctatcacttttcctactctttgcacttacatttgtagttttatgtttattctttcgtcatcgagtatcacaatcatagttactgtatgctataattatttgtcgactaaatctgcctttcatctttctgttcttggagattcatggtttgcaccaatttgattgataccaatttgctttaatttcgtcgtgattatgtaactccttttcagttggtacttaaaccatcgatccatcgatcatagtacaattccggagcaacgcggggtaatctagtaaattagttataaaatgaaagggcgttgcatttagcattatcatccggtgctgtccagttttcggtggcccatgctataaaatggtcattcaatatgctctgctggaagatgagctgcaaacctcttactgtttctgataatcttcctatgatattttatccattatctgacaataatttgtctgcggaagctagctaggaccacggccatttcccaacaaactcatcacatgctctccttgtttgttgcaagatgcagatggtggtaaagctgtaaataatagtggtggtatacgtggtacggtgagcatggaggggcaaggtcttgtgagccggagctg

SEQ ID NO: 52941 - DNA, 1501 bp, Oryza sativa
aaacaccatgaaaaatcgtttttctagtagtatcatagcctcggagctagaacgaaatgaaggaggtgcctcttgcttaatttactttactttaaatcaagtttaagttggtgcaggtgcctaagtttacactgagagaggtgcacacatggtgaagatatgtgaagtatagcttaaaaaatttttttgaccagattcctggtaacccccttacatactctacctccgcccgagtcataggcaggtgcatatatatatgccattgagcaacagccacatatgctgattgtgattgcttaattacaggataataacagaaattactgtgttttcaaagcagaacatggctgttctttgatttaaaagtgtaccatatatataaaagaaattcccccgttacaatatgcaggttaaaaaggtcgatgctgctgatcttctagcattacagatactagtaaacgtgaacgtgcaaggcacgtttcccacatcatgtcacactaatcatgtaaaatcacccgaagattattgcttttttccacaatatatatcacacccaacatgtgaacaaccaaagttcaaaaattacatatatattgtagtgtaaattgcaatatcttaataactctttgcaggcactttttgtaaataccaaaggtcaaattagcttcaggtaagactatacaacacatacattcatcctacaacattctctagtttgtcaaaagtcatggacgtgacatgctttcaattaaatatactgtacattcttgcatgtatcaatagagttattcaaggtagctgctcgtcctgccacccagtatgaagggtcagtttttactgttggtgtgtgttggtgtgtgatccagctccttctgtagcatcttgttacattttctatttataaaacatttagtcaaataatgaaatggatttcctatggttaacatcaatgaaacagattggatagaaagagaatgcttaatggtatggttaaactcatgaattagcctgcgaaaatgcatgaaagagaataactcaatgaacaatgtacttgaccatgcaaaataggactgaaagttacccatatcaagaccaaataatggatcaatgaaaaattgatccagccaacattcctgcgtcttgccatgttttttacatgatgacatggttctcctagaactgcaactgtatatgctgcttcacgcccatggatagccgcaatcaaattagttaccaaaccatgtgaaatgtgcaccaatagtgattcttcttcataagaagtatatgttgattcaattatctgcaacacacattcttctctttaaaagaaagcacattcaaacattatttatttgtggttcccattaaaaaaaaatgtaactcatgaaaaactatgtttaatagaggataacccggcacagattgtgtcataacaccatctagaactacatactgaaagaacctagctagatctacatactaaaaagcacctttgtgctaa

SEQ ID NO: 52942 - DNA, 1501 bp, Oryza sativa
ttttccacaaagggagaggtaggtacagatcaggtgcaaggtagagttgtagtcggcgagcctcaagcgagctctctgctgattttcttggggtaggatggtgtactttgacttctcaaaccgcttcttgagcgtggtccatatctgaacacctatatgggaggtaatgaggaaatgtctaatgcatatacaatatctaaatctaatacaagtgttgttgacattgttggtccaattattagaagcatgtatagaaactagagaagaaaatgcaaacacagtgacctaatatttattccttctttctataaagttaaggccaaaagtttaaaactcgtgcttccacgtcatcatcaaattgtgaaccgttggatgaatgcattagatcgcttctcagacgttggatgctatgcagcatagagcccaacccattagtcaccgggtgagtctcttcgcctcctcagtgacatgtagcccacatgaacacattggcccatctccgtacacatctacatgtatcaagcccgttaatccgtataaaagagctttatgactgaacgccccttcagttgacatgtgctacctaaattatctacaaattttggatagggctgctaaaaataatttctccaagaaagctatttgtttcttctgtttcttcttaagattatacctcctatctaacaaattgatgttaaccaagtcccgcagcaacgcgcggggcatcctctagtttacttaataccgatgttttagaaaatattgtgctttcattcgtgtgttttataattctcataaatgatggattattcaaaggcattcaacatgtgaaggagagaagccaacatctaatgaagtccatttagcactgtggctgttacatggagttaataaatcagaataaacgttatgtcttaattatctttctcatcaccacttgcatgcgtggacatgtccagaacatgcatgtcagtttcttggataacgcctatggaccatcacttaaatagctaagtacagagaagtttgcattctgatttcagaactgaacacttataaaaattgaattatagtgagtctagagggatttacaagctttgttcttttgattcttgagggagttgtagaatgttgaactgcggttcatctgttcatctcacgtctatacgacatgattgtgtgggctagtttcatcggtacttggaagggcgactgcctttgtagttcgtcccgtgtgcaaaatctcgtggtgcattgcctttttgtcatgtcacgtggtgataacaattatatcaagtgttttggtccatcgtgaagatcgggccacaaaattggctcacatgtttcttcatacgcatgtgcatacgaggaggccaccagatcctatccaacaatagcccactattgcattggccaatctatggaatctatggaatgacaactaagctttgccactatcggagcttcctaattcgggcattcgcaccaggggtgcaagtcg

SEQ ID NO: 52943 - DNA, 1501 bp, Oryza sativa
attgaaattttacaaaattagaatcatgccacttccgtctcgttccaaccatcttcttccgttttcttccattttttttctcccgtcttcttcctgagctaccgatttacaatggcatggcacaagaaagcatggcgtgcagcgccccgacgcaagcattggcgttggagaggacgcggcgaagctggacgccgactacggtgtctcgtgcgccgcgccggccggtggacctggaggatgcctgcaaccactggctcggcctcgacacggactcacggagaagccaagcgtcaccataagcaactaggagaaacgggatctcgacgcggcgaaggtcgagtacgcctgcatcgatgcctacgtttcagcgcgagctcggggggcggcggcctcggcgcgggtgcagtggcctccgtgctggcgcagcgtgggcgacggtgaacggcgtcgccatcgacactgcctcccgcgttccccttctctttccttttccttcttctcccctgatgactctgccatctgcagcggccggggaacgcccggatcgacggcgctggcgtggctgtgcggctgcggcggccggggcacaacgcgagcaacggcgacgcgcaccaggctagtagctcggtcatccggtgctgctctcagttttttttttctttttcttttttcgttttcttttcttctttgatggtgccagtcgccgtggggcggtgcgccgcaacccagtggcttggcagccgcagcagctctgcaacgatggcgctgctcggcgaggccgtgcgacagcgtgacgcaggcacggcgggcggcaccttggcgctgcagccttgtcggcgctcggtgtggcgtgacttgtgcgttaccagcgtggactctcgtccgtggtgtcgcatgcgcgggctcgcgaccatggcgcgtcgccggctcatgcacgccgggggacagctcaactcgtgtcgccggccgggagaaaacggaaaaaaaagagatggatggaaacatgacgggcagtggcttgtatcctaattttataaaatttcaatagtatagctacgaataggtgaattgtaatggtatttatctaagtatgcatatttacgatggcatgaatccaattaacctttttttttccctcaaaacccaaaacccgtttagaggctggagtcagcaggtgggcctagttcagttgatccatctaattttcttgctgtgcatacggtgccggtgccgctacagtacctcgacgcctcgcccgtcgccgctatctgattttcctttttgccgctacagttcatcgtacgtcgggttgcacatgtggagaaggaaggcgaagacgatccctagctttacgatctctttctccctgtgcatgacgctgctacgatccagtagtgcttattattagagaaaattcgatccgtagcataggaaaaaacccggtaccaaaaaatagcacgacaaattttctacttcgaccagaagcacatgacactaattt

SEQ ID NO: 52944 - DNA, 324 bp, Oryza sativa
aagggttgtttgggatctgtgtgacttgccttgctggccttggaactcttcaaactcttcttctgcgaaaacggactctccggaaacgacggaatctaagcagaaaagagcaaaatcaccaaaacagcacctaaacaagcatgaacagtatatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaagg

SEQ ID NO: 52945 - DNA, 1501 bp, Oryza sativa
cagaagagcttgtgtttattttaagttataccggagtcatcgtgcaaatattctaaaatccccaatctcatcgatttcctattcaaaaatatcctaccaaagatctattcaaaaatttcttgaaaaattcaaatggatcactatctctccctgggctgaaatcaaccttaacccagcccatcaccttttcttttcaactcctttgcccatctccctctgtttgggccgtgcgaggccacgactattgttggcccagccgaggcagccgccccaactaaaccgctgctcgcttcactcggtccatcccgaaataactaatacgcgaacgttcgggttaattcctactcgcgaacggctcgacaggttggcatacacgaccgtgccacgcgtgtgaatgcaaccgatttccttttgtagctaaactgtgcatgcatatatatgacttccttaatcaccgagctaatctcaatagctcggtgattaaggaagtcatatgtatatggtttcctttagtcaccgaacttttgagactaatcacattggtgaattatgttttataatttgttacacgggacatgtacaaagacgagggataatttttgggaattctcactcaatgcatgtccacatttgctactttgtttttgcccaattgaaacttatttttttttggaatttattttaattttgttttgaaattcatctatatataaaaagtttgtataacgaaagtttttatatataaagtctgtgtatcaaaagtttatctacataaagtttgcatatataaagttcaattttgtgttaaagtttgtgaatagagatattagtaatttgaataggatttatttaaatgaaaagtttaaaaatttgggtaaaaaaattgttgagtagaagatgttgctataaaataaaaaattatgtataccttagttacacattaattatgtggtaatcaatgctttaattataaacatcacactgattttttcggtagcaaaatatgtacataccatcgacatatgcagataactataccctaagtacatgctagctaattaaagtgtcggcatgtatgcctacatgctagtactctagttcttatctagttgcaagatgtgtgtatgcgatgcgcttacaaatcgtgctgctaattaagagcatataagcacgaactgaatgatactaaaggtctgagcatgttcgtgatccgcgaacgttcgcgtattagcctcacccggtccagccaccgctcgcactacgcgcgcgtcgcctcgcgccaccctgcgccttgcttgcgcccgcacgcgcttggcccgcactagccgcgtgccgccttgtacctgcctgctctgcgccgcatgtcgccacgcgcgcggcacacgctcgctcgaagccgcaccgaggaactcgatcagatggtgtagacgttgtcgcacaaatcttaaaaaccgagcaagcaccactgctaccgtcaatctcaatctcccactacccaact

SEQ ID NO: 52946 - DNA, 1501 bp, Oryza sativa
tgcctcccgtagcacctccgccattccccatcgcgccgccgcatcgctccacccatcgcatcaaccctgcagctctccaggtcaggaggaatagatgtccccttcggccctgtcaattccaccaccactccgtgactcctagggctcgtagctccaggaaccagcgcccacgcaccctcccacgctcgcgtgtccactccgctgtcactcttcttggtatcgattctttacccatgcctcattgatgcaatttgctttcttgcgttttctgttcttgcgtgtacgttcttggatttctgttacatttgtatggtggtttgatgtgtcacgattgggagtaattgctgaggttggtgataatatgggataaatctggtattgcttggttcaattcggggtggtgctaatgttctgttcctaaattacaaattacagtggtttgatggcatgtagatttagaaacaactgtatttttgaaattttaggctgtatccaccacagccactaatatgttgccgcagtctatgagctgctgccatcactgatttccactttgccaaggaaccagtagggtggataggtggacagctgctcacctcttggtcgacagctcctccattgcgtgtgtcttgcaaaaaggggatttttatagccgtattgtgaatctgtgtgtatgtttgtgggtttctgtccattgagatatattaggtgatatttttgtgtaaataacaattgatttcccttttgctactggtgatatatatatatatatatttttacgttttggagatgagaaatttcgctctttgttctggatgcagctatcccttgggcttgagtgctgttcgaatgaaccagttggtgtcgcggaagtacatgggctgaatttattaaccaaggtatttggatcattttgatattgatatttagaattttccagggtgtacaagtggcagtgaatatagcactctctgaatattaaattttgaggcagtttacaatgaaatattgtaggtcatcaacaaggcaagcatcagaggaccaaggggatctccatggtagaagtttgaactttacttgaggaaaacagccatatagctggcaacaagcaaacaccaggttagtaatgagatgctttctatatatattatgttctactattgaatattatctgcatgcttggtactgaatgcttgggaaaaaaattatagttgtttgaataggcttcatattttgtgtgatgaaaataattgattgcagcagtagtggttattttggcaagattgccataattttaattgggaactatgtttactgaattgcctgaatgtgaatgttgtatatttgcaattgtttaaacacttaaaacatgcattatgggtctgtatagctgatctgtgaaaattaacagaggtgcaccatggataaacagtggatggataagcctaggtacaacaaatactttcaactattttaggtctctatggtccatacccttttt

SEQ ID NO: 52947 - DNA, 636 bp, Oryza sativa
tagtcttcaaaactaatatctgacttcaaattactcgtatgctataatatttctagcaataaaattataatcatataaaagtaaatttacatgacatgatattattttcatcaaataaaacttaatctataataaaatatttattgatcaaatatttaaagagttgaattttaaaacgcgtgcgcaccatagtgagtgggacggaggaagtatatatttattaacaaattttatcctaaatattttatggatgtaattatagtacaatctagtgtaattacattgtaacttatatgtaattaaaatataacttgtatgtaactttcacataattttgaatcattagatttgttttaagatttgtgcaagcaagcaagaaaagaatcaaagcgcgcgcacacaagagaggattaagtctcacgacgtttgctttacggaaatagcatgttacaaagcgatttttagttatattgtagttacaacgtaattatattataattgtactataataatatctatcaaatttatggaggaaaatttatcaataaatgtatatgtagtctcaaatcctttattagaagtttgactgcttagtaagctttctctcttcattgaattgcttcaaacaatgaaaaa

SEQ ID NO: 52948 - DNA, 989 bp, Oryza sativa
cagaataaagaaccattaagtgacatcatattcatggcttcaccttatttgttcacatagcatttcaattcagtatgtagatagacttgcacaatgtgaattactgaattgcacaactaggattagttacttatgtacattattatagcaaagggtatggcatgccatactgttcttcactatcctctttaagtcaccaagaaagaaaatgtgaagctgccaaactgagtttgatatcagttgtgtcctattttatttataacattgccagcacttcttctccatgatcacctccctccaaatttcttatttgtggccagctcttattattttcttataagtggtgttgatgtttttttgtgtcgtattatcggctattgatcttgcgacttaattgccgatcatatgaatcatttaatgttatcatataattaaccttgttagttgtttttctttttcctccctctcacctcaaccaaaagtctatatagcatgcctctttagatttctcaatgggcaatcgattccccatataatctttctatcatttgaagatcctgagggtatgggtcatggaacttgcgatataaagtactagctcttagttgtcatttgtacataaagataagattatgatggaaccttagtcaaatttatatctgcagatgattctctggaaacatagtataaatttgtgcccctacctgcacagtgctcacagaaacaattccaagagatcacacattacaactcttttcaaaagatcacaaattagagcttggaagtttcagatcaataggatggatgcaaggtgtgcaaacatctggagctctgctgatgcaaggagtgaggaatctgagatgattgatcaactaaagtccatgttctggagcagcactgatgctgaaatcaacttttattctcctgacagtagtgtaaattcttgtgtcacaactagcacaatgcctagcagctgtttcttcctctga

SEQ ID NO: 52949 - DNA, 337 bp, Oryza sativa
catcagccatgttaatctcagtgattatctccaacaccagcaactctatccgcatgcatcaggtggccggcatctgcatgcgtcgcacttatctgcagtagcagatcgatgaggccaaaacagattatgcgttatcacgctcgattcgcggaggattagcgaggccgttgtggtcgtcgctgcctatataaagcagttgacccctcgtcgcggctggggggaagaagaggaacacacggcacaagtgctgcgccattaagcagcaatatgccctagagaggttcacacatgcacccacgtatattcagagagagatcagaaagaagatgcacgccca

SEQ ID NO: 52950 - DNA, 336 bp, Oryza sativa
cgaattcgagctcggtacccataagaatacttgtgtttagacataatgggttaattaaatactagagttgttgaccattgattagccactttttcaagcctatccctacatgtcagtcaattgttgtatcataaccttaatctatatgttgatgcttccgcgatgttttcttgtctaagatagttgttgccgaaatttgcttgttttggcacttatgtgtggttgtttagtggcatcccaggcttatgtggttttctggggtgttacattctctctggtcagcaacaaatttaaggtattttttattaatatttctccattaaaatgaatctgcag

SEQ ID NO: 52951 - DNA, 328 bp, Oryza sativa
ccccgaggagtcctaaccctacggagcgacatcaagcaagctgtcacatgcgacaaggagagttgcgacatggcccaaacccgcgagatggcgtctgcccgagaggaaatccgactggctgcaaccacggcgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggata

SEQ ID NO: 52952 - DNA, 206 bp, Oryza sativa
tgcacatgatttgaaaaatagatcttctcttgcttgtagttttgctttgcacacacgcactttggatgagttgtttttaactaaaaagttgttgcaaaaatatcaaattgcttttcatgctagtttgatgtttaatatgatttctgctaaaaagttaaaacaacctcatgatgttttggattgctcaacatgtaatttgaataaga

SEQ ID NO: 52953 - DNA, 234 bp, Oryza sativa
tggattttggggtctgtaaattatattaatgcagctgccaactttcatatgactttttaagctttaagtacctaaggtcattttgtactttataaaggttttatattaagcactgatggattattatttgtttgaatgattccatgctatgaaaatatatgctattattcttctttttttatggaccgatggtgctcttctaaaactaataaatggatataacattgcaagaaa

SEQ ID NO: 52954 - DNA, 174 bp, Oryza sativa
tagaagtaaaggctttactcatgttgacgttgatgaaaaactaggtcccgaattttcgataggcattgataactatcaatttggtaaaaacttgatacacatgattcgacttatgattaatacacaatccgaacactactattgcaataccacgtctcctaaggttatcaacca

SEQ ID NO: 52955 - DNA, 583 bp, Oryza sativa
gatgttggtgctagaagtggtgagattttgattaaacatgatactaataaaactgtgtttaaatctgctggtatcatgtctaccatgaatgcatcttcttcaaaatccaatgttgtgcatgcaaaacctcctgtttctacttgtgttgctaaatcttcttcctctaacaatgtgtctaaacaacgtgaaaaatatacttgttctttttgtggcaaagatggacatattgttgatttttgtttcagattagctcataaacagaaaaaggagagagagattgcttttgcaaaatcaaagtggcaaaaatcgggttttctctcgaggaaaccggtcagaccgtagtgggtcccgcggtcggaccggcgaccggtcagactggctgaacagcctcggtcagaccgagcaccggtcagaccggcggtacagaggcggtcagaccggtccccggtcagaccggccactgtacctcggtcagaccggcctcggaggaatttttctgaaaattctaaaattgattttgcatgtggatttatgcctattggatcttctggtcgtgtgtctcattactggattcctaaatttt

SEQ ID NO: 52956 - DNA, 814 bp, Oryza sativa
aacaaatagtaccagctagtaagctggttatatggagaaccacacacacacacacacacacacacacacacacacacacacacacacacacacacacacacacacacacatatatatatatatatatatatatatatatatatatatatatatatatatatatatctcatgtaccgcctcctttttttttaatatatgatggcgttcactgttcgagatacgtatgactattcaataaaattatgtaattattatttattttattatgacttgatttatcatcaaactttcttaaagcatgatttaaatatttttatatttgcacaaaagttttggataagacgaatgatcaaatgttaattaaaaagtcaatagcatcatatattaaaaaaacacattaataaacggaggtagtattcaggtgtgcaaatcaatcgcatgggctgatataggtatttgcatggaagccatttggggtgtgattttctttagggccatgcatggagagaatttcttttgtcggtctattaattctaccagctgggaaattaaaagaacaactcgttttcatttgtttctagatagtgaaagcatttaatttgtgaacacctacaacctgactcgcctattctttcatccagttagtcccgtacacttgggtggctatatacacaatttctatagtgatgattaatatatcttgaacggtgtgtatgttttatgctatacaatttttcatcacaaaagagtatgcacagcctaattaagtactatttgaaagagaagaaaagactcccgtgtcgctctctgcagg

SEQ ID NO: 52957 - DNA, 530 bp, Oryza sativa
tttaaagtgcctctataaagtgtctctacactataaaacttctgattttagaagcaatttgcaaaacgtctctacaaaagtgcctctatacgaggtttttgttgtagtggatggatggtcccaacaagtgtaaaatacggaaagaagtccataaaaaaatacggcccatatggaatccaattcatgggacattattttggggaagcaaaggtcccacatatttggaaaaaaaagggggaaaaatccggtccatatgtgatgcgtcaacctaccctttagcagaagcctgataagataaatgttcttgagatcaccaaacttcactattgcaccagtgagaaggaaatggtaaatttattgcatatccaaaaaaattacccctgctctgccctcacattatatttcctctagcttcttacatttttttttgacgaagtcaatatatatatgctcctatatatgcatggtagaagagcaaagaaaaaacagttaataataccgagcaaattgctaccacgggtaaagctttt

SEQ ID NO: 52958 - DNA, 1047 bp, Oryza sativa
gagggagagggagagcgagtggagagggagagaagaatcgagagaagtggagaaccggtcttatctcctctaggtgtgggccccgttgggagaaaatcgagagaagtagtggagaagccggccttacttcacctttgacggccatccgggttgcgatccgtcacaggtgactaatcacctgtgacgggttgaaaatgaaacccgtcataggtgaggtttacaccaccttcgacggtttccacttccggcccgtcacagatgactagttacctgtgacgggccgcggccggatggctcaccgatgacggcatcccgtaggacccgtcaaaggtgaccttcatcagtgaccgttttctttgcccgtcagagatatgccgtcagaggtgtgaggatctggcgtagtgtaattatctcgtggtgaaggagcgagaaggttctgtcctaaaacttaaaaaagtgtattggcataagttcttatcagtatatatgaagcaggataataatgcttaaataattattcagaaaataaaaaaaaaacaacgcaaactgaaaattacacttcgatcatttgtactaataattaattaaacttgaaaccttaatttagattgtgtaagtgtgcgtaggttatgacatttgtgcgtgaatgctagaagtgtacttagatactggtacatatataaaagaaaaccgggcgactaataattaaggaagtagctattttttacttgctaataacccactaattttgtacggtgtggcttctaatataagttgtgagccacaacataggcaagacacaagcaaataattaagtatttaccatgtgcgattatgtggttgcaaagtgtggtttttaaaaactctagcatcaaaccaaattgtggcccaacaagttgatggtgcagatcgagctattgaagaatggactatataaacaaccaagctgctgaactgcaagagcaaaccaaatgcaagtgaactctcttttgcttagatacaaaaattttggcaactttgtatcgatctggtgcaagacaacacaag

SEQ ID NO: 52959 - DNA, 435 bp, Oryza sativa
aagaaaggcttagtgacactatccacattagtatagaacacaaaaagtgtttagtttgcaccaattaatcgtttcacatggttaaaattttacttaacttgggccaaggctactgttagtaaagcaaaatttggttaacactgagaatggagttatgattgaattacagtgagaatgtgaagtacggcgttgatcatggtactgaaattatcgaccaagatttctgctgggttaaagaattttgttaaggtgccaaatggaatggcaaaataatcaatctaaaattacagtgtgttacttttgttgcataatatttttgagaattaattttccaatgagtttaagttgaaccaattattttttataattttcttagacactcaaatgaatatatgaatcctagtgcatataagagccaaaaacaattaaaataag

SEQ ID NO: 52960 - DNA, 1501 bp, Oryza sativa
ctactacactagcaagcggttgagtgcacgcataaagaattcctcagcttacatacggccagacaaatcacctgtacgttcaactgttccaccagtaatgaccacacctcctacgcgtcaacactcgacacgcgggggccactgacccgtccgggtcagctcagttgcgtgtgcgtgccaagcattccgtgcacgcagcagcaagcacgatcgctcgcatcgcgcgcacgggaggcattcgcacggctgatttacctgaaacacacgtactccactcctctgcgatttggctgccgcgcgcgcccgccttgagagatcgatttccagcgagttagtagttaccgtcgacgacgacgacgaggttgatcgagttactacctgttgttaccgtgcggagatatttccggacggtgacaacgaaaatatcctcggttttgctcacgctccatctgggacagcgaggggttggtttgggggaggcagagagaggagggcgaccccaaaaagctaaagcaaagcgacgacgaggaggacgccgacgaggcggcccgctgcggccacgtggcgcgtggcgccggcggggatgaggttgcttcaacgtgtggccacctcgtctttgtgcttgcgccttccccgcaacctagatctttttttgtcctcacccagtcactcgtccgaacacttgtctaatcctcttgccaaactaaaattaaaacgtgcagcatgatagtaaaattaacgctgtcgtgccaataatttcttgacgacaacgacatactacctccattttttaaatagataacaccgttagactttttctcacatgtttgaccattcgtcttattcaaaacatttacgtaattataatttattttgttatgagttgttttatcactcatagtactttaagtgtgatttatatcttatacatttgcataaaatttttaaataagacgaatggtcaaatatgtgagaaaaaaatcaacggcttcatctattaaaaaatggagggagtataatgttgaaattagaggtagataaattttgggaacgaaattaggaatgacttatatctcaaatcataattatggttcagtttaacccgatggatttggacctgaacgtaatttcgaaacttcccaagggtatttcaccaagccgtacgcattatttaaccgatggtgaagtggtgagcacacgccctctcctaaaaccaaggaacccaaccccacaaaaaagcgtaggacgccggagtgcgaaatccttatccgctcgcggcgacgccatggccgccgccgcggtggtccacctctccgtgcacggccgcctccgccgctcgccggagctccacgcccggccataccaccgcccgtcgctgctccggtgccgcgcgttcaagcaggaggccgataacggcggggaggaggcttcgtcgtcgccgccgccgccgacgacggccgaggcgcggaggcgcaggaagggcccgctgtacaagctgaag

SEQ ID NO: 52961 - DNA, 1501 bp, Oryza sativa
ttggagaaagatgcacagcacctgctccaaggtgaaattccaacgtcttactactactaatactcctagctatacttaagtaaactcaaatcatgtactagtacacgtactcctacttgtacttgtactggagcactactagtatacaagttgtactagtagttgtacctttgcttgtgttagactgaacacacctggtgatttgatttggaaacctggatttgtaggtgagagaggtgaaaggctatgcaggaggagagagatagtagagagcagagcagagcagcaaatgcaaaggctcaaatcccaagctagtgatgtgagcatagaaaggcatactctattgccatcttccattcccttttccctttgacctgttgtgccggcaaaggcatctgttcttttgaggagattgatgtaatgatacttcatgtattaccagtacaagtactgcctccaatacatgtactccctccgtcctataatataagggattttgagtttttatttgtacggtttgactactcgtcttgtttaaaaaaatttggaattattatttatttatttttgactttgttatctaaagtattttacacataactttttgttttttatatttgcataaattttttgaataagattagtggtcaaacactataagcaaaaatttaaaatcctttatattataggacggagggagtacaagtaatgctcaaaggagaatttatagtgtcccgtttgaaatttgaccgggcatggttgtctctagatggatgaataatgagcttgtgatgatatcctgggctgtttgtttggcagtacatatgtctctctctttttcagcagagctagagtataaagtgagggtatagttgctttttactccaatttaagtgccattttgacttgtagccgcttgtcaatatgcatctgaacttacctcaagtcacttgagttttgtattatgcaaacggaagaccctagctagtttatgattaagaggaaaatggagcatgtatgtaaccatatggtgaaccatgttactctgatgataaattactcttttctcctgaaaaggtgcacactgatcaattttcaaatttaaactgatcaaaattccacccaataactgccgacacaaataggaacagtactagctcgtatgcatacaatcatgatttccaaatgattgatcccaaagttcaaacgcagcacagcttctctctggctaccaaacaaaccacacctcactctctggtcaatccaaatccccttccaaatcagattcttccagtcttcaaaaaagaaaaagaaaaaactagcgtgataagtcaaaggttggtcagaaccaagaacagtgcaggtacatcacacacacacacacacacacacaccgctagaggccagtgtccacggtccagtgcatgcatgcatgcccaagtgtaattaattaagctcaaattaacccaactgatcgaccattatacatgagaggcaatta

SEQ ID NO: 52962 - DNA, 1501 bp, Oryza sativa
actagcaacatgctcctagttatagaggctgtgtttaccctaaaacttcactgtttaaaacttcactgtttgcctgctcaaacctactcctacatatttctggcaacctagatgagatgatcaaccgatcgatcaggaagaagaagaagacggccgggggaccatatagacgatgcagagtcctacttttttttctctcataaaaaaccaacatattatcggataagacatatatatcatatcctagtaatataaatttggatatccatctatcttgattcatattaataggatacatatcaaattcgtttttatgggacggaggtgcgaagaagacgtacgtacggggggccctcctgcgcggttgcgagacgcatgcatggtgcatcggcgcgttgcagatctgttgcagtggctatccttaattagcttatcccttctggtctctgcgacgcaagccgatcgagccagcgatctgtagtgtgtagggatggaggcaggacggaaggagaagcagagagaagggcgtcgagaggatggtggggatcagagtagcgttgtgtgtgtgcagcctcgtgttttcgttatgcaatgcaaaaatcccctgctgccgcctgcagcctcgtgctgtgtctcctcttctcctcgccccccttcacgtgcagtatatcgatccatcgatggctttgtgattaacggccccgtttttgtcagggtgatgaaaatctcagtcagggcgagagaatccatacgctaatatgcaaccaaaaactattactaatagtcgcagagtcacaggctgaaattacgctgtgtcacctgctcgctgcttatccgtacacaatgcatgcacggctacggttcaagttcacgtcttgtttgaatagcttaaaaatagaattttaagaagcaggtactacctctgtcccaatttaaatgttgttgtggatttctatgttaaatgtttgactatccatcttattttaaaaaagtattaaaaagttaaaaatttagtcacgcataaagtactatttatgttttatcatctaataacaataagaaagtactataatcattattttttttcaaataagataaatggtcaaacattgaacataaacaatgcaaaaatgtggtcgttctagaacggaggtagtatttagtactacctccatttcaaaatataagatacaaccacctttaacctaaaaattaaaaaacaattattatcatcttttagtttggatcaccctaataaatataatacatataatagaattaaagatctctacggtgaaggatttagaaaaagaatagtttagtggagaggaggtgctaattaattgcatgcatacatgcagtccttatattatgaaacatcttgtcgagaaatgagcctctctagcgggtgatcgagagatccccttttgtgagttcggccgggggaaagggcacgctgatcgagatcgagtatccgcttcgagttctccgagaccgcgca

SEQ ID NO: 52963 - DNA, 184 bp, Oryza sativa
gatttcatttcctttttttttcattttggcaattgttgtcatgttattttgtaagtgtcaattgtaacaaacaacatttgcaataatctatgctctggtagattttctgttctattgttttcacattatagccttcttactctcaattttgcgttaactaatgtgtactttcagtgggtaccaa

SEQ ID NO: 52964 - DNA, 248 bp, Oryza sativa
cgatcgatcattctgcgggcactgatccccatcaacgtcggcaaaacaccatgatgtgattaagtgatgatgagctcattgtgccggctagtttagctacagagataatttgaaaaaggaggtccaattaattacccccttaaatatataaaagcctattaagttgggtattggtttagccccttaggctttgttgtttgaagtaaataaccctaagcgtttttgtgagctgtccttttgcttgcagg

SEQ ID NO: 52965 - DNA, 1501 bp, Oryza sativa
tcatttatgaaattagttttttttattagtccatgtttaatattttaaattagcatccaaacatccgatatgacatgggctaaaatgttttagccccatgtaaacactcctaggtcgctgttgacgatcagacgggactaaaaagcagaaaagcaaccttcactaaaaacaacttccaagaaaagcccatgttagccctcatctatccttttgggttctgctttgcacttatggtacttgacctcaggtcacatcatatattatgcatctaaatttggttgcaatttatgggcatgcatatatattgcaagcatgtcgtgtctactgaacctcgtgattgattgaataagacgtttagatttataagactataatacgttatatctatctaaaatcctttatattttaaaatggagggagtggtatagaataataaccagatttggcacatcacctaaaccacgtgatataaggttatataatgatagctggagtttaaaatttatctaagactacaagggtatcttatcaacattttcatctcaacaaacttatttttcatttattctttttaccggagtacttatctatgtaacaaccatctctgacctcaatcttaagctctttgaaaaaaaaaaatcaaatattgttatatttttggatgaaggagtacgggtattcacctcctctctctccatttacaaatattgtgcactatttgacttctactttttttttactttgaccatcaatatatttttgactggttagactaccattagttttaactattaatacatactatagagtgtatgtatgtcttctttattttcacttttttaaatagttatatatatgtatgaaagacagcgtagatgattatatcttcatacatccatttactgacaagtatctaaacatgctgaaacaaatataacaaacatagcaaaaataagcaatcacgttcatacttgggattaccattttgtttgttaaaaaaaatcaaatttgatcttgcatatatattttatcgagtgatatgtgacacaacaacaatctacgttatgtaatgtttttagaatttattagaacctttttggccatactcaattaaccacgtcacatacaactctattcaatcttttcaattacttcatcgtattatataatcttcgcaggcaggagggagatccgcctgcatcacaacgactgcgacaatcgcaacggcccgcctgcgaaaatgcaaaaaaacgaacaaaaaaaatcgccgcacgcggctcaccgccgccgtcctcccccggccggatctgagaggggaggggagctgccgccatcgtcatcgtcgccgccgccatgctccatgccgtcatcgccccgcgcgtcgtcttcaccgccgccccgcgctttcgtcgccgccgccgctcccgccggcctcccccctccctcctccggccaaatctacgagggagggagggaggggagacgccgccggccgccccgc

SEQ ID NO: 52966 - DNA, 1501 bp, Oryza sativa
attcagacacttatatcaacattttttttaaacacccagtacaaagtttcgttttaatataaaagtaaaaagaaaaacattaagtctcatatcaacatatttgaatttctaccgcaggtcttagtctaccacgacttgttagggacgttccaaacaagtcatgccaaggtaaatgccaccttcttttactgatccgacctaaaccattttttacccgttacgattttgctctttgagctcatagtactgaacttcttactctatacctgactacatctgcaggtctcgccaaaattctgtaaacagtatggtaacattggggacgtgattaacagagctctatcaaagtacaagcaagaggtggaaacccagtcttttccgggtcctagtcacacgccctacaaactagctgccacagatgttgatgcctttctgaatgcgctgaagatgaagggcctgaatgtggctgctgatgctgcagccgatgctgttgaatatacagatgagaaagagataaatggaacgccgcagctcaaggtctatgcttgattgttcctagctagctagcaatggatgaatagcaatatggtttgatttatcgcaaaataaataaatgatttggttgctgaatgaagctgaatctgaatctgaagagtgaagacccatcaagtgttatgatcttctttaggtgtatttgaccatggatgcatggggatttcttattttttgtgaagtataacgtgagtgttgtatgcatgaagtatgtatggggagtgcactcaaacctatcagatagtagattccattggtgacaaagttataattatgtattctgtaataagttcatcgtatgctattgttgtggttttggaatgtgttcagcaaaatttgtagcaaagtagtactcctacttttttataagatagtcgcatgtttataaaattatattagatcccgcaaaaaaaaaagatattagaaaaaatgactttaatgaatgttcactttgatggcctagaccatgttaactacataagtaaatttcactaaactacaaatgttcttttatcaaactatcataaaacgttagatttgatacattatatcataaaaatacatatttagtgctaaatgtattaaaaacaacatatttatcaaactgcatattgaggttcgaggacatcttttttttccgccccaaactcagcctcaacctgagggacctcaagtgaacttatttccaaaccatccacatcggttaggtttaggtgggctgaaaatccaaatatcctgaaaccaaataccagcccaatgaaactacatattcactcgtgactcgtcgtcacccgtcccaatccaaacccccacccaaaacctctcggcatcccacttgtccccgtcgctctctctctttttcgccgcctcgcctcgcctcgcaccaatcaccacacgcgcaccgcgcactcactcgccgcgcggcgcggcgcggcgccgcctcacgcgg

SEQ ID NO: 52967 - DNA, 194 bp, Oryza sativa
aaacattgtggccaattatatgatacgcatgccaggaaatgcttgccagctatgcataaactgtttggattctattgacgcttcaaaaccctctcgtggtgatctaaattttggttagattgccatctacatcaactatttgatttattgcgatttggatttgctattataaaccgtctctatcaaatgaaagg

SEQ ID NO: 52968 - DNA, 553 bp, Oryza sativa
aacgtgacaggccacacctgaaaatatgggctgcaggcatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggagaataataattggtccagtctttgagcatagaaaataaactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgtataacca

SEQ ID NO: 52969 - DNA, 617 bp, Oryza sativa
atactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgatatgagttcgtcattaatggaacaaagtttcacggattagaatttactactcaggtacttttgcaattattaagagcagaaaataaattatcttatctctatgcttttgatttattccgaataatacttagcaccttgcgttattcggtccatccaacgagcccccgggtgctaggaatcggcccaaaggcaaccatccattggcaaaccgaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtga

SEQ ID NO: 52970 - DNA, 1501 bp, Oryza sativa
ctcaaagtataggaacagtgaactagagtattcttcttctctggtcgtggttcttagaaaaatatcaccatcatagttgtttactatccaaaccaatgcacgcaccgtctagcatatatcagattaacatatgcaccaaacttagtttcacccatctggtccatacagtgaataaagcaaactttataggtctataggtacatccaacccaaatttcaaatttatttgcacagagaacttaaagcaagcatattagtgcaaatctccactccccagctaggtgaaatcatggtaattccattgaatctttatgtagagaccaagttaacttctcagtaagtagcattccagagaaaaacatcatgtaccacataaattatcaggtaaaatccatttttatcccttgaactttcactaaattcctattttcaacctcaactacgaacccatatatttttcaaccccaaaccttaaaaaccgggtcaagtcccaagactaatattttaatggtgttttttaccacatctaaaacaacaaaaatatgttaaactattctagttgctaatattatagtgactcaacatgccaaacatttcccggggaaatccacccccccccccccccccccccaaatcttcaatcctcacacaatgtagtgataagagaaggagatgcaaggaagaaggatataaagcatatgatatgtgaagcaatgccgtgctagcaaccaatatagcatagcaatgtgattctcaacatggataaaaccagcaactaaaaacaatcatgggagaagtttgtctggtttcaaaagtttaggctgttttatagttcaaggtgaaagatgaactttgatggaagtttgaggcctaaaaatggactttaccctaaatgaactcggtagccacataggagcacattttgatgataataataccctacaaagtacaaatgtgcatatcccttcaaaaaattgcattgaagattgaaactttggaagaaaaattctatatttcacctgtcctgataaatttatgctggtactttttaatttcccccatgatgaattgaactctagtctctaggcagccgatgcgaaattcgatttcttctacaagaaacttataactatttcagttcaagttgcaacataagtagcaacacagatagttgagaccttgagcctccgtttggctacgcggtggattcagataatcccaatagctttacaaattttggtgtctggcaaactgatttttcctttagtttggtgttacaaagggtaatattattacagtttgaaaatataaaacaattgagggaattatgagggttagataacatattttaaaacaattcgatcggcaaaacaaacaaagaaagattgtaagttttagtttgcacagcaatttaaaaaaggataagcacagggcagcaaccacaaaccgagcctgggaattagatcgatctaaaggggggagaggcggcggattcaccgaac

SEQ ID NO: 52971 - DNA, 800 bp, Oryza sativa
agggagagggagagggagagagagggagagagagagagttaattgaaaatgttaaggatttgaggtattattactagaaactattggaatatatggcgtggctttgagccttcggatctgcgatgcaaagtttgtagattagatgaatgacagctatgagattcgagcttttctgtgacatccatgaagcagatttcaacaggaggagaggaacagtccatgtgttccttgtgtaagtgagtgaagggagtttggggctaaaaacctacatgacatcaatgaaattagcctaatgaaacccctctttctagttcttcctacttccagttctcgaagcattcccatatttcttgtttcgtgtctcagtttgatctcagatcaccataatcttcccatggacaatcttgactagttagttcggtggtggagttctcatgttgttgcgattcttttgcaataggaaatttgtgccagctattctggataaaatgaacacatggtattctgttggtagcagatttccatcagaagtttccccaattaaaattggtgctaccatccaaactgtattttagtgtacaaattacagtgctattcttttggagaaagacgtgtcatggtatggatatgatgtcttaacctctaattcggcaattcgaatacccaagctgaaaatccaatgtccacaactgcataatcatgtcttatactgacattggaatcattacatggcaaccaattagatctacatgagaatatatggaattgcattacattaacaactgattttctgttacagg

SEQ ID NO: 52972 - DNA, 198 bp, Oryza sativa
atataagggattgaaagagttttgaggtgcacacaaggaattttctctatgtatgtactatcagggcaaacttctgtattcttgtttatttaaccttggacgatagtgctctagaggtaatatttttatcgtggtggtgtggtgccctacactacagttattgttctgtaatttctcatttctgttgtcattttcagg

SEQ ID NO: 52973 - DNA, 1501 bp, Oryza sativa
tgataagcgggtggcgatgcggttcgagggtgatgatggatgagagggagattgaccatagcgccacaggttttcccctctattcccttctctcctcaacccaatccaatccctcgtacctgttatgaaacaacatggtgatctaatggatcgcaattgaaggcaaccgcgcctcttctctaggcgctccttgacaatagacacgatgccactccttccccatctataaattgtactgcactgatcaataaagaaatccgctcatttattccctacattcttgtgttaaattctctctcgctcaatctctcaatctctcgctcaatcaattctatccacgttcaacacgttattagagagcgaaggcgaaggagatcgcgaagtgaaagaagggagaaacatcgcttttgatctaacagaaaagcaaatagaagaatcattagagaaggtacgatacctatcttttcattggatcatggatgtcgttctcggcctccctcgccatcagcgcgcatgccggctctgccattttcttcgccgacctatgaggagcacacgctggggatcacgcggaggcagggctagggttggtggccgccgccactaccctcgccgccatgtgactgcaactccggttgtggttcccccgcccgtccctgttgtgcctcctcctccgcctccggttgccgaagcacctcaccggatcctcgtgtagggggtgcagtactgcgcccaccacagatggacggcagtggtgacactacccggcgagccatgtgctcttcccccggagatggagtcgcagccgccaccatcaaccgctccttcaccacctccaccgacaccaagccgacgccaacgccgttcccccactcccgcgccagcggggtctggccggaccggtaccctggctgcgcgcacgggggagccgcccttcttcaatccgtcctcgtctcgtcgtcacgccagtgaagccgccgctcgccgtcccggcctccgccacatcttcatcgccgtcccccatggctctcctagccgtacactccctaacggggtgctggggaatggcgtcagggctcggccggcctccgactccgacgaggattgggagccgtcagcctaatccggctggcaaaccgccagcggacggaggggcggtcggggcggtagtggatggtggatggcgacggcggtggatggcggatggcgacgacggtgaggcggcagaggaaatggatggagacggcggtggactctgtggcggtggcgtcggcggcgcccccaacggcggcgtcggcggcgcacctcggctgcgtcggcggcgttccccacggcgacgtcggcggcggatgaacggcgcccccctcctgcctttttattaatttacctctgtaaattgataatgttaaccatgattgtagggacatggcaacaaaagagttcgacgaaatcgccctcgataggactaactatcccatctgggcttccgatatcaaaatca

SEQ ID NO: 52974 - DNA, 1501 bp, Oryza sativa
gcccctagaagatgaagggttttggtgtctagctcgtgcctgccgtcaaagtgcctgtggtcatcgccctagtcttccggtgtttcccgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagcaatattttcaaaaataaaaaaatcctgtcttatttgtgaaaatcctctagtctctctctgtcctgctgcttcatttatcgccaaaatctgacctttaaaatgttgtttttctttttgtttttgtttgtagatggccggcagcgtcagccgtcgtggcctggacatgactggtttcgtcttggagctgcggggcatgtgcgttgtcctggggtatccacatggagtggactaccagggcatgccgcttccggagcaggagggtgacgatgcagagccccacgctgcttgggaggttactgcagtgatcctcactggctctcccgagcggacttcgttggcagtcaccgcaggtggagattctttccccgccgcttgccagaacgccgctctcctcgccatcggcactcttcaccagcgctacccggacgagttgcagcactcgccctaccgctaccaccctcgccgcggaggagcccgcgacttcgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgcatcagctcaagatcgcccagggagaggtctgtcgccccaagcgccgccgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcctgtcgcagcggtagacgagcagttagtaggcttgcgcgtgtgttctttctcgtttgtcttcttgttggagtcgtgtggggcatggttatgccggtgtgtggcataactgtgtcggagcctgtctttattttatttgcttaagcaacttgaactttaatgaaccaatttaatagcagtaataaattcaagaattatggtagtcgtgggtggttagctttaattgtcagctctctctgtttgctggttttgtgtggggtttcc

SEQ ID NO: 52975 - DNA, 1501 bp, Oryza sativa
cccaagtccagaagaggagctccttgaagataaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaaaataaaaatcctttattatttgtgaaaacccgctattctctcttgtcttgctgcttcatttatcgtcaaaatctggcctttaaaatgttgcttttctttttgtttgtagatggccggcagcgttacccgtcgtggtttgcacatgactggcttcgtcttggagctgcggggcatgtgcgtggtcttggggtatccacatggagtggattaccaggccaggccgctcccggagcaagagggtgaggatgcagagcctcacgctggttgggaggtcactgcagtgattctctccggctctcccgagcggacttcgctggcagtcaccgcgggtggggattccttcccgccgcttgccagcgccgctcttctcgccattggcacccttcaccagcgctacccggacgagttgcagcacttgccctaccggtaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgtttttcctcgtttgtctttttgagttgtgtggggcatggttatgccggtgtgtggcataactatgtcggagcctgtctttatttgtttgcctaagcaacttgaaccttaatgaaccaatttaatagcagtgataaatttaagaataatagtagtcgtgggtggttagttttaatcgtcagctctccttctctgtttgctggttctgtgaggggttttc

SEQ ID NO: 52976 - DNA, 1501 bp, Oryza sativa
ttccacatgtctaatgggtaaggcttagtttgtggctcagtctagtcttaaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattccgcatttgtgggtgtgtcttgttgagtacggtggttgtactcagtcttgctcaatttttcccaagtccagaagaggagctccttgaagataaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaaaataaaaatcctttattatttgtgaaaacccgctattctctcttgtcttgctgcttcatttatcgtcaaaatctggcctttaaaatgttgcttttctttttgtttgtagatggccggcagcgttacccgtcgtggtttgcacatgactggcttcgtcttggagctgcggggcatgtgcgtggtcttggggtatccacatggagtggattaccaggccaggccgctcccggagcaagagggtgaggatgcagagcctcacgctggttgggaggtcactgcagtgattctctccggctctcccgagcggacttcgctggcagtcaccgcgggtggggattccttcccgccgcttgccagcgccgctcttctcgccattggcacc

SEQ ID NO: 52977 - DNA, 1501 bp, Oryza sativa
ctcggaatcaatcccgcaaacctcgccggcgtattcaatggagccgagatctccgcgcccgtttcctctctctccggccgctctctctccctcccgttgctatataattgctccccgagctccgctcttccgtttccgccgctcgccgctcgctctcgccgtcggaatcgtgctcgcgccgtgctcctctctctccgccgtcgccgccgagctccgttccgccgccgccgccgctccggacttcctccttactcggcgacacctccgtccgcttcgccgagtggttgccgaccccgtccgccgctccgcttcgcccgccgaccgccggagcaccttcgtcatcgtcatcccgaaccgcgccgccgcttccctccactccggccgccgttctcgtcgtcgtcgttgtcccggggtgagccgaagaccgccgttcgccttcccccttccctcctctctctcgggcgccgctccgccgcgccggtggtcgccggcggtgaccatcggggcgcgggtgcgcgccgctcccgtcggccgtgccggcgaggccgccctcgggcgcgccctcgcggctgccaagtgggcccggccgtcagccgcccacgcccgtgggtgcggctgacgcgcgggacccacggcgccgaccgccgccagccgcgtgcgcccggtccaccgtggaccgagcggctgacgcgtgggcccccccttcccgtggacccggtccgcgcgcccgcccctcggctgacgcaataaataggattttttttaattgaaaaataaatgaagaaattcgcaaatatccatttaaagagcataaaaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatatgattattgtcattgttattattattaccttgttcaccctagatcaaacaaaaccccaactagtggacactctactcatgacaccactagtttaattctaggtagatgcttcgcaatttaattaggtaacattaggaggttttacaactttagactttgggaattctcatatcatttggacactttggaattgttggtttatggtggaattggacacacacctctcttcctctttcaaaacccctaaaacctgttttcggtggggtttgggtgcatgccagttgtgggaagtagcaccccggccactataaggattaa

SEQ ID NO: 52978 - DNA, 242 bp, Oryza sativa
agggggggggggaaaagaacttcttttaggattttctttttataaaacctttttaactttgtttatttcttttcaattattatttgtgctctgaaaattccactaaaatttatttaagcattttaggcttttaggaaatatacaaaaatcctccaagcctcatttgacttttatctttgcacattttaattgttgaaggctttcacattgaattttacttattcttttgcacaattttgagg

SEQ ID NO: 52979 - DNA, 1501 bp, Oryza sativa
aatcaaaaagttcaaaaagagcccaaacatgatttttggacaaattggagtgtatcgggtgggttcgtggcaaaaacacatttcgtgattcgcgtggcgaacttttgtgaaataatgtcaatattggtatatattggcccacacgggtgcgatgtttttgaccggaatgaaaatgttcaaaaagcaccaaagcatgatttttggacatattggagtgtattgggtgcgttcgtggcaaaaactcacttcgtgattcgcgcggcgaacttttgtcaattaatgccaatattggcatacgagggtgcgatgttttgtactggaatcaaaaagttcaaaaagagccaaaacatgatttttggacatattggagtgtattgggtgcgttcgtggcaaaaactcacttcgtgattcgcgcggcgaacttttgtcaattaatgccaatattggcacacgagggtgcgatgttttctactggaatcaaaaagttcaaaaagagccaaaacatgatttttgtacatattggtgtgtatcgggtgtgttcgtggcaaaaacacatttcgtgattcgcgtggctaacttttgtcaaataatgtcaatattggcatatattggcccacacgggtgcgatgtttttgaccggaatgaaaatgttcaaaaagcaccaaagcatgatttttggacatattggagtgtattgggtgcgttcgtggcaaaaactcacttcgtgattcgcgcggcgaacttttgtcaattaatgccaatattggcacacgagggtgcgatgttttctactggaatcaaaaagttcaaaaagagccaaaacatgatttttggacatattggagtgtactgggtgcgttcgtggcaaaaactcacttcgtgattcgcgcggcgaacttttgtcaattaatgccaatattggcacacgagtgtgcgatgttttctactggaatcaaaaagttcaaaaagagccaaaacatgatttttggacatattggagtgtattgggtgcattcgtggcaaaaactcacttcgtgattcgcgcggcgatctattgtcaattaatgccaatattggcacacgagggtgcgatgttttctactggaatcaaaaagttcaaaaagagccaaaacatgatttttggacttattggtgtgtatcgggtgtgttcgtggcaaaaacacatttcgtgattcgcgtggcttacttttgtcaaataatgtcaatattggcatatattagcccacacaggtgcgatgtttttgaccagaatgaaaatgttcaaaaagcaccaaagcatgatttttggacttattggagtgtattgggtgcgttcgtggcaaatactcaattcatgattcgcgcggcgaacttttgtcaattaatgccaatattggcacacgagggtgcgatgttttctactggaatcaaaaagttcaaaaaacgccaaaacatgatttttggacatattggagggtattgggtgcgttcgtggcaaaaa

SEQ ID NO: 52980 - DNA, 160 bp, Oryza sativa
ccgtgaagtacttgcacgcccaaatcggagttcgcatgaagtcgtggcggccgtcagaagttggtgctgccctgcagtcctaatccaccccgcgcgaatcctcttccctttggatcctctccatcgttcctgagtaaaacacgagtgcacgcgtctccgg

SEQ ID NO: 52981 - DNA, 1501 bp, Oryza sativa
atgaagcaaaaagtcattactctagtaggttcatgagctttactcagggacgagttgaagataagtgttggggtgtcattgaaggtcgttaagtgcaaactttaaccgttaacacctacataaaagatatcaaatatactctcaaaacatagtggtaggagtttactactaaccacttcaactaattttggtaaatatatgtatgcaggtcatttaaggagaaaatatatctgccatgcgacaaaaatgaacctctgaccaatcatgtgcgagtacaaggattggacggaccacaagtcagtcgaaactgacttacattgggaccaaaccgccataggggcccacctataagctgctagagaatccatcctggcccacctcatctccaccttacacgtggatggctccagtggagtcccaatgatggttctgaggggttaaccgccattccaaccatcattggcagctatgaaagtaggagacctaacacacttcaacacacaacttttgagctccagagagtacaactaaattgtagtttctgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaacaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcggatgcacgattaatgcaagggggtacaagggataatgatataggggttaagttttgcagaaaacagcatttaaaagtcacttagttgcccaaagccattttaaaaagacgatcctaaagctacacagtattattaatcaaggtcgtgaacccgcacgaacctgccttaacccaaggcctacgatgattcagaccgaactggcaacccgaccctgggtcccagctcgtccctagccatcccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcaggattgagccccctagcagcaggacaccggccctgtgccatgacatctcgactaccgggccgcagctcgtgtagccttcatttgtcctaga

SEQ ID NO: 52982 - DNA, 1501 bp, Oryza sativa
agcagccaccagccgcaaacaaaaaggcatttacactgccgggcgacctagcccagccgacagtgaaaatgtttttctctcgcggctacattaagctgaccgtgtgcaaaagtctaatttttgtaggcaactagttaagataaccgccagcataagcctgtttgtttaagcttaatataattgtaattttgattattgagctagttataataagtcgacataaaataagttgttagctgtttgtttctctagaatattagctgtttgttagttattagaatattagctgtttgttagttattagccacccaataatctaaaaaggacacatttagagtggccatagacaaaaaaaaccacatgcatgcaacggcccattttcatgtatcaaacacgaaattaaaatcaaatcattccatttccacatatcaaatatgaaattcaaatgaaatcgtctaaatcaccactgcatcaaatggaagaacagacaaaataaattcatccatgcaaccctcccaagcgtgtccctcaatctatactcaacatgcaaccatgccacatcatcacccactagcaataattacatatttaatctcatgcaatcaagcaatatcatctacaatctatttaattctacaaatcagcatacaagcatattcaattatcacaccctcacatgattttcgtaatattttaacaagtctatcattttaacaatatttactatatacttatcaatatgtttcactcattaaagtgcgggtattatttttttttatcataagttctgataattattgatgtttcattattcttctaactcctagctcaattgtcgaaaaaatatagtgaaaattgttaattagttcctgcagtaaagcgcggggaatcacctagttcaaaagaattctagccgccatggacgagctcacaggtgactgttggtatttgttaacgacattactagaaatataattcccagcaatggcgcagaaacgctcgtggtttattatggttacatatttcatctgcaagcgcacggatataccattgtagcatttcacctgagagtattccaagggtatcgtatttgattaatcccgtgggaagattataatagagagaaccgtactaataatttatatattacttgtaataaccaaagtctaagcaggggttaacataattccaagggtagagtgacactaagcagaagcatttatactctaattcatgattatctaagctaagtggaaagaatatagaaagatcatattcctataattatagttgtcacgcccagaaattcacgaaccaggatttctaagctgaatgtgcattaaacccctgtctaggactagccagggtacacaaacgataattgttgacacacagatccacatcttacaaaaatataaaagattacaaatgcagcggaaaaggtaaaacgagctagacttggaagcttgacttcagcagcggggcgactccactccacagg

SEQ ID NO: 52983 - DNA, 1501 bp, Oryza sativa
aaagatcgggtaacaaccactaagctgaacaatctgcaactcttcttctccactctcctccccctctcttgtgtttaatttgctagttgcttctcctctctccaatggctgctgctctctctctctcaatggaggctaggttttcgtttgcaccacaaaaatatgaggcaatcttcatcattgatgaagacatgtatcaatagctcatatttgtaagacttttggactagaatgggctgagagcaaaggctctatgtggatggagtttagcctaacaaactccacctcccgacatcatggagcacctggctgccttccggtagtcataccaatgagctggcaacaaaccttgagattctccattgtcatcaccttggtcaacaagtcagccccattatcatcggtgcagactttctcaagccgcattttccgagaacttaacacatcacgaatcaaatgattacgcacgtcagtgtgctttgaccttgagtggtatagcagcatggaggtctcagatatgatcaacggctagtgtagccttcttccgcaaatatgaactcagggagattggaagttaatattcaaggaagaagaccacactagccatcgactacatctgattgggtttagaccacaagctctggatccttcatattggtgtttgtggctctaaattaagtttgtctagacttatcctggtgtatgttggcttgtatatatctgtctagatctttcttctcacttggcatgtcccctcttctcttatggagtcttgtttttaaactctcggggtgctccaagaactaggaagacaagtatggatacgatccgagtaatccttgtaatgtccgagtagaactcttcttcaacttctttgtctgaaatacctttcgtatatgaggcatgattctgtattaagaattggtatatagtgggctccgtcgggtctaactctaagagtattgggtaccccttatcgttaacactgacataattacccttggaagttattatcaacggaagcccataattaagagactagtgtaaattaatctttcaagcagggtataactatatccccgtatagtggagctattagttattctctgggtaggtagttgcttccttccctgtggaagtggatgggtattcaaatttcaactatgccatccaatcaagccacgacgatccacagccatagtgtaaaaattcaagtcaattgcttacaacttcactcaacatgaccaatatatatatactaattaaatttgtggaacttggataatgcaatctgcatattcaaaattatacacatggagtcatgcatggacaagaaaatgcaggcaattacgcacccaattgtagcaagccactcgcaaattttcgcattttttctttgccgccatcacacctaaccgactccttttccacacaaacagattataaataagcaccatatttccaactccgttcatcccacgaaacaacacgagacagaaaa

SEQ ID NO: 52984 - DNA, 1501 bp, Oryza sativa
aaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaagaaccaagtgatatgttcgaagatagtctacagaggtcagattaaaatcacatctaacaacgaagcttcaaatttggcaggataacgatcaaacaataagaagttcagcagtaaagtcatttgggaagacgtcaaagcatgtcaagtgggataatttggttcccttgggaaacataattcaaaggcaaagttatcgaccctcacaatgaatagaggaaatatctagcaccggagaccaggaaagctaatatgagacaatcagtggcaagttgtcaatcatggtattcttagtaagcaggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcctagtcgaagtcagctagaggtgcaaccagggaaaagtcatgtgaagagaagattccatctataacaggagatcgagccaagcagtccagagtggagaggttttgctaggcaagtttgttatagaagacgcgacggaagaagtcagataagaagagaagcccgcccaacctatcttcttgctagcctcctcgaatctcggggacgagattcttgtaaagggggtggatttgtcacgtcctgataaattcatcccgaattaaaaatcattccctaaaaggaataatagaattaattaaaattcgaaaagaaattgacaaacactaaaatacgtgccagaaaaattcgaatgtggcccggagaatttttgttaaattctccttggtctaaaaggagccctcaaattttacttgaattttcagagcactggaaataattattaagcaacaaaaacaattatcaatgtttattaaaaagaaaacctaaaaataaatcctcttcctcctttgggccaagcccagcccaaagtcctctctcccccccccctctctttctccccctcctccctttgggccccaaagcctccctccattcctctcagcccggccgaaagtctgttt

SEQ ID NO: 52985 - DNA, 1501 bp, Oryza sativa
ctcgtcgtctcgcggcgtcgcctccgtcgtcggattcgcagcggcgcgttccacgtcgtccccgtctccgtgcagctgttgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagcattgcgccggccgcgtctcaccttcgtccaaggatcgccgctgaagtcgtcccctcgccatttgtctccgtcgttcccggccgcctccgccgcgcccgttcgtcgttgtcgttcccacgcctcgtcgcgtggtggtaaggatctctcctctcgctgccccgtcctcgtcctttcggtgtcgcccgtgcccgttgtgcggttgtcagccccggtatccatgtatcggtatcggtagtcgttcgcttgtccgtgtagtgtccgtgttagtgtgcccgcttggtagccgcgttgtttcctcgtgtgcaacccgtgtggtgtctagtggagtccgtttgtcggccactcgcctcggttgacacacggggtccgcttccgtcgacccgtggaccgtctctgtgtacctggtctaccgcggtcctttaggttgacatgtggggttcgcatgtcaacagcgcagccttcctgtcttttccaggctagcgcttacacatgttttatagtcgcaaagcctaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagttgcaccccggccactataaggattaa

SEQ ID NO: 52986 - DNA, 1501 bp, Oryza sativa
accttatgttgaaaatgctaaggcgattacaacgaggggaggtaagtccactcgcaatctgccatatcctaaccctgcagggaccggcaacaacagcaacagggaagcaccatctagtgacacaactgaagaagaggttcagtcaaagaagaccgtgctgcaggagtattgtgacacgagaccgctgccactcccccagagatacaagaagccgtcggtggacgagtagttcgctcgttttgttgaggtgatccaaaagattcacattcacgtgccgctgctagacgtcatgcaagtgcccacttatgcacgatacctcaaggatatcctcaacaaaggccactaccgacgactaaagtggtcaaactaatggaggaatgcagcaatgccatactccacaagctcccggaaaagaagaagggtccagggtatctcatgatcacctgctcgatcgagacacagaaattcaaccaggccctctacgaccttggagcaagcgtgagcatcatgcccaaggatgtcttcgacaaactcaactttacagtgttggcaccaacaccaatgcgtctgcagctgggcgattcattggtccattacccaactggcatagtggaatacgtaccggtcaagatacgggatttcttcatcccggttgacttcgtggtgttggatatggaatctgacaaggagacgccaatcatcttggggcgtccgttcgttagtaccgcagatactaacattgatgtgggaacgggaagcatccgtttttgtatcaatgggaaggaagaaaagtttgagttccagccaaggaccgagcaatgctccatggtgaggataaagtatgggccaaacccgcaaaatattcatgtggtcgaagtggagccacccaagacagacagcctagtaaaattcatgcagaatttcctggagaagggaatgccggtaaccaggtcccttgagaagaagacgctggtaaaatctagtacaccggctaagaaacaagagaagacggctcaaaagaagccgccacctgttgacggtcgttagcgaccagtttcacccgtcaatactacccaaataaaggagaactagttatgcttgcaatgcatatttatgtcaaataatataggcaaaatttgctacaggacaccgaaaaattgcggtctttgctgcgagacacccgaagatcgtgtatttgctcgtggacactgtaaaaaagtggtaattagctgctggacactcctcccattattttattatctccggtcaaaatagagagagaaagagttgtgtaattaccaaaatgcccctgtacagtgttctttctctcacttcttttcttttccccttcttcttctttgcagtggagtagagggtgacggcggccggcccgagccgggacggctcggccacggcagggcggcggcggcggcgcatcgcccatggcaccgccggtgatgccctccgcatcggcggcggcgagctcgacttcttcacgtcg

SEQ ID NO: 52987 - DNA, 1501 bp, Oryza sativa
caaaactacttttaaactaatttttctcttaaattacttatccaaatcatgatccgattacaccattaaattcgttgcaattaaatcttcaatacaagaccacacatggatatattccgataaaaagaaattttagcttattattgaattatctttaaatttttagcttattccaccagttatatcgaaattgtttcactaagtagatcgaaaatgtttcacttgtttaaatctggtgttgtttcaccttatataaaaacaatgtttcagcaaatagcgaaagaatggttcggttcactgcaacattagatctatacatagtgaaacattataagtacactaggtgaaacatttttcggtgaaacaaaaaatgaaacgaattcccttaacaggaggtttccaaaatatgtgggttttttgttgcaatgaaatatttcagttcactgcaacattagatctatagatagtggaacattgtgagtgcactaggtgaaacattttttgtggaacaaaaaataaaccaaattcccttaatttagagtttccaaaatatatgggtgatttattgcaacggcgtgttccactgcaacatttgatctgtacacagtgaaacatcatgagtacactagctgaaacattgtaaaactactggttaaaacatcaaaagagaccacatgcaacattaaaaaaatcaataaaaaattaaaatattttgttgtcaaaatataattatgtgtggtcttgttgtaaagatttaattgtaacgaatttagtggtgcaatcagatcgtagattagataaatagtttacgataaaaattcttttcaagaaataagaaaagaaaagattctttgcatgctgcagtggcaggaaaaaacaacgtctaatttttctccaacccgccggtggttcgggtgtgagcattttcacgaagaatgggttaaatcaatagtgggccccacctaacttttcgtccgatattttgtttcgctccggacgctcgatacgaagcgttttcgtcaaaacaagccacatatctcatccagtcccaatctgatttgggttttgggcctcgtaattgtgtcgtgggcttagcccaaggtggtgtgcaccctagggcaacactaggacgtccctaatcacatttattcagtagccgtcatcgtttagagttgggttttgcttagattattatgtgaagaatagtttcgccgctagttcggtttgtggaaccccaaattctagtgcttaatcattcatatgcaattgtgttgcaatctatcttgttcttgcttgtgttcttcgattcgcatgaagggattagccttctcggcaaggtcaactgggtttcggcacggttgataaccagaggagacatggtgctgcgattgcggggctcaagagcgtgcacgttcaacaagccggatcaatttgtgtcgtgactccacccaaatcgttgtttatcagaacctttcagaagatcgggaaccctagtgcacat

SEQ ID NO: 52988 - DNA, 1501 bp, Oryza sativa
agacccgacggagcccactatataccaattcttaatacagaatcatgcctcatatacgaaaggtatttcagacaaagaagttgaagaagagttctactcggacattacaaggattactcggatcgtatccatacttgtcttcctagttcttggagcaccccgagagtttaaaaacaagactccataagagaagaggggacatgccaagtgagaagaaagatctagacagatatatacaagccaacatacaccaggataagtctagacaaacttaatttagagccacaaacaccaatatgaaggatccagagcttgtggtctaaacccaatcagatgtagtcgatggctagtgtggtcttcttccttgaatattaacttccaatctccctgagttcatatttgcggaagaaggctacactagccgttgatcatatctgagacctccatgctgctataccactcaaggtcaaagcacactgacgtgcgtaatcatttgattcgtgatgtgttaagttctcggaaaatgcggcttgagaaagtctgcaccgatgataatggggctgacttgttgaccaaggtgatgacaatggagaatctcaaggtttgttgccagctcattggtatgactaccggaaggcagccaggtgctccatgatgtcgggaggtggagtttgttaggctaaactccatccacatagagcctttgctctcagcccattctagtccaaaagtcttacaaatatgagctattgatacatgtcttcatcaatgatgaagattgcctcatatttttgtggtgcaaacgaaaacctagcctccattgagagagagagagcagcagccattggagagaggagaagcaactagcaaattaaacacaagagagggggaggagagtggagaagaagagttgcagattgttcagcttagtggttgttacccgatctttatcaaatcagtgattggaggctcaaccgtggttggattggcaccaaacttagtgaggtttttcctcacttagagcacttcaatcttatcagttcgtgtgaggattggttgagtagagcactggatttgagtcgggttgggcagagtaagaccaaaccgaagaaccgaaccgaaaagaccaagaccgaaaaaaccgagactgagaaattcggtctcgaccagtgaaagacttaaatctgttcggtcaattcagtcagagccctcggttaaccgaaatgaccgaattgggcccaataagcccactaatttgctagaaaccctagaggcagagaggtgccctccggctctcgcatccatccaaaccattcccatcctcctcagttcacaccgtcttctcatctccttcgtgcttgcctgactacatcggcgtgcgccgcctcccgcctccgcctccacctccatcgccttgcaccgcctctaactagcccacctccgcctccattgtcatgtgccgcttcaagctagcacgcctccgcctccatcgtcgtgcgct

SEQ ID NO: 52989 - DNA, 1501 bp, Oryza sativa
ctaagatttatgtatagaaaaacctctgagttattccctgcacctcatgaatcatgacggaactcctgatctatagaagcatgcaaaataacatacaaaagaaatatgattaggttaacactaattagttaaacagtagcaggaactacttctaatataatatgaagtaattgttacttgcacacatggcaacacattgtccttgacagtcaaagtgttggatcatgatcactgccttcatttgatctccaatcaaattcaatatccagatagtgtttccttcacaacaagctgaagcaattaatcaaggtccctcgattaaaaaaaatgtttggattgcgtaaaaataaaaattagcattcatgtcaagagatgcagaatgattaacacatttgtataagcattttgtaggcaatttcctgatatagatgctaatgttatccgtaaagcaaacaataatgttgctaaaatcaaatcataccagcacccaaaatcaatttgttagcaacaaaaaggattgattaatcgatttactccaatggttagataattacattcaggcacaaatagctaaatcttcatactacatatgtaattctgtgagttatatattatataaatatattcaccgtaggactctcatacagtatttaccttaagaaaacagaagatcaatgctttgtccagtgcaaagcatctcttgccaatacattttttttgtgtgtagctcccttgtcctcttcaagggtatggccagattccagctaattaaagtacaaagttttatcctaggggaaagccaaacaatcatatgagcagctgaaattatgtttcaggaattatgcaatctaatatatatgcagtctagattaatttaatatatgctcctaggatatcaaagagcagattgatcagatctgtgacatacaaagccatagagcacatggagtgtgacatacctatcaaactctccaaagaatgaggatgggaatcatgtcactcctctgtgctctccatcctgcaaaagtttcatgaactggaacatgatatatttgatttctatccatgataaatggcatcaatccaagtaatatcacactactttggcacaatttaatttaacgaattttaaaactataagatggaagtgtagctagctagtgtagcagccataaaggcacattcgctgtatgatgcaggaattccctgactgccacaatcagcacaggtttgaaagttgttaacgtcacaagtagatgcttgaaatacacctcgctagccaaccagaccagtggcccaggcgcttccttggagatggagtaggcagggggcagcgtcttgggtggctaagcaagcctgaattttccgctcttacggagtacacgtattttccttgaggacacaagggaacctacaatagcttcagatctgtaccataacacaaccaggggaggagattaaatgcaagaacatcgtcaaatctacaatatttaccagtttg

SEQ ID NO: 52990 - DNA, 1501 bp, Oryza sativa
gtgatttggttcagccccaacaacaagcagaaataatatgcaactaatgacggttatagttatattggagaagaacacatgagtggtggacatagcttaccaactagcaaacatgaccgatttgtttaaacacagaaaaatcattgtgtccgggtgcaacaattatacttttaaaaaaagtataaaaatagaatcatgcttagaacacgtgttaacattatcattagaagctacagatattcgaggtggttatgacttacgattgtcatcgaatactttgcaaagtcaagaaagtcaaaattgttctatccagattagtgaaagaggagtataacataaaaaaaggatgggatgagaatatcctcgaacatattataatgtattattgaattgtatttaaacccaaaatttggtagccttatttttaattcttgagttaatttcagatctggcaaaattgatccaactcaaagaattaagaagataagggataaacgtgcacaccaacgctcatatgtgagtgtgaagatgtgcagctgcgtgtccaatggttgattcatcttgtctcatgaatgtgcaagcgtcgcggtgtagcacagacatgggtgaccttgtatatgactgtgtcgtgtgagctcaagatcacctccacacttgtttttgtacctagggtgcttcgaagatacatggacaaaataaaagtgaaagcaaatgggactcacctggtgaagcccggtgagtcaatttattttattaatctcgttgatatgcgcaattacatgaaggaatgaaataaacaaaaagaaataaagaaaatgattaaagtaagtcctaggggtgggcattcggtcccccgccaacctcttaatgggaggtggagagagatggcacctgattggcagggagatatgagaagcctacaccttcaacttctcgcagggggacagggatggaatgagcaccttcccatgtccaacgggtgtgctcgcttccacgaagcaaagtggtcgcttcggcagagggcaaagtggtcgctttggtggagggctatctagcaagtaggacgatgtgtccatactcggacaggggttgttctcatttccattgggcgctgccacaggggtcacaacaccaccgttagcatgggatggcctgagtgcattgttaacttggaacaacgggacacaaattatcatccatggtatgtcaaaaagagggaagatgacctcatggaacatcttgcaggcatgcttggcatcggcggcatggcatgacattgcttccaccatggcaggacgtactctcgcaatcttgaactttgggaaaggttccatgtagtcaatactccatacatcaaaaagttccacttgaaggttctatgttaggggcatcacatcacgagcggtgatacctccatgcttctggtatcttgcacatctccgaatgaactcatttgtgtcttcatacattgtaggccaaaagaatccactctgtcagatct

SEQ ID NO: 52991 - DNA, 934 bp, Oryza sativa
ggccggctgggccgagaagagaaaaaagccggttttgggccgactttgggcccaaagccaaaagaagacttttttaaaacttttttcaatttaaattatttcttaaatgcaattccatttattaaaaatacttccttagctcaaataaatcccagaaaaatctaggaattatagaattaagcaaagtatttaatgaaatttttctggcccaattttatattggaatttattaattagaattagattttcttttcaagacttttaaaataaattctagaaattccatttaaacaacaatttatatattttgaattttcagggtgtgacaaataccgaatctatgaaaaatatgcttcaaaaataaagtcaattacctctgtacaagtaatattctcgagcggcacggcttcggcccacttagtgaagtaatccattgcaactagcacgaaccaatgctcttttgatgacgaaggataaatttgaccaatgaaatccaaagcccaacctcggaacggccatagtttaatgataggattcaacacagcggtaggcgctaattgaacattgccgatccgtcaacaagcttcactccctctatagcatttgaaacaatcatcaattattttcggccaatgaaaccccaccctcctaagcaaccaatttatcttacgggccgattgatgaatttcataaatcctttcatgtactactctcctagcaactttagattgatcattatctaagtaatactctatctatttttcggcgatataatatttgaacgcttgccgccgaatctccgatcaaccttaagtgtaggatctttcaaatatctaatcaaagaaattctccaagctatttctaactcatgggtacaaatgtccgaattcacaattaattcggccttttaatcaattgtaacgtgccccccagc

SEQ ID NO: 52992 - DNA, 1501 bp, Oryza sativa
aatttattgatcaatgtggtaaggccggtagtaatgatttgcttaagttaaaattgtttcccctttctttgtcaaactttgcatctacatggtatagtttacttgctcctaattcaatttctacatggttacaaatggagcatgagtttcatggttatttcaaagatacaagcttgatggaacaaagaccgattgatacttcatcggtcacttgttaaactatttcggttacatctatgcctaagaccggaattgttagcgatcctctccctgttagtcctattgatgtagacaaaaagaaagggaaaagtgttattattggggatcctcagcccaaaaataggataaaaaatgcgaaggccgaagatcataaagttgcaaaggatgagtcatctagtatccaaaggaccaaaaagccgaagctcacttttgagatgcttatggctaaatacaagaaaggattagccggtcaacgatttaataaccaaactagtgattcgaaaagaccaagatcatctcgtaggaagagatttggtcaaacatcaaagcaatcggagccatcaaccataccaactccatgcaaacctccgattgtgatgccatggtatccatatccaatgtcactatatggttatccttttatgtattatatgccatggatgcttcaaccacctatgccgtgtcatcaggaatagaagcaatcacctaggacagtaccaagtcattctaacccaagacaagaccattttccacaaaagaatcggtccggtggatcaaaggtgaaaaaggtgaagaaggtgtgggtgaggaaagaagtcaaagctccggaggtcgttgctatcaatgaggaatctcaagatgttcatgtacctactggagatgcggcgaaaactatacaagcggagaagactaaagccgacgccattgctgtcgacatcggctgtctgaccgagccagcttgccggtctaaccgccagacaacggccggtctgaccgacggcttgcagccggtctgaccgggcctagaggccggtctgaccggggggcattggagaagagtgggaaaattgagagcaaaataggagcttccacttcgactaaaaatatgaagaatcgttacttagctcctagaaaacaaccacagctaaagtggataccttctggcttatctcgctctcaaaagaggaggctacaacgtcttcgggccataggtcaaaaagaaaaggaggccaaagatgtggagaacaaaatatgtaataatttagagcctcgaacgacacctaggcaagtgtggagatccaaagaggtaaaagttaagagaccggtgatttcccatagtagagaaatccaatttgatgagagaagaatcatcggtcattagagataagtctccttcacatgatgctatgagtgttagtgcggtatccatcttgcattcgaaatcgcgcaatctagaaagccaattttgcttggggggcaagacattaatatgctcataagg

SEQ ID NO: 52993 - DNA, 294 bp, Oryza sativa
cggaaacacagggtttgtcttttttttgggacggagggagtatgtgcttaaggcctagatctatgttttttaatcactcttttctgatagaatgtaaaatccagctgctacaagtgggagcctcagacttcattaacactatgctatgggctctagccaaactctactacaaactctgcccaatgacctgctaattcacaacgtacagaaacaaaacctaagaatatgaggcttaaatctgaagtttggcaatgcattgttaacaagaaattaaatgatcaacataaagctgaa

SEQ ID NO: 52994 - DNA, 1501 bp, Oryza sativa
ggaacgaacgtgaccgagaacgagaacgatcgaacgaacatgaacgagaacgagaacgagcgaatgaacgtgaacgagaacgagcgaacgaacgtgaatgagaacgaacgtgaacgagaacgtgaacgagtgaacgaacgtgaacgcgaacgagcgaacgagaacgagggaacgaacgtgaacgtgaaccagaacgagggaacgaacgtgaatgagaacggtcgaacgaagacaaacgagaacgagggaacgaacgtgaaggagggaacgtgatcaatgagcaaacgaacgagaacgagcgaacgaacgagaacgagcgaacaaacgtgaacgagcgaacgagggaacgtgaacgagcgaacgaacgtgaacgagggaacgtgaacgagcgaatgaacgtgaacgaacgtgaacgtgaaatgcaatatatatatgtatgttacttcgcgtttatcctaatacatttttttgtatcttgcagaaaagacgtgttgtcggagtcgtccctcaagccggagtggaagagctagccctagaagcaattcgctcaggcaagtgacgtaataatatatatgattgttatatttgtaatgcaattaagattattagatttgtaattagacttagcatataagattgtgtagtgttctaataatagtcttaattgcatatacgacagttacacttagcatacatgactattttagtcatttattactattggtgcgactccggtctaactacggaattggtgcgactcctaacaattgactattttagtcttaattagacttagcatatacgacagttacacttagcatacatgactattttagtcttagcatgtaagattatttgagttttaatataagattattttatttgtaattagacttagtatataattattgactagctagggtcgtataatatacgtcacctagacttagcttatatcacgatttgagttttagtatataattattgactagctagggtcgtataatatacgtcacctagacttagcttatatcacgatttgagttttagtatgagattattgactagctagggtcgtataatatacgtcacctagacttagcatatatatatcacgatttgagttttaattagtatgagattattagatttgtaattagacttagcacgtaaggttgtgtagggttctaatgtacgacagttacacttagcatacatgacttagattgttaaaacataaatgtctcatgacttaacttatatcacgatttgagttttagtatgagattattgactagctagggtcgtataatatacgtcacctagacttagcatatatcacgatttgaattttagtatgagattattagatttgtaattagacttagcacgtaaggttgtgtagggttctaatgtacgacacttacacttagcatacatgacttagattgttaaaatataaatgtctcatgacttagcagatgtttcttgtatcaacaga

SEQ ID NO: 52995 - DNA, 1501 bp, Oryza sativa
tgagtgaaaactcgcgttgggagaatgaatacagccacaatgggcgtgggacgaacctgcgagggggtcggttaaacgactaccttggaggggaaataaggtttccccgggatggttctgtcccccccatcttgcgaagccgtatcttcttccgctccccctcgggctgcggcgtcggcgcggccccctccgggcgcctgctgctgacacgcgccgccccgccccctcggggaggagatggggaggaggaaccctcttgcttcctcttccctcgggcgtcggcagggcggcagccccccgagcccccgtcacggagcccggaagcacgaccccctcctggggtagattgttctcccctgcagctcccgcccgcgccatcatggcctcgaggagcctgctcctctgaggccccgaccgccttcatgatggtcaggatggtggcgcgatctggatcgctgcagagggggaggactccttgggggatgagcgatgcctccgcggagctgagattcagcacccgttggatcattaccttgaagtcttcagggacccagtcccatttgaccccccggtgggtcctcatacagtcctcggacccggtgtactcccaggcaccccgggcgcgccgctggagtggtgcgatccggcgacgaaggtagtcgccgtacaccatggcccctgtgagcccctgggatcgcaggcccgccaggcggtcgaggacggcgtcgtagccatctcccagatctaccggcgcccgccagctggaggcctgcgccgggggctggttcggaagtcggaggcgcgcttcgtcggcgaggggggtgtagaaccagtcgctcttccagtcatcccacttcttgcggaggacgcagggaatctagcggttcagcaccggcccccgcggctggaagtagcagccaccaaccaccgacggcggcgacaccggctgtacggtgaagaaccaccggaacaaccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatagcggaaccagccctgccattgcgaaagggaggaagaaaacggtccgccccgggtagcgtggcgccgggcgtccctcgcccagcgtaactatctcctggccggtggcagattccggcaggaagcggcgcggcagcccggcctgcctctcgctcacgatgcgggaaagcggcagcacgctaccatcgagtggagcagagccccgtgccatgacgccggaagaagagatgtttgagagcgagcgcgtgtggcgagggtagggcacaggaaacaaggagttagggcacaagcggcgaagacaaggggaataatggcgagaggaaggaagcaaatctcttcctcggtgtctttatacccttgccaacgctgtgcccggctcctcgcttctcgcgcc

SEQ ID NO: 52996 - DNA, 352 bp, Oryza sativa
atatcgcgtttgtagaaaaccttgtgtgtattttgttcgcagtaataaaataagatttaggtgtaaaataatgcagcactgcaactgaagattgatacttccatgttatatatctcaaaaatgcatttaagcatttaagggccctgaatgaaagcaccaattacaccctgtgctttgagctagataagtagtgccatatcaagtttgatgattctacttcactttatttcatatgtaacctagctttctggcatttaattgatctgtattattgtttaagtgtctttccccgtttttgttaataatgttattttatatttgtattcatgttaaattttcagcaaagcaagtt

SEQ ID NO: 52997 - DNA, 1501 bp, Oryza sativa
tgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgtgccctaactccttgtttcctgtgccctaccctcgccacacgcgctcgctctcaaacatctcttcttccggcgtca

SEQ ID NO: 52998 - DNA, 1501 bp, Oryza sativa
cgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaa

SEQ ID NO: 52999 - DNA, 1501 bp, Oryza sativa; identical to SEQ ID NO: 39699

SEQ ID NO: 53000 - DNA, 190 bp, Oryza sativa
tgcagcccgtatacaaattcagtgacccagctcttttcagcaatttgtaacgaaaaacaggacatatttttacttataagctggaaaccagtttttacttaaaagagaaaccaattcagtataagctggaaactcagtaacttttcacactgtcatctaactcctcccattggcatgtttgtcttcaaga

SEQ ID NO: 53001 - DNA, 165 bp, Oryza sativa
aagtgaagtctgtaggttggcagaggccagcactggttctgcagaatgtgtgatccattattgatatttgcatggggcacattaccgtacggcctgtgagagcctataccgtgcacatttcatggataatttatatgagaaattgcctagccaaatccccaagca

SEQ ID NO: 53002 - DNA, 1501 bp, Oryza sativa
tcgatttttcgttggcgttcaatttcaccccgagtttatgtcgagaccttcgaaaccttccgcactttttgtcggtaagctacttaaacctctgtaaacgacccaagggaagttgatatatatctttcttttgaaaaaaaaaaaagttagcgatgtaatatcaacataccgctttctcgagtaccgtcaaaatttctctttgacaatctgatcaacatgtataccgacctgcaggactaatcgctgcatcgtgtgggcaactggatggtgtgctgcaagatgcggcttgtaaccatgagccacagcagaatcagcgtgcagagaagcgtcctgctgctagtgatctaggagattgaacctgccgcagcaagcggcaagtgacggcgtgctctgattcaaatgaccctgatgaagcaccggatgtcaaaagctgttaattgtagttgccgtttcttgatatcattgttagtaagaattttgtaaaaagaaaaaaaataagtatgtgtagcagtgttcttataatggaaatgggggagaataatcctctcttttttaaaaaaaaaggaaaaaaaaagtaaaggtgtgcaacacatgaatacatgatgcattgcatcgtcaccagtagttcttcatgtcgagatacggactaggggtttttttgtccgaccttttctccgctcttcacaaaaaatctgggttttttgggaggtccgtggatgtttagaaaaaaaaaagtaagctcttctaggttaatcagcatatctactggaattcaagctaatgcaaccatcggattcttcaataaatatgtgtgctaaataggaactgttttacatttgctagcatcggaaggctacatgttactgctataattgacaataacgatcgcaacagactttgcagacaaaatgaagtcgctgtgataaccttatggtcctcactaatcctttgttcagtattttcaccgttatctggtcaggctcaataaagtcatccagaagttcagtttcatcagcaccgccactgttactagatcagaagttaatttttatagttgaaaccagtgcatcccttaataagatactcttactgtgtatttagtcatgaagacaatgaggaacaagcaatttgtttaattgtttgttgaaatcatcagtttgtcagattgagacacatactacaagttattcattggccgtcaagtgctttaattggaagtaaatttcaaactctttgggagatttctttggaactggatcggctgaaggacctgtggaggcgataccgaggcactgaggcagtgctggcccttggcgtagccctcccaatccatggcggcctccccctggcccctgggtaggttttaggcgcctggtggtggtggatcggtgccggtgggggatttgccgggtcggcgaaagaatgccgaccaaatttcattaagattgagagtaaaatacatgtattccgatattaaactgtcgagtcaaggcaaaagcct

SEQ ID NO: 53003 - DNA, 1501 bp, Oryza sativa
atcgacagtaccctggaggcctggatctcgcatgagcggtcggggcatgttctgacgacgacgcgcttgtaggctcctcgtttgacgactgcgcgattcctccccgcgtggctttctcctccgcatccgtcctcacagctccagcctttcccaaaccgctacgagctggctgcctccccccgcttcccacctccagtctcactgctcctgtactccccaacccgtggcggtgaagtgtttgtacactactctcgtggcggctggaacccagcatcagcctccgtgccctctcgcggcgaggcggcgcgctgctatagccggctgcctccccatcttctgccctccatgcccggccgtcgccgattctgtaggcttccttggactgctggtgttgcagaaaatgttacttccatgcggtctgcctcctgagggagagacaaagactgaggtcgagcgttcaatgttacatgctactactgaaagtatcagattcttatccaaaacaggatcaaaatatttttttgcgtagccatcttgaacatctgaagccctctatatgtacccttttcgaacctgttcatcattaatgttcagtccttgtgtgtagccttgccggagcaaactgccgcagctgcgcgccttggcctgggcccccagcagccggcacccatatgcagctccgcctgaatgccgtctccgcacacccgagccgtcaatagaggagttaaggaaggttttggatgagtgggaatgatagaagaggatgaaaagaggacgtaaatagaatcgattcccgggggcggcggcgcggggcgcggcgtgcttccggtggttgtcggcggcggcggtcaaacatgcgacaaaggaaagggaacggctctaactctccaactggaattcgctcgagcgggatctgacgaagaagtaaagaaatgcgaaaatacaaaaatattcctccacgcaaaagatgaaaaaaactaatataccctattcaatttatactgcaggctcattgggcggaagattagatgaatctacaccgttaaatcatatatactgctagtatatacttgcagtacaatgtaccctaaaaatcctcttaaaaaaaggccaatattagagaaggatctaatatcaaataattagaatgggtgaggtttcaaacccagatcgtctagcccaccaccttatggagttagtcggaggaaaatgggctgaattctgacaatcctattgggccgcgggccgaaaatggacacctcaatttcatcgctcttaggcccatatgcttcgtgccgatagttcgagtcgtgggcgctcgtggcagccggcggcagcgaagcatctgtcgcgggagacacgtgcctcctccagaactacacgtgtgcaactgcatgggcgagtcagcgcaccataagaacagctcgctcgcactcgagtctctctctcgttcatccatccagcggcacacacaccaagctagcttctagtagttgagcaa

SEQ ID NO: 53004 - DNA, 1501 bp, Oryza sativa
tcggatcaccatttttgtccgaatcattgagttcttttttaagttaaaaaaagttaaatcactgggttgatgtaagtaaatgagaggcccctgttctaagcaggtttcagagagcacggcactcgtacatttggcgaccatggataagttccaggtcctgaagcaacgcaagtgttcctttcgctgcactgtctgtgaacaaagcatacctggcctatgtgtgcatgcaaacaaagttatttagagatcgtgtcacgcataagaatcgtttgtttctggaaatttgtcctctccgaaaacaaaagaacacattacttcgatgtttgaacagacgccatgtttagaacaaggcttgttgattatagtagctactactaatctgccgttctgctttaaagaagagaataaagattataataaaggagtaaagaaagagagatggcgaagcggaaggcttaagaaacgccaaaaaagcctttgaaaaacttggaggagaaaacttgaccgttgcagcgtgggctcctccgcgaaattaaaaagaaccggctaaaattaaaatgcaggcattacattacgcagactcaaggcaggacacgagaaaagctgcaagagtttatccgattattatccacaaggcagaagccaaaacaatctgttaattctcctcctcgttcttccttcaaaatttctttctcctactcagcattgcgtcgtcgatgaaacccttttttcctttctcagtttctttcctgagacttttctatacctgcaaagtgcaacaaagtggtcgaacccccacggtttgtcttagttttttctcaacgaaaaagcggcgactgcacgtgtcctccatggccgcggcgctgggttggttttaccgggttccgggctctgccgggtgcacgaagccatcggtatcagcatcaacctctcctctcctagcctcggatcctctcatcctcctcgcgcactagagaagctagagcttcacccactcgtgcttctctcctcgcctcgcctccctcatctcgatcttccaatggcgacgtgacgaggtggttgccctgcgctgcgcttctgaccaccacgtgcatttccatttcccgctgcatccgatccgtttgttgttgttgccgtggcgtgccttgtgaatttgctgctccgagcgagagcgagccggtggtttggttggttgcagaagctttggcttccgctgaggctgcgctggtgtggccggtggctcacgggtttcaggccgcgcgcgcgctcgcgcggtgttcattttttttttttttttttttttttttgcgctcacaaggaaagtgcagacgcgcagtgtaaaacgtcgtggcaaccccaaccgtcccaatggcgacgccgcccactgcttcccgcgcgtcgccataaaatctcgtacgcgtacgtgcgcgcgctcgtgtgcgtctctccttctcctctactctctcttcacgcgggctggctggctggctgttgatgagca

SEQ ID NO: 53005 - DNA, 1501 bp, Oryza sativa
tgaaattgaggtgtccattttcggcccgcggcccaataggattgtcagaattcagcccattttcctccgactaactccataaggtggtgggctagacgatctgggtttgaaacctcacccattctaattatttgatattagatccttctctaatattggcctttttttaagaggatttttagggtacattgtactgcaagtatatactagcagtatatatgatttaacggtgtagattcatctaatcttccgcccaatgagcctgcagtataaattgaatagggtatattagtttttttcatcttttgcgtggaggaatatttttgtattttcgcatttctttacttcttcgtcagatcccgctcgagcgaattccagttggagagttagagccgttccctttcctttgtcgcatgtttgaccgccgccgccgacaaccaccggaagcacgccgcgccccgcgccgccgcccccgggaatcgattctatttacgtcctcttttcatcctcttctatcattcccactcatccaaaaccttccttaactcctctattgacggctcgggtgtgcggagacggcattcaggcggagctgcatatgggtgccggctgctgggggcccaggccaaggcgcgcagctgcggcagtttgctccggcaaggctacacacaaggactgaacattaatgatgaacaggttcgaaaagggtacatatagagggcttcagatgttcaagatggctacgcaaaaaaatattttgatcctgttttggataagaatctgatactttcagtagtagcatgtaacattgaacgctcgacctcagtctttgtctctccctcaggaggcagaccgcatggaagtaacattttctgcaacaccagcagtccaaggaagcctacagaatcggcgacggccgggcatggagggcagaagatggggaggcagccggctatagcagcgcgccgcctcgccgcgagagggcacggaggctgatgctgggttccagccgccacgagagtagtgtacaaacacttcaccgccacgggttggggagtacaggagcagtgagactggaggtgggaagcggggggaggcagccagctcgtagcggtttgggaaaggctggagctgtgaggacggatgcggaggagaaagccacgcggggaggaatcgcgcagtcgtcaaacgaggagcctacaagcgcgtcgtcgtcagaacatgccccgaccgctcatgcgagatccaggcctccagggtactgtcgatggacggtattataaatctcaacttcaaatgactaataagcactttttaggtttttgacaaattcctattatacccataaatatactgctagtatatacttgcagtataatgtaccgtaaaagtcctcttttttttaagtgtcaccctgaagtctgaattctgtctgcgtagctgttagctctgaattctgatcagaaaagttcagtatatcttgcgcccacatgtattggta

SEQ ID NO: 53006 - DNA, 1501 bp, Oryza sativa
attttttaccatttccatttttgtttcggtcgattaccatttccatatggctcggccggtagaaagtcgaaaacgaacgccggtcggccggtaattaccgttaccgttttcacccctaatctaaggccccgtttgatagatttacaactcctaaatttaactaccggagataagatctgaagtgaattgtagagtagcataacccaattccacctatctatttttttttataacgctccagctagctctattccgactttaggtggagttagagtcagagtagtgtcaaacaagacttaaatgaagtggcagcgttatttgatcacgccatgttaactaacgtgacaaaataaaactatcatgtccactacgggtgatgtaattttgtcatgctactgttttagaatgaatctctatctccactaatataaaaattaaagatatttttatcggtactttagtacgtcatccgtgtataagtcagttttaaggtcattcgcttatttaagtgagtttttaagttcgttcgcttttgaaaatattggagcgtataagaaatctcttttaaaatactcgcatgctaacttgagacgttcggactcctaattacagctcatgattttgtaaaaaaaaatattcaaggtaaattttaccttagctaaaccgtacaacaataataataaagattaaaatagtcttcgcccgttacaacacaccggcgttcttttctagttatttgaaaattaaaaagtaaaaaaaaaagttgaaataaattttatccgctccccaccaagccagccagccccactgcccgacggcacccggccgccgccgccgccgcctcctcgactcctccgccccgccgcgtcgcacccgacgaccggaccgccgtctccgcctgccgcccgcacggccgcacccggtgagtggctggatggatcctgtttagttctttgcttcctcggtatttgagtgaaaattttgttctttgatgggtttgggcgcgcgatttggtgggaggtgaactcttctagattctccactgctgccgaaattaagctgtgatcgatgttcatggtactctagaatgatacgcgagatgttagggtctaggttccccattgctgccaaattttagttgtgattgatgtccatggaactctagaatgatacacgtgagatgttagggttgtgcgattgcgcaaaactagttgtgtttgggcatattgtggatctgatgcagcaggtcataagactgagtgtgtgtgatctggaagcactcctcattctttttagtcttgcatatgctactgccgcttggttctgtgcttcactactgagtactatgcccattcatgtctattttcctgttgttgaaattaattaagctacatttgtggccagtcaaaactgctcaactggttgacttctaaatgatacagtttcttttttatcatagcactgtgttgatttcgtttattggatccctcggattgcaaaa

SEQ ID NO: 53007 - DNA, 234 bp, Oryza sativa
tacatccaaacatatgtacatagccgaatgttatgtatgttagattatgatatactcccactatttaattaaacaaaaatcaatattgtaatatgtaagtacttagaataacataatgaaagctatgagctttcgcgtacaaatgaatgaataaataaataagtctcattttttaagcaatatgctagctcttgatttgtttacttaaagccatgttcttgtggtggttgacga

SEQ ID NO: 53008 - DNA, 783 bp, Oryza sativa
atttttatcaaattataactattagcatccatttgtctaagaaggaacttggaagactatatgtagctattttaatcatgccatgcagttcattgttttggctgatgcctattgatttctgatgttgtatctattacaggtcgaggaattgcagatctcaatcgaagatgagcagaggagcatagcggatgagctgagagctggcgctgaagagcagcagaacatgagcacagatgaaggtagcggcgatgcttcagatgccatggctttagactgatcctagcagaaaagcgcgatgcctgcctagttccacaaaggcagatacgttttcttgtggctatatagcacttaattgccttggttagacttgtaggttgcttaattacaccctgacacatgatgactctcgtgtagttttttttttagagagaaggccagagtctctcgtgtagtttcagttgtaatttcagtcctaagttgtaatcgtgtgccctttgtctgaaggaacagaacatcatggtgtgacatatactcctccagattattccaacatgtatggttgttattatttgctaaacaagcccctaactgaatgctaatcgacgcactgtcgacgtggaaaccaaattctagtccgagtccagctctgcccttgttgcggctaataaaagggctgaagttacggccggtgagcgatcgatcaggtaattttaatttacctttggttgttggctgcgttaggtttttaacccaaggagcaagaagctaggtacatagagacga

SEQ ID NO: 53009 - DNA, 837 bp, Oryza sativa
aagaaggaagggggggggaaaaaagacttttagggatttttctttttataaaccttttcaactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattcctttttgaaaatgatttttattttgggatgaatttatcaggacgtgacagtttgagccttttcttttccgttggtcgtgtagacgctgtagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattgttattattaccttgttcaccctagattaaacaaaaccccaactagtggacactctactcgtggtatcactagtatgattttaggtagatgcttcgcaatttaattaggtaacattaggtggttttacaactttagactttgggaatattcatatcacctgggcactttggaattgttggtttattgtggaattggattcacaccgctccctctattcaaaagcccccaaaatggttttaggctgggctcggggtgcatggttttgatagtagcacctcggccatataaggaccggt

SEQ ID NO: 53010 - DNA, 754 bp, Oryza sativa
gattaggtgtagccttggtcaagctgcctgtggagtgaagccgtctaccccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctaaaaatattggaaaagtagaactgttctcctccctttctcttttaattaaccaaactaatggcacatgcacttcataatttttttttggttctcattaaaaatttattccagtgttattagtactgtacatctattactgtactaatggctcatttatcagcaaaagttttacaatattgttttatttaatcttgctgcaataaaataaatttaccatgttgattttataattttctttcatttcttttgaaaccagttattcaaaattacaaaatttatgatctcgtttccaactgttttaatttatttcgcaaagcttggtttactttaattacttacctttttactttgattttcaaactttattcaaattaatccaaaaacttgtgctattaattggatagatgtcttaactctctcctttcacttgtctttaga

SEQ ID NO: 53011 - DNA, 1106 bp, Oryza sativa
atgtcatatggcagagggttggtcccctgctgttaggggctcagtcctgcatgcctgtcccgggtgttccggccgtaggcgggattgggtcggtactcttgtctatggctaggatgggttggaaactatgtcacgtcttccgtctgtacaccgtggtggtatgtggcacgtggttacacgtgaggaagatgtgtcttgtgggtaaagatgtacccctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagtaagagaagctttggagaagatgtcttaggtggagtcctggcttataccccagttgagcgcctgtgaagattgagccgtaggcccgctagtccgctgctgtttatttttgattgtcaggccttaagtgcctttgtaataatgtaaatattatcgatataataaagatgtgtcttttataccatgtttgtgtggtgtaccccggcttttcctgggacggggattaatacactagcgttcgggaaaaggcaattttcccggtcgcgacacaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcga

SEQ ID NO: 53012 - DNA, 841 bp, Oryza sativa
ccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatgg

SEQ ID NO: 53013 - DNA, 509 bp, Oryza sativa
aagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaa

SEQ ID NO: 53014 - DNA, 226 bp, Oryza sativa
catcgcccgtgtcttgtgtgtttccactttcgcgaacattccacagactaggagcttagaacctcacccagggcccccggccgaaccggcaaagggggacctgcgcggtctcccggtgaggagccccacgctccgtcatctgacgcgccatgtagggggttctgcgtgtgtttttctaagctctcatactctttcgtgtgcgccaagcttttcctgttcagcccaa

SEQ ID NO: 53015 - DNA, 722 bp, Oryza sativa
gaggagcccaagactactccaccatccgggatgctagctcggaggatgacgctaccatcgtgcacgtggcacgcatggtggaggagtacgacgcggctagtatcgacttccatcagatggtacgccgcgggatggtcgagaacaacatgaagatcctggagctgcgccaggagaacctgcagctcaagaaggacctcgacgcagtggaggcgcagctgcatcagctcaagatcgcccagggagagatctgccgccccaagcgtcgccgtgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgttctttctcgtttgtcttttttggagtcgtgtggggcatggttatgccggtgtgtggtgtaactatgtcggagcctgtcttattttatttgcctaagcaacttgaacattaatgaaccaatttaatagcagtgataaatttaagaataatggtagtcgtgggtggatagttttaattgttagctccttctctgtttgctggttctgtgtggggttttcaga

SEQ ID NO: 53016 - DNA, 334 bp, Oryza sativa
actctgtattgtatcaacttttggtgtaccttgcctcatgggacaaggaataatacacgcacgtcgggaacgcctgttgggtgatttccggtcgtgacagcttgcttgttttaagtttgtttgtgtgtgtgggtctcgcatgtgatttacatcagtggtgggatgtaagtgcatgcgtttgtttgcttttgagtgttaggaagtgggtgagtttagtggtgtgagagtcttcagtttgtaataatgaaactcagttaagatcaataaaagttaaagtaattctctgtcctaagtagtttcccccgttttctcttcttatcctgtccataccaga

SEQ ID NO: 53017 - DNA, 574 bp, Oryza sativa
aagaaattttccatgtttttacgtgcatggattgcagttggatgtctatacggttttacatgttcatggagtccgctttctggaacttcagtgcttgagctggttacatattgcataatctgatcattccaaggaaaaatcagtattgaataaaatatatgttggttgaggataaagagataattacttactgtctgttcctgcccagttggagcttcgtcagcattagaatcattgctcacttcattcttagaactgatttgcttggttcggtccattttttctagttgaatgaactcaaggacttcatcgagcgcacctcttatttcctgatcttcaaaattatcccaatttaattgctcagaatctgaatctacacagttctctttgttagaatctgagacttgggaaagtaatcctttcgcttttgatatcctttccctttcaaggtgcttagcataacgtatcccaagaaggttgcagatttggctcactgctaatcttatgtacatttttgctcgtaagtctgacatccttctacaacatgctgctggtgaagctggaagatcagaga

SEQ ID NO: 53018 - DNA, 1501 bp, Oryza sativa
ggtcaactttaatcaattgcatattggaaccaaactcaaagggagttgtggtctaatatgatcaagaatggtatgtcatgaggtgtgatgtaatcatgtaaatgtacatgatggacggataccacgtaggagactgttgcaattcggtggcaaaatgaatgagaaaaagagaagagagaggaaggtggtctaagccaccaaggcccagctaagccggcttccctctccctctccactagctggtccaattcgccgttatatcactgaatttagatcaaattactacaaaaggcttacttcagagttgggcatgatagacagtggtggagccagcaccaccgtgaagccgggacgactagtagcattttctggtgaccaactgatatttatacgcgtcgatgactaacggcaatggagattgcatatgaaaatcagattgaaaaacatagcatatacaggaatttaatggcacagagcgttcgaaggatgggtctttccacaatgggctggataggtggggaatggggttgggccttaactgatgatcgaaggttgcacagtacatcttgatacacatcgctataaactcgttttcctgattttatcattatattcctttgaaccttttggatcaaatcatagtgctatgcaatcatcgtaatacggaaaacatatattgttcccattaaacggaaaacagtcaccaggaatgtcatacgaagtacccaaaaaaaaggacgcctaaaaccacagtattaaactgcagcaagatttatttcacctctagaaatgcaatattttcaaccaccgtcaccaccacagacacaggcaaaatgggaaaaatacaagatacagttttccgagatgtggcactccagcagggtacagaattttacatagtcaatagaccctgaggagaaagcagcatagagaacagaatctaagaaacggagaatccacagtgctttcttcacaatcggctgaatttatacaggtttggttcacaaactgaccacacgaatccatccgaacgctgtccactcttcagactagaatcaggaacttctgcgacaactccagatctccaggattatttgcttaaacgatatttacactaatgtgtgtgatacacgtgccatccatcgttgagtcctgcaaacacaggttgaacattcaagtttctaaaatcaaaatttagatcagtatttgcatatgcttctgatgagactacagtcagaaatagcaaccaacaagcaacaaccaggcaagcaacatatgattctgaccccaaataaaaacatccacaagctagctactttctgcatgttatccacagttctgtacctatcaattgttcggttccaagcagacatgcggggcgcagatgaggatggggatgttcaggatcttgtcataatatagtcgtcagcttgtaactgacagttcataacaaaaccaacagatatctcatgatattaaaaagccatgcggctaaggcatc

SEQ ID NO: 53019 - DNA, 1501 bp, Oryza sativa
atcctacaggaattgaaaacacaggaaatggagagaatagccctttgattataccacaggatacactcaacaaaggaaagtttcacaagaggtctaacctcttgcttattttcctatggaattgatcataggaatgcaatcctatggaagttttcctatcctcttccaatgaatcaaatggctctataggaaaaaatccttaggaaaatgaatcctccaaaattcctttgctaatcctccatttcaaaggggcccttagtatcacaatataaaaataaggggaaacatccactacaaatttggacgtggacagttaaacttatctatctagattcgtagtactataatatttcttttcgtatttagtgtccagttatgttttttaatttgatactagtttgaatttgctagtatattatatgacggaaggattagtttttccatttgttgacactcgaactgaaaccttactggtgtgtttagttcacgtcaaaattagaagtttggttgaaattggaacgatgtgatggaaaaattggaagtttatgtgtgtaggaaagttttgatgtgatgaaaaagttgaaaatttgaagaaaaattttggagctaaactcagcctctgaggattttgactggcaagagacaagatggattttgtttttcttgtttgagagtgagaagtgagaaggaaaggaatcttcaacttcctttgcatccccaccaccgaggtcccatctcagatacccgaaatcgttaggttcatgagtttctctatagttattcgaggacataaacgactgaattaactattataaatttgaatatgagttttataaaaatattacaaagaaaaaaatgtatatagaaatcttttacgcgaaatgtactatttaggagcttggaaagcatatatgccaacgaaaatctaaaattcagaatgaaaataaaatacaatgcctgtagatattagatgagcaaatttaatgaagctatcacaaagaactctgaagttgcaaaatagcgttacaaaggaaaaatgccattgggaatgacactgacgagagtctctctacctgtttacgttaattaaaaaaagaacttaccattcatataatggttataaaggcagagtatctctacctttttacttaaataaatggtgttatgtttttccatccaaaactgctgttattgcatttttttacagagagaaattaagttccacgaaagcaaacactaccgttgctttctctgttatatagtatgctacagtacgatccttttttttttgttttacatttgctacgattctattctatacgatgtgaaatctactctatactttgatatgtaataaataatttgttttcctgaatttattaagacaaattgagcatgatgttgaaaattcaactaacacagagagagacaggatccggccggccttctagtttttttttttttgagaaacacagtacaaacgcagacgctcacaacatgc

SEQ ID NO: 53020 - DNA, 829 bp, Oryza sativa
cacagagacaatagataaatttagattgagcagtagattgcgcacaatcttaaaattatgttctgaattcctattgtggatgaactacagaaggtatgttggagctcaggacagcatcagcaacttctttttgcatgacagaagaaggtgcaaggcattaggaactttagttctagtcggctagggaaatccattttaggcaagtctagttaagttttcggttaacaagccgtccttgtcttcgatggcaagatatattagcactctgtatatggagtcctatgtattatttcgcgaagcaagaaaccactaccttctcaattcgctatttccagtgtccagtctgtttctctattcttttgaccatatgctcgatgctgcaacgatacctttccaatgttgtgtagtttgtcttcgtgcctcacatccaatagcctttgaagaaagatcctgctaaggctgcactaaatctgccaacaaaagaaataaaattgttcatgtattttatagaaactagggaaaacttcttttttacttcccctcaaagttttgatatgagatgtggagtaaaaatgttttcctataatcttgtaaaatatgtattctcagatcattacacttttaagatagaactttgtttatagtgtgtgtcagaccattcatttagaaaggcactcttaactatactttgccaaagtaggcatgaaagcctgactctgtggatcttcaacttttagtaatcgcaagccaagatattctgttttcctttatcacattgattcataattaatcatgaacagagcaaaattaaatggattggttcttcatt

SEQ ID NO: 53021 - DNA, 1501 bp, Oryza sativa
tttcatgctcttgtcttgtggtgttggggattagaaaaaaaattgtgtttccttatctgacaaataggcgcacgagttcgaatgttttaatgtagtagttacttatgcaaaaagggctacattactgtgttttgcaatattctgaaaggaggtgtttatatgtagtgactagtgaatagattaggttggttgagatatgttgtgcaagtatttattattttagggcggcaagcgcttttcttatagacgagcaacatgaaaccttatatagttcttgttctggttctggtttgccatttgcaatgtgcgtgccactttttgtgcaaaatagcatgcatttatattatttacttctttagtatttgtacttccaccctttcaactaggtgtctaatcaaagcatctctcgagtatgtatgatctgatgattgatgttttaatgggtttgatctagtggcctcgattgaaagtggcatactgaacaacagtcaaagaagtgtatggttttcatattttatagtaccatgctgtttaacatttcagattgaaatttgaataacatgactgtttgagctaccaagtatagcgaaaagttgttcagctatactataaacatgtatagattaaaatatacatatgaggatgacatatggggtctggacctgcatatcagtgacgcagcaatgttgttttctaacttgtgtgatctttttgttgatacttaggacacccccaagttccctatgttgtgtgtttcatgatcttgtctaaagtatagtagtacatagaatggttaaattccatgtggatgtgtgatgaaaggggagaacatttagttgacctgttatatataatggaattgagagaattgggtgagttgcaccttgggcttgttccatccacacaatattactgtatactgcatagcaatgattaagtaatataataggatgtccacattaggcctcccattttaatctacagaaagctgctaatgtatacagcaattctattaggtaatagcccagtcactgaagtttgatgttagttttcatagatgagtatgtttacctgctgctcaagataactatatatttcaaatcttttgcatttgatgcccctattaattgctagcacttagctgtttgtctcccttttcttgtttgcattttatatagtgattaagttctgtggcataatatacattggaggcctaatttttatcattacaaaaaaacacaagctgacctttttctttcatacaaaattccaaaccattctcattttgcatatagccatgtacacttatagatgcctatactcaattctcttgtaggtacatgcatctcgtttcagttactgcagttataggactatctgacttcaaaacagcggaataggatagcctgggtaccttaaatggtgtgttgggtgattttctgagggtgacccaaattcttttttgatttatttgaacaggtccaagttgccaattcaccta

SEQ ID NO: 53022 - DNA, 419 bp, Oryza sativa
aaggttacttctctcacaagccctgatcactaccatgtagtatagtcatctcccaatcagcacgaacacgattcataagactttcacaaatcagggttaggttgatttgcaggggacaccgccttttcagctttattttcctttcacctcggcctaaaaccggccgtgccactgccgccgcccaatatataaacacatctactctctcgtgcactacaactaccactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagaca

SEQ ID NO: 53023 - DNA, 1501 bp, Oryza sativa
ctctttggcagttacagatgcaaagcttttgcgtgttcaggaaaaaaaatatctggatttcttgtttcgtcatttgggcaatatttactaatccaacacatatgctgtaaattaatctttaacacaagcgcacagaatgttcatataaacgtccatatttgttctttttcctaatacatgtgtttctaaaagcatgaaaagacaggtttgtgtaattaacttgcaaagtgatgctcgatctatatcacctaagatattccaaatctttgggacctagctagcttgtgctttttggagcggggtatttagaagcactactagttccatagcagtgtcctttattaattaatccttcactgatcatcattaacatatccttcttcctcttgtgttttgcatctgccaccacattcctctcagtttcctacaagaagatatatggatggtttaaggaatcaagggcatattctccaaaagcaacgtttttaagccttgaccaatgaaggaaaactttgggagaattaaccactccccacagatggacgttaattgttaagttatttgtgtcaatttcacaccaacaaaaacatagacattattaaccagacttgagactatctcatctttaagtgtcaatcagacaatcactgtcactgctacctaaccacaagccaagtagcaccaaagctaatctcttatagtctttcccattagcattccattagtaaagtttgatcactattacaccctttagttacaaaatcatatcgttttgaacagaaccagtcgtcgtcgagatgcaaccactaattactatggcaaaatattgtggaaaactaatgaaactacacgttgtagcacttctaaattataatattatggatcggagtagtttttaaaacaaacatatacttatatgcatacaattttcatatatctatattcctttaaaaagagtgatgatgatggtgaatgataactctgccaccactcgtaccatcgacaccctactttttttaaggagaaagtataagatcaatatgttaataacaaatatatacataagtatgttatgaacaaatatatgtagaaaataatgatgatgatgatggcaataggttaacaataataattttttaaaattaaaatcccgttgcaacgcacggacaatagctagcccagtgtaaatatttcaacagacttttaaaaaagtttttattgtttgacttaaaacgtaacatgtgtagaacagcctttagctgtcaaccaaacaaagacagagtattcaaagatgacaatatgaacagagctaagctaacagcagcctcaggtccaagcagcagaaaaaacagtagcatcatactatcagtaaataattaaactagacttaacccttccttccaaattaagttgtgtttttgtgggtcccttgaagcctttccttcccttaaatacctcctctgcctccccccccaatcctactcattccattccatcaacc

SEQ ID NO: 53024 - DNA, 337 bp, Oryza sativa
aaaatgtaaaatctcagaatttaacatacctgccggagtgcaatcactggtaattggttacttatacatcgtcgtttgttacaagtaacagaacacatcgacacattcctgtcccagtaaaaaaaatctgacagaacacctttagaaattaagctaaccctcctgaaattgaatgtttacatttacaaatgtattggacatttttttttggtagtggacaactacacaccactagaatacagataagtgggagtttagtttgctcgtactacaagtatgctctttaatattctcactttccagctgtgttttttgacacaactctattccaattgca

SEQ ID NO: 53025 - DNA, 741 bp, Oryza sativa
gcagccccgaccatttacagatcgacagtacaagaaaacatatacaggcatacagccagccacaagagctagctaattaagcaaatggcaccgcttaaggcagcacgcctagtaaacatataccgatcgagtaagttcacgtaacctctcagaaaaatccaattagcaattgctttaccactaagggactgtaactgccagtcacatcaagatgaatcttccctctttctcccaaacaaaattcctaaacacaaccacgcatcatcatccacgcctaaccccctacggtccgtttggttggagaaagtttttaggagggattggaaatttagagggatgagactattaagagttttgtttgtttgggagacatgaaaattttggtgggatgaggatggagaattgaggaaggaactcctttcttttcaatacctgggtaggggcagttaattgggagggaattcctccttcactttgtttaagcaaatctcagccatccgtttttattaatgacataatctctaactaaattccttatcaattttcatcacctctaccaaacaagatattgggattaaaaattaaattcccatcttaatctcatcatcaaatccctcgtgccgctagtggtaatccctgcttcctgaattctgaaggcaccagtctggccgccgtgagtctgtcagtcactccagtctgagacctcaactcctgtgcaaacaagaatacccaacccaatga

SEQ ID NO: 53026 - DNA, 383 bp, Oryza sativa
ttacccgaaggagttttttttttctctcaggtagtacctgcatatgcttggttcatcaatgccggtgtgattatttttgaggcaaaaggaagaagataccaagaaccaaagcgccctttgcatggcgagaaggggaggaagacgaaagcaaaccgatcgccttgttttattccccaaggccaggagaagagtgcagcacagcacagcagcagtgtgagcgatgacaggttggtgtgtgttgcgtgcacccttggttacatcgcgtgatggtgtcaactgtaacagcatgatatgcttagggggtgattagatggggctaaaacttgttagtctatgtcacatcggatgtttgacgttaatttagagtattaaacatagactaa

SEQ ID NO: 53027 - DNA, 1501 bp, Oryza sativa
tgcctcctctcctcctcccacttcctcgtccgctcagccaaacttttgaccgcgcggcagtccgcgaggtcgtggagggaggtgttgtgcacggtgcaccacttgctggtcgggcgctccctgctgggagcgccggcctccttctttttgtcgctccaggcctcccctttcgggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccatgcctcctccttgcgagccacacggtccgcgagctgaaaagctccgcagtggtctggggctccttggaggcgatcttctcaagcatgcggttgtgccgcacgccccccctgaacgcgtagatcaccgcgtgtgcaaggatgcacggtatggtgttgcggacttgacaaaaccgctgaatgtacgagcaaagagactcatcgtcccctcgctgtaccgcgtgtaagtccgcttcttcacctgggcgcggatatgtgccctggaagttcatggtgaactgctggcacaaatcctcccaagagtggaccgacgcgggtggcaagttcattagccaatcccgcgcctgtcctttcagggccatggggaagaaattcgccatgaccctgtcgtcacccccggcggcctcgatcccagtcgtgtagatctggagaaactcggcggggttgacgctttcgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgctcgatattgaggcgggcatccggcccctcacgcacatcttcttgggtgggaggcgttgacgagggaatggcagatgaacggcgggtaacggctgccgctcgccgcgcccttcgcctcgacgacacggagccggcagtagcaacgccagtggccttggtggcggaggaccgcccgccggcgcctaggcgctgctgcgccgtcatgaccaagttggccacgtcatctagccaacggcgggttggagtctctggatcagggacgacgggcgggtgacgcaagagcgcgcccgcagcctggagcgcgccctggggcgtgctgccatcaccgtagacgaggagacgacgctccccgtctcgccgtccttctccatcgcccgcgtgcggcgaagtcgcggatctttcgaccccctcgagcgcctcctcccgcctaagacttcggcgagaggggggcggtggagtacgagctcgacgacgcgggttctgctcgctgtcgtcaccgctagcgctcggagagaggttgtgcgcc

SEQ ID NO: 53028 - DNA, 1501 bp, Oryza sativa
  unsure (1)..(1501): unsure at all n locations
ccctaatagggtccctcccgagtgttcattcggtgagatctacccactccctatggcggtacgtctttggatattgtcccaggttgcacataatgtgttcaaggtgtggcagcgtgattctacgttaacagtctgatcactggtagagccagggcctcgttggcacatggttttgcacggggttcgttggcacgtggatagaaatagttataatgctatatagtcggttataattggtttcgtccagactccataaaatttataacggatattggttgtggcactagagtacatatcaatcactaaaagatgaattaagattggtgtgtttaacctcgttgattacttcttgttttgttttgttttgttttgtgttggtggtacacacgcatgacatctgcaacggcccagttcttggtttcaaatattttgtatctagataatgaattccatgtgccaaaaccgttccgaaaatatgaacaatagtacaattcggtagcttcaacttgagctgcaatgttcactctctagtatacgacaccaaacacatgtgttagttaagattgatcatggataaattaagggcttgcatgcaatttccacacaaatgtatcacaaattcagaaatctttgtcccttctcaaagaaaaggggcatctaattgtatatgtaagtacatgaattaaagatggcagccttttcctcttcctcttttcactagtggagagagcacaacgggatatgatctttttaaagttggaagcaatacaaaaattttttttaanannnccnaaaaaaaaatttggtgccnacaacctgaggaattcgtgtgcaaaatgtgtgtcgccttgctgaatctaagtagcttttgtttcctcaataatgcatcatgatataaaattctccattcatcaacgtatgcatgatgatgaatctacttaataatctagagtaatatttctcaaatgtcaccaaacttggagtaggatgaaaaagcaggcccaaaaccaaagccacctctctggccggatcatggtgtggaagtaatttagtctcaaatagggaaaagcaagacagaaagcaaaatgcaccagaatatacttgcataaagagcaaaggttaccaagttattttattgccaaatcattagcaaagtgcaaggttatggataagctcaaccaggcagctaactgaataatttcttatatatgtgaaattaaccatttttcccatgacaagaagttacatactatatgataaaatgtgagcttagtaagaataacttatgaaagtattggtgcaatatttggcttggattcaactagatatcaatccttttcatctcctaattaaactaccctttttttcggattgaaagttggacacagatatcaaacagatatgaatacaataccatgtaaaatatctcgactgcgaatacagagagcagaatcaactatttatcattgatataaaggaaaaataaattccacataacgtc

SEQ ID NO: 53029 - DNA, 1501 bp, Oryza sativa
tcaaccaattctactaagatatataaacttgctctaagagtgcagaaaactttagcagcgtaatgatgatcctggacgataatgacgaggaggacggcgacgttggagcttagagctcgactttgtttcgcaacaggccgaccagatccgcccgcgcgtggcttcaattcaattccatatgccttccggagactaatgtccaaaccaagtaatcagcatctagtccttttctagtaaaaaagaagttttgaagagagagagacgtacctccacatattattcaaaaaaaaattataagcgtattaggcaatgataacactggacatcggattaaaacactactatagaaatagctacaggtgctatttgagaacccccataggaaacccccaaccagcacctattagtcggcacatttgtggtatccttaaatgtgccggtttaggaactggcacctttaaggttccaaataaaaaaagggcctaccgtcacggtggccaacgacaagaggaggccgcgccccaccgtggcagagaggaggagagccatcggtggggcacagaggagagggagacaaggcgagtgttggagaggagaactgccgccatggccgcgcgcgccgaggggagcccgccgcctccgcacccaccggatctggcggaggcgagggtgcacccgcctccgacgctgccgcctctgccaggcagccgccagccacgagagcctgcctcctcccctcccgccggatctgctgtaggggaggtcacagccactgccgccgccaggccacgagagagagaggggagggaaagagacgcgagagatggaaggcagagagacgcaagagagagagagagagagagagagcgagcgtcggacgagagacgcgcaagagatagagagagaggagggagagagacacgagagatgggagggataaggacgcgagcaccgggctggagtagataaggacgatactctcggctcgatttgatacatgtgcggataaaccatgctccatcgacatgatcaaagtctacaccagacatgcatgttgggtgtgtttgaatctccactttttaatatattatgatacacttttgattcatttatacttttaactttgttacatttaggaatttaaaaatatatatatgtaatggatcacccatataaaaatcctagatacaacactagttaactataatgtcacttgagcatcacatagactccacgtaggatgaaaatcgggtcaatgtggtacatgagcgccatgcatgatgaaactgctaaagaagtcaaaatgtgccagttttaatgaaggggaggttttataatccagatatgtggttgagagatataaatcatatttaggttatagttgagggagtaaaaatgcacttttctggccctatttgcatggatgctatggccatgcatgcaaaatgggcctggctgacccaggcctgtttgatgcaatttctaagtgaatatatataga

SEQ ID NO: 53030 - DNA, 1501 bp, Oryza sativa
agcccactgctgcgccgctgcccgccgcctccgcactgccctccgccccgccgcgctggccctccgcgccggcccgctctcgctctcagcgctctcgcttgatctatccaaaaagaaaagagataaggcaggaaagagggagggagttagagaggaaaaaaagagatagagagagtttgttgtgtggacgagagaagaggataagtaatagggattatatagtacgtgttagatttttattcccggaattagtaacaccaaccgggactaaagttatatctttagtcccggttggtgttacaaaccgggaataaagatcctaggcgcctgacacggtctgatagggaaccatctttagtcccggttagtaacaccaaccgggaataaagattatctagccctgttattcttataaaccgggactaaaaatcgtttttagtcccggtttttaatagaacccagactattgtggatttgggtcgacagaccaaagatggtttctccaccagtgtataccatatgtttttgggctagtcaatctatgatacgatattatcggtctaatgatcttattaacgggttgcactagttcttacctctccattcatagggtggaagtcccggaggaattagtgtcattatttattaatgtaagcatggtgcttggattaattaaatgtcgtttggatgcgggtgttcctcacggaaagtgagataggcagcaggtggtgacaacccctatttgttctctatattcctccacgttcgggtatgatgtaagagttcataaaatgctatagccacactggcagaccaacagggagtggcctcctggtagattctggttgcctataattaactatgtcctagccatgtgtatgtatatggttgttgtatcgactaagcatgattagtatatagaagtacatttgaaaccatagctatttctttagttctttctccactagctagctaatacattgggatgattattttgtgtgtcacattacccaaatactatcattatcatttacccatgtttggactatggtatattgattatagtatatggttatgaatatatcaacctactctttacaccaccgtgtttcctgtggaaaaacaaataacgatacccatggaatactcctaaatgaaatgctacagcggtattcgtgcgcttgtggatttatctctgaccgtatcaaataccaacacatgggtgggcaaggaactggtcgaaccaatgctcaagatattcaaatccatgtcagttaggaagggcctcaacctcaatcctaagtggatccattatagggttaaggctagggattactgtcgaagaaacgggaagcaaagtccaatctccgactgctcgaggcatatctatcgcttgccctcgtgcacggccccccattgggctgagcttggggcacatttgccctagaattgaggacacatccacctttgggcatgccacccgtgggctatggtcgaggca

SEQ ID NO: 53031 - DNA, 1041 bp, Oryza sativa
atgctctttttggaatgatggacctcctctttctatccatatgccaagactgtcttcttttgttttgaatgcaaagatcccagtcacaattttctttcaatttagttggaagataattttcacttgcccctatctcaagaagcttatcttaacttgtagtctttgaaagttttgcttaaagaggtaagcttgtcacaggaaaatgatacatgggcatatatttggggtaatttgaagtacaggtcacagaagttttacattcttaattttagagttttgcaaccacctcagcatttcctttggttacggaagagtaagacaggtcaaagtgtttggttggttactactcatggaaagattaaatataaagtatatgctggatcataaacattgtgctcctccaaactgtgacctccaatgcgtgttttgttcaactcaatctttggaaatcttaatcatcttttttttttccaatgccctttctcagtgagattttggaatatcttagatattgtttgggacacctctttgacactagatagcatggtggtggaagccagagatagataccatggccattactttatggaaaaattcttatttgagacatgaaatatttggaagcaaaggaatgggtttatttttgaaaatactcatccttgtttgtcttcttggagataactccctaaggctgatctcctccttttgttgtttaggttgaatgagagagataagaatgtagttttgagttgaattagattgttgtaatttttttcttttttcctgtacttgttttctttctttaataaaaatctatttaacaacggggcctcctatgctgtaatttctttaaaaaaaactatatattgccatgaaggtctcactactagaaaaatcatttttcccaacgtgggagtcttattttcgcaggcagacatgacccttagagccaaatgaccgcctacaaaaatataaatcgagatgaaatttgatgtccgcctgcgaaaatattttcacaggcggaccacttaagcggcgcct

SEQ ID NO: 53032 - DNA, 334 bp, Oryza sativa
agtgaggaactgcgtgtttcgccgttcgagtgcatgctaatccgttaatcattgcggccgtggtaagcaagtgcctagctttcgtgtagcacctatcattatatggcgtccacatggtcaggaggtactcatttgggaatagagggagagggatgcgtcctgcaataagcaattccgtgttagtttctgttgctatgtcccttggccagaatttgccatgctactggtgggtttagcacccaacggccagacggaatgaattgcaacggaggaataaatggaaaggaagggctggaggtcatacagcagtcagccagccatatactgtacttca

SEQ ID NO: 53033 - DNA, 338 bp, Oryza sativa
ataaaatataatcactttacgatttaagcagtatgacaccacacatatggaaacactctaagaacgtaaagaaaatactattaggcaacacccctataaatttaatatttttgggtagataatggggagaggaggcaaatgtgtgtatcagtgtatagaaatattgcactggagttacggtgggttatgggaatgaaaaatggcttcggaagttcagccttaacgaggggtttttgatttccagttggagcattggaggatgagcttaggttaagtttcccttagcaactagagaggaggcagaaggggatgacaaggcagaggagccatacgagaga

SEQ ID NO: 53034 - DNA, 421 bp, Oryza sativa
gtcactctgggtctttaggcggcattgactttggttctgtcctagtcagcgtaggacccacgcggaccccacatatcagtgacacctcaccttcttcttccccttaccacctctcccccatcatcacggcgcgagcagcggccggcgcgtgcgactgtcgccgtctcgtccatcccactgtcgcgtcactctttcctcctcttcggctccctcctcttccccctccggtccacctctttctctctctttctcttcccctccatcgtcgggcaccattgccgcccccctgtgtcgtcatcgttggcggtagggatgagctacttcggtagctactccacctacctcgaaaccatcttctccgtcgtgctcccgccgctcgactcgattgcctgactaatttctgccattgttttcatgcagt

SEQ ID NO: 53035 - DNA, 1501 bp, Oryza sativa
aatctcactttccagatatcactacaaaaacaaactgcgttttctcccttagcttcttttttatcctcacttttgcgttctccatgcacgatcgataagccgcatcccatactctgcaaagccacccaccccgggtatctcactgatgcacacccatgaattgtaagaacaaagaactagtataaaaaaaaaactttcttcaactctcgatcctaaaatatagaaactgaattttgtttcgaaattaatatagcaacttctacacctactcctgttactacaacgaatctgaacaccactcctagattagctgtttttggacggagggagtacttccttgtctcaactaattataaccatctcttatttaatttcttcacccatgctttcttatctcaaccacaatcacaagttcacaaccatttatcatttaatttcatctctttcttaatctttgtattcaataaatttcagaagtgattagggtatgtgcaattattattagcattgcctattgggaatacttggtggcagaaaaagagaaaaaaataaatagatgatacaaacaccgttgctacggttaccaacaaacacttggcctctataaaatagaaattttgctttatgaggatgtgagaggaaaaataagtagtaaaaatttattctttatgttattggttaaaattaatctttaatgttttaatgttgtaaatatataattataattaaatatgtatttcttcgagcttatatgagggcctgtttagattccctggcaagtttttcaccctgtcacatcgaatgtttggacacatgcatgaagtattaaatatagaaaaaactaattacacagattgtgtatatattgtgagataaatcttttaaggctaatttctttatgatttgataatgtggtaatacagtaaacatttactaatgatagtttaattaggcttaataatatcatctcgtagtttacaggcggaacctgtaatttgttttaggtcatgtttagttctttggccaattttttttgaagtacactgacacacatttgaagtattaaacgtagactaataacaaagcaaattacagattccgcctataaactgcgagatgaatttattaagcctaattaatccgttattagtaaatgtttaccgtagcatcatattgttaaatcatggctcaactaggcttaaaagattcgtctcgtaatttacgtgcaaactgtgcaattggttttttttcgtccacatttaatgctccatgcatgtatccaaacatttgatgtgatatttttgaccaaaaattttttgggatctaaacacactcttaatattatactgcgtttaatatttcaaatgtatatccgtatatccgatgtgacacgataaaaatttttacccttcaatctaaatacaaaactgagatttttatcttttgaacatactgggatgaaatagtaaatttggaacaacccgtcccacccctcccatca

SEQ ID NO: 53036 - DNA, 242 bp, Oryza sativa
taggttgagatatttctcgcttaaatcctaaggtggtattattatcctcaacatttattatgggcctttgagatttaatattataagttgggcctagcccaattattctaacagaaaccacttcacacaaagtcctctaccagactaccactaccatctgacctagaatgggttggggaacagtacctccgtcctctctcttcgggcgttcgcggccggggagtgctccatccacctgcagc

SEQ ID NO: 53037 - DNA, 528 bp, Oryza sativa
gatcagcgtcccatattatacatttgactgagcacatgcatatctagatcgcatcatgctgatatgtgtacctatgtagcaacctgataaaggttcaactcggtaagattaaacatagcatactcatttggcttggttcggatgcacaagacgtgtaccgaaataagtgttccctaagtttacgtaccaagtttctcctatctattaagttactgtaccatcgatacaatttactctaaaacttttatatttctattcgtagcagtctgaaagacaaagctgctaaattgaaaaatagcaaaaaaatcataattaattctaaaatcagtatttacattcaaattttctagtgatatatacagataaatgtttcttgtttgtttagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagg

SEQ ID NO: 53038 - DNA, 1501 bp, Oryza sativa
gcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctcttacaagagaaataaggctttggtttagattattgggcgaattattgcctaaatcatctacttaattataggaataaatttaacttttaaaaaatatatttacgagtaattctaaacaagtggtttaagcaatacagtaaatgtgtacggggcatcatggtttctttaagtacatgtacggtctttaaacttgtggatgtgtgtcatctagggtcctgtttggatccgcggactaaattttagtccctgtcacatcggatgttgggacaccaattagaagtattaaacgtagattaatgataaaaaactatttcataaccatggactaattcacgagacaaatctattgagcctaattaatccatgattagtctatgtgatacta

SEQ ID NO: 53039 - DNA, 812 bp, Oryza sativa
ccgcaacagcgcgtccacgttctttttcctgatagataaggaggccgcgagtccgatccgttttcttcgcttctttcccggtgttagtttctccttctccgcgcctgagttgctctcgcttccccgcttctgatctcttgcgcgcacgagagattggaaggagcagtgcctctgaaaccacaccttcgcctgagatctgcaccgggtaggcgggtgatcaggtttttggggagtgcctcccgcacgactgctcatcgccatgtctggagttgccgccgccactgctggcggaggtggtacgccgccgccgccgacaggagctggatctggatctggagttggtgcgccaggaggtgccgtgaacgacaacaacaacggaggcaattctgcctcaccatccagcggagggccattctcggggtataatcttctcctcctgctactgttgttagcgctattcctgttcccattgttagcgctatcgctatattatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcaatttcttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 53040 - DNA, 1404 bp, Oryza sativa
ccgccggctgccctcgtcgtctcctcgccggccccggtcgtcgtcgtcgtcgtcgtcctctcgtcgtcctcatcgtcgtggcgttcgtccctccgtcgagccgttctcgtccgtcgtccgcgttcgtcaagtgtgccgctgcagccccgtcgtcgtcttcgtcctcggctccgcgtcgtcaagcctcgtgccggccgcgtctcgccttcgtccaaggatcgccgccgaagtcgttccctcgccgtccgtctccgccgcgcccgttcgtcgttgtcgttcccacgcctcgtcgcgtggtggtaaggatccctctccctcgctgccccgtcctcgttctttcggtgtcgccccgtacccgttgtgcggttgtcgaccccggtacccgtgtaccggtgtcggtagtcgttcgcttgtgcgtgtggtgaccgtgttagtgtgcccgctcggtagcagcgtggtttctacgggtgcagcccgtgtggtgtctagtggagtccgtttgtcggccactcgcctcgattgacacacgggatctgcttccgtcgacccgtggaccgtctctgtgtactcggtctaccgcggtcctttaggttgacatgtggggtccgcatgtcaacggcgcagccctcctgtcttttccaggctagcgcttacacatgttttataattgcaaagcttaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgctttgcgtagcttctgtcgttccggaggttcccgaagcgtggttcgcggccgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctaggataaacaaaaccccaactagtgggtactctactcatggttccactagtatgaatttaggtagatgcttcgctgattaattaggcaacattaggtggttttataactttagactttgggaattctcacatcatttggacactatggaatggttggcttatgttggaattggacacacacctccccctctattcaaaacccccaaaatggttttaggctgggctcgaggtgcgtggttgggtttggttagtcgtacctcgggtactataaggattaa

SEQ ID NO: 53041 - DNA, 1501 bp, Oryza sativa
aggggaagtttgggaggggggacccactgacaaacataggaaaatttcaattctcatacaggtatctattggagaaatgctgtttatcaataattcttgagtctaacaactttctttaactgagcacttgtatcaactttgcaggtttacatatcacgtgctctacttgataactcctctttgcactctaatgctcaaagcattagtcgaagcttggatcatgttatgaggacattatttgagatttgtctgcgtcaaaggtggtctgagatgacatccttattattagagtactgcaagggtgttgaccacaaaatatgggcagtttgtaatggaccttcctaatgaggtttttcatcagttaccgcttgccatttacatttttatgtgtttgctatttttttatgtgttctctgaattagatatgtaaaatagtagacttgaggatgaaaatatctatctggatcgtctttatgggatagaagaaaatgatatcggagctctgattcactcttctcatccaggaaaggtatgccctgacttaacaagtggtacctgtaactttgcaaagttcatacgaatactgcaattactgaaaagtactggctaatgtaatttacaacaatcttttgctgaaggtctttccatatgtcaacttatcttcttgtgtgagcccaatcaccaggactgttcttaaagtaagggcttttggaagccatctgcagccttttttgctgagaaaggtgaactcccaaagagatttggtttagatcagctacactgggaatcctcctgcaggtgataaactgtaccagtcttcctttttcttctctaaactgatatttctaaagaaatgtttctttcaaataaatgtatgatgcattaatccagaatgtcttctgttgaaacctcaggatattgcacagcggttcctctcttggtcatactccctgtgctagagagttaaggtacgcagaaattcagcactgcagacctgtattattaattgcacctaattcaacataagggcttgttagtgcctttggacattattatgcttattattgcaataacttcacttcaacgagattgttttatttacaaatgaggatagtatcacaaaggtagatatgctaagcaattaagcacactcatatagaatcagtaataacttgttatagtctctatggtctcctactttcctaactactactttcgcaacatattaccttaatattgcttcatagtattagctaaacggagaaacatgtgtagggtgtactaaatgctgcttgtccacttgccacttgcattcacagatccatcttagtggcattgatgtgctttgtctttcaggcagttgctcttagtggcattgatgtgctttgacttgtacaaaacatccttggatattcttttaatccatcttgagttatctgtccatgtgtagctttctcatctgagagcagcataatattcttagagatttattgaacaacta

SEQ ID NO: 53042 - DNA, 1501 bp, Oryza sativa
cccccgggccggggcgggacccggcgccgctatcactcgtgccgttcgcgcgcctgcgcgtgctcgagctgcgtgggtgcgacctctccacctcctccgccgccaggggcctgctcgacctccgccacaccctcgagaagctcatctgttacaattccacggtgcgattacgacatgttccccagtaattctgatcctgcagctacttaattcgttgtttccggcaattcacatggtgagcagaggcgctagttttgatctcatactaaactatgaactatattaagtgtgaattgtgcttattgtttgcagtctggttcttctacatccaacgaactggttttaagtgttatcccacctatgccccacagaccacaaagccacaatcaatactatgttcctaggatctgacccatcctggtggctggcacatatattacaagtattgtactatagttactcagcatgttactggcttttctatgggtgaatttgcccattttccgagttctaagatactagtatgacatatgacatgacgccacaagcatttgatggttactaatgtttccattgtaacccatgggatttaacgggatgctgctaggtctttaggttatcatcaagcacccctctggtgaatatgaatttgatagcaatctaatccacatgctgtttctctggactagagaattgtgagcatctttgcaatactaagttctgatcacattcaggcttgtgttgtgggtttgtggcacatggtgcactccacagtattgcaattgtagcgtctgtcccttttgtgctcgctgcaattaccctcctgacgtgcttagttaatctctgaatgcagaagttgtgtggcactgtagccatttaatatctttgtacgtttgtcttgtgtatgctttcatgcagctgaaaatagggttatgcttcttgacatactcctttgcaaatttactgaggaaaacttaggcaatttgtcatttatctgagttagaggtttcagtggagtccgcagtggtcatttaaggtaataatgctgtaataagtcatcttgtctaggtaattatcacagggtacccattataaacaactaaaacactgttgattggaaacaaacaaagtgtttgtgtgtgtggatggaccgtgtaattactagtagagacatataattgactgtttagagcatatagcctgagaacctcaatatttggttgtggctttagaggctgcaatttactgggcagtgccattgcttggatcttttattggtacacaaacaaaagctcagtagcagcaaaaaagttaatagaggaagaagttgcacagttagttgcattggtcaaacaattcttctgattaggcttcctttttgttcatttccacacaatgcaacaatactgtccatggccatgtaacagttcagttttgcactacttcaggatgctcttaggcatatcttcacgagcaggatcatggatatcaaggactcacc

SEQ ID NO: 53043 - DNA, 170 bp, Oryza sativa
tttatactctcgacctatctatcaccaatactactacttttttttaataatgagaaatactttttttaataatgaggaacactttgggtatttttactcctcgctaattttacattgggatgctaggattcgtctttttttagaacggagagggagtatattctaaccga

SEQ ID NO: 53044 - DNA, 1501 bp, Oryza sativa
ttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccaggggggtgcacacgagtgaagacaaagtgtgcagaaaagacatgtgttggtctgtgagggcagtctatgacctatgaaagctatcagatgtaagtggacccggcctgggggaaggcgggacgttacaactagcaagccgaactttcgacaaacaatgcatgttaatgttggcgtcgaaaatcgctagcacgcatttaggatgtatttgaggaggaggggattgagaagattgggaagatacacaaaacgaggtgggccattagcgcataattaattgagtattaactattttaaattacaaaaattgattaatatgatttttttaaagtaattttcctatagaattttttacaaaaaacgcaccgtttagtagtttaggaagtgtgcacgcggaaaacgaggtgttttctcacccaatatcactggaacgaacgcacccttagtcaagaacaaattaataaaaagataactatttttttgaaacgaaataaaaaaaaactatgcactttcgtgataacgaccgaccaatttttcaatcaaatcagtaaaggaattagattaatctactcctaaacctagaagaataaattcggcgctgagctacgacaatttggcacttcttcgccgcctcagatagaatctcagcgccaatattagtggcgttgagatgttatagctcagcgccatcggggttggcacaaaggctcatttctacaattagtttttttggtacggttcaatcttcaaataagttttctaaaagagtcattttgtcaaaatttcggagaataaagtgaggtagattatttttttatcgattatattaggggtgtgcagtaggtgtaaaaacgtagctcaaccttgtcgggccaacaatgacggtgctttgggcgtcatttccctcttggggtgttgtctccctctttctttggtggggctgccaggtgaaaacctcatcttggtttttctcgagaccacaacggatggcggtgtttgtgctcatcgctgcttttctccctgaagacttcgtccaggagcccccctcccccgcgccaaaacttctctcatacaacttgtgggcgctctctctatatgtttgtccttttgcggtgtagtcctatctaatacaagctagccatgttggcaggccttatggaggagagcggttacattcttttctctcacctttttccttccaatccatcaggcgtagatgaagttgagtgcggtgcttgatggttagagtttggttttgggtggttcggatgtagtttctttgttggtatagcagc

SEQ ID NO: 53045 - DNA, 1501 bp, Oryza sativa
ttcaagggtctcttctctcagtcacacaatagtttgtttcaccatccaaattcacgggatctccgatcacaatggacaggtttccactattatgcaaccttaggtgggtatcaagtccatttccctcgatgcactgtctatcacattacgtggtagccccttggtaaactgatctgccagatttctagccgtttggacatagtccaatgctatcactccggagtggacagatttcagtcttctcttgatgtgtctagatgacttcatgttgtccttggaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacgcatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctatacaagtacatcaatgaaccaataatttgagagtatcttagttgatcccttgctattcttcggtttttccttaatagcacgctgggatcataaggagtaggtgtcacgtcctgataaattcatcccgaaattaaaaatcattcgctaaaaggaataatagaattaattaaaattcggaaagaaattggcaaacactaaaatacatacaagaaaaattcaaatgtggcctggagaatttttgttaaattctctttggtctaaaaggagccctcaaattttacttgaattttcagagcaccggaaataattattaagcaacaaaaacaattatcaaagtttattaaaaagaaaaacctaaaaataatcctccttttcttttgggccactccctctctctcttccggcccacggccaaagtctccctctcctccctctcttttcctcctctccctccttctcttgggcctcctctccttcctctcggcccactccctcctcctccctctccgtcccgggctgcctctccctcctctcctcctgggccgcctcggcttcacccggcccaagccgagccgcgcctcccacccgtgccgcgcacgtgcgcgtgcatgcgcgccgttgccgcgcgttgaccgcgcgcctcccgcgtgggtcccgcctgtcaggcgcgtccccgacctccagccgccggcctccttcctctctctcccgtgaaccctagcgccgttcctcctccaaatccgctccattcaagccggctctttccaaattgattagggg

SEQ ID NO: 53046 - DNA, 1501 bp, Oryza sativa
agctcatgttacttatgtgacctagctagaactatatgcttagccatgcttaattacaactagctcagttgatgggataattgcagtattagacctttttagcatcagaacgagctgcgtgctcgagacacccggccatgtttcagtggtcgtaattatccaactaaaatgcgactgaatggtgggctgtgggtgcatggttttactagtcgcacccatggcagttaaggaccggttcgcgggaaaccctggaagaattcctcgtactttccacaagccagcgtgggcaacggctgggcttgtagtgtagctttcctctagctgacgcatccaggtaagggtgggcatgatggagtttggatgggccctgcgacggcctatgtggcttccggattcaccatggcacgagaggggactgcccgctgccttgcgaggagtgggggtgaaacctgaggtgtggtgtgcttggttagagggggttatgcgaagggtcctgtcactgcctctttccggtatgtggtggtggcatgtcggcgcacggaaacatgtcgtggggctgtgtcttgtggttacaattgtaaacctctggccagagtaaaactattcgaatagccgtgcccgtggttatgggcggtcgaccagattcaccgtgattagtcccaccttaaaaaatcgactcaatgcactgtagttcaggtgggttggttgggcctgttcaacgtggtgtagcgttgatcagtggagatttaatgttactttaattactcaatagttttactgttttgctcaataaaatgttttacaaccacctttatgcaaatagccacaagccgtccttgtatccccttgcacgtctgcatcatcggtgtggcttgctgagtacggtggttgtactcagccttgctattattctccctttttttcagaagtgtagtgcttctgagctggaggcgaagttagaagaccaaggctcagaccccagttgagttttgcctgtggagtggagctgaagccctgctaggatcgtcttttctgctgctgctgctttcttttcggtgtgaggattaagtgcctcttctgtaagtatttacgctttatttacgtttggaactgtatattacttgtcattttgtgtaccctggctggtactggacagggatttaatacacaaaatagtctggaaatttgggctaaatttctgggtgtgacaagaaccaccttgatagtacaaaacactagagattagagaaggaggaagtagaagagaggagttgtggttgtagcagtggtggaagccagggaacttcccctgaatccttacctcgccggagttttgctgccagctgcatctagggttgaggaggttggaagttaggtttagcttggggtcagactcatgaggagccacagaaccgatttaggccagcagcggctgcggggcggctgccggaggcagggaacagcggcgggcgagacctgaggatgtggcagcgtaggggag

SEQ ID NO: 53047 - DNA, 1501 bp, Oryza sativa
acaccgaaaagaaagcagcagcagcagaaaagacgatcctagcagggcttcagctccactccacaggcaaaactcaactggggtctgagccttggtcttctaacttcgcctccagctcagaagcactacacttctgaaaaaaagggagaataatagcaaggctgagtacaaccaccgtactcagcaagccacaccgatgatgcagacgtgcaaggggatacaaggacggcttgtggctatttgcataaaggtggttgtaaaacattttattgagcaaaacagtaaaactattgagtaattaaagtaacattaaatctccactgatcaacgctacaccacgttgaacaggcccaaccaacccacctgaactacagtgcattgagtcgattttttaaggtgggactaatcacggtgaatctggtcgaccgcccataaccacgggcacggctattcgaatagttttactctggccagaggtttacaattgtaaccacaagacacagccccacgacatgtttccgtgcgccgacatgccaccaccacataccggaaagaggcagtgacaggacccttcgcataaccccctctaaccaagcacaccacacctcaggtttcacccccactcctcgcaaggcagcgggcagtcccctctcgtgccatggtgaatccggaagccacataggccgtcgcagggcccatccaaactccatcatgcccacccttacctggatgcgtcagctagaggaaagctacactacaagcccagccgttgcccacgctggcttgtggaaagtacgaggaattcttccagggtttcccgcgaaccggtccttaactgccatgggtgcgactagtaaaaccatgcacccacagcccaccattcagtcgcattttagttggataattacgaccactgaaacatggccgggtgtctcgagcacgcagctcgttctgatgctaaaaaggtctaatactgcaattatcccatcaactgagctagttgtaattaagcatggctaagcatatagttctagctaggtcacataagtaacatgagctagtcgatttattacccaatgttgacaaatgacatatatcaagtaaacatagcacaagcaagcagataggtaatacccggatcccatgtaattagcaagacatgcatgtttatttgcaaacggtaaaatatttataaattgggatcaacatgctcaaggggaatgtgtgacttgccttgcttcttcaaaacaatcttccgaactcttttcctcgcgaccgcgaacttccgaaacgacggatcctacacgctagcacgcaaaacgaggaaaaactctaataaacaccaagaaaacagtacatgaaaagtaaaaaaacatgtagagcttaattttagatgaatttttcaagttgaatggctcaaattggagttcgtatgaattagatatgaattttagaagttttgagccatttaaatgaatttctggaattaataccaatttat

SEQ ID NO: 53048 - DNA, 1501 bp, Oryza sativa
cagattctagcatctttctgaaagtcttcatagaagctacaaaactaatccttgagcagttcagccgatagttttgctccggcattagttggtgtagaagcgtattctccatatgatgtgcatctccgatgagtacgctcttctccatcatcatctacaattggctctagtcttgggaattcagcttctaatacggatggccgattgacaaccttcatgactatcaggtttaaccaggtttgtagtagccactagggtccacctgctctaactactgagccgactgctatcttagctgatgcattgctcagcatctggtatagatagccgaggagaattttgcccaaggagaatttgtctctttgtttctagagcttcagccagaaattgccagttgattgtggggccacaacttgatccacaaaaaagaaatttttctagccacattaataggaaagccacatgttctcgaggggtgaccgagccttggcccatgtatgctgccacatagcctgaccaaccccctatacttttggttttgaagtcatattggttctttgtgttcaaactcatagggttggccgatgaggtaacatccagacctgtgatcatactgatatctatgagagttggagtcatcggtccttgattgaacagaaaggcattggtagtgtttgaccagaagtaagaagcagctgccatcaggtgttcatctttggctgagttcgctatagtaaggtcaagtgcttggccgattccaatttcatcccagtgaaccctcttgctggctgatacacgtttgaaccatgtggtccagctcttttctggtggaactttctctagggatggccaggatttgaaggtgttcttccagtgacctagatccgggttggttaatctgaaggggatcctattggtttcaccaataataaactcagtggggtctggattgccgactgggccaagaaagtagtgattttcatgcgccaggctgggaatcgcaactaggttggaaaggtgctacaaatccaaagcaatccagagggagagagtgatatcagattggagaagatcgatttgctactaaagaaggggatttagccgatgagaacttacctcagcgtgttcggccgatggtgcaccaagtgggttggcggaagacgacattggtgcgggcggagatctcgctgggaaggaagtcgcctaggaatcgcctttgcggccgaggaatcgccaagaaaagagagaaaaggtttcgcttgagcggtgaaaacggaagtcacggcgtgagatttctcgggggtaacggttagtatttaaagcgctggaataatggtggagtgcgaaacttgctcggagtcagcttatggcaaatccggaacattatcaaatatctcggacttggggggcatgtgttaacaaccaaatttggtaacatcagcgtcggagagaagattagatcgaagcaaagtcggaagcggagatcgagtttgaaaacagg

SEQ ID NO: 53049 - DNA, 1501 bp, Oryza sativa
tcggctgtagatattaacaatatatactccttatatcgatgcatacttaaatcaagtgattgggaaagatcggtcatcatgccgagacagtataaatcacttagatcaaaatatatgtcaataaaaagattagatatgtttatagcatagccgattagatggatctagcatgtatcggctaatacttcgatactactctatatcaagatattaaagcaagtataatatattgagcaaaagcctaacatacttaaatacagcaatatctcaatataaagggcagatttaacatgtcaatgaggcatatagaacaaatgaagttaaatcagatacgatcagctgaaactccgatactattcaaatcggcaactagaaggcaggctagagatcgatattctaagcacgacttaatagatcaaactaaactgatgcagcattaagtatgaaaagaagaacgatatctagacaatcaagccgctagaagtttcatagaatggtagatatctcatataatctagatcaacgtcaagatctaacctaatcggctgtcttctgcatacagatattggccgatagtagtctagatggcgatattgctagagattatgtaagatatatgataacttgatgaattacataaacaagattagagtgtcatgaagatggaagcactaatcctaagaacgcaatccatcacgacgaattttacctcttgttgaagatcgaaatcgatgcagctcaacctgaaagcaagaacccgtcgaaacaaaactaaagcaagaagggtggcgatgcgccgaaattgtgttgaacatgtgtgttaaaaattacttgggactcggggtctatttatacccgaggattacaagatatgcccataccggacacgaccattatctctaacaaactctaagataccacaagactttgcggcagacttttgcccacccttatctataaggaatttacataaaatatcctaattaatagatataattaccttcccaggactctatccatgcatggcaatcatcctgaagtacattcacttgaacccgatgtcgcacacaagtcgtattgtcggaatcggctatatcggcttatttagctcgactcagactcagccgatcttgtcgtagccgatctagacttcagccgattcctgccctgttttcaaactcgatctccgcttccgactttgcttcgatctaatcttctctccgacgctgatgttaccaaatttggttgttaacacatgccccccaagtccgagatatttgataatgttccggatttgccataagctgactccgagcaagtttcgcactccaccattattccagcgctttaaatactaaccgttacccccgagaaatctcacgccgtgacttccgttttcaccgctcaagcgaaaccttttctctcttttcttggcgattcctcggccgcaaaggcgattcctaggcgacttccttcccagcgagatctccgcccgcaccaa

SEQ ID NO: 53050 - DNA, 286 bp, Oryza sativa
caatgatgtcggtcaatcccggcttcggcgccttgcctttaacggaacctgggcttgatggtggcggtggctgtttctcggccatgaggagggactgacgtctgacttttaatcaggtcccaccgggcgtgccaaaagcgtgttgacagaaaacatgtggcctgggagatctgcttaactccagtgtaggtccaaagctcaccttcggatatattagcgtaacagttgatttgatcctgtaatcaacaagaaatagaagcaaagaaaccttagttaaatctataaa

SEQ ID NO: 53051 - DNA, 153 bp, Oryza sativa
atgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttc

SEQ ID NO: 53052 - DNA, 880 bp, Oryza sativa
atgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcgaaaagagttcaaataaaatcaattgcaaaaaaataacagcctttctttgaagcctgcattaaacacttattttccatggctttctgagtactcccgtactcacccttgctttatataaataattcccccccagttgctgaagaagatgaagcggatcccgctgacgagaagttcttccaggagcaagccggctacgatgagttttagggtttcggcctagttcccaagtcgcgcctgtgatgtttggtccaagtcttggcttccgcttcccttttgtaatgcagttgtgagctcgggatctgtccacagcccaacatgactgtactcctactctataataaagagacctctgttgctgtgatattctgtcttcctgtgataccagcactgttttcctgggactggtatcgattaacaggttaatttggagcgtcacgggctagttccgctcgggactagttcggggcgtgacaacggccaaactgtcaggccgagtcggcacaggcccgacaccagtcgtgccgtgccgtgcttgggctaggatggctgtgccgtgggccaggccgtcgggcctcaggccttatggccatctatactatatcctttgatggtttaggaagcggtttctactaacatagcaggttgacttcgttcaagtgtgttgatgtggcagtccagatcatataagaaattaaaaatagaagtaggtccgacgtgtaattgata

SEQ ID NO: 53053 - DNA, 1501 bp, Oryza sativa
gttcagcagcgctactgaaatgcgaaccaaaggaagaacctgcatttggcaggacactttgcgtgctagagaagatcggcacaggcaaagaaatgctggtcatagaagaattcctggtgcaccgaacgcgctgagagcgctggtcagccgtccaatgccaaacgagacaatcctcgacacccggtgagagctgaacgtgaagcaccgcatcccaaataagaagaaactgagaaatgaccgggacagtgaaggcaccgcggatatcagagacccaggagttgttcgccagtccagaagcaacttttttttcaccattgatattttatgattgatgccacaaaaatattctgaaggtatatatgatatttcatagttatattatagagattctttgtgatggcacaaagatattatgtgcatgctatctctatggtatatggtggtatcattacatgataagggggaaattattttaaactctcgaggggacattcccttgttgtttccttgtcatctaaattgttataaaaaataattcagaagatagattgatatgtgataaatcactccacaaacatgcaaagttaaatttaacttctacaagttgcaaaaaaaaattgactgtgaatatacgttaactagtcatagtttaatttgtttttctttacaacttgtagaagttgaattttaacgaccaaaagaatggaagcatctgcatgtgatggatgaatatcttgcaaacagatccttcagttcaattttgctagtgattggctcttgaaaaagctcaaggttcccaagtacatcatcctaggctccattcgagctctaaaagaccgagataaagtgcaagtttacgcgaaagctagtgaactcgagcctagataggagaactcacttgaggtttgttcgctgaaaaccccattaatttggaccaaaaccattaataactcatagtggtcagaaaatttttcagataagtccccaattcggactgaaattttaaagattaatctctaggggttagtctagtgttgactcgagaacatggcaagagcagaaatctttggatggacgcggaatgccaccgtagaacgacgtgacactgaggactagagtacgcagttagtagtcgtaatgtcatcgtcatcgacatcgatgtgttgctacatggcattttcgttcagagaaattgtgaacccaaccagcaacaaatcaacactgttcgtctgtccctacgtaccggacaaacctgacgttggcactacagcagcccgtgcacaagaacacaacaagatcacgagtttcacgagtggccatggcgacaccaccgcaacagtttcactaatcaccagtcattacactctgccatttccttatccagttatctggtactcctacctgcttaattcgctcgaagtacagatgaaacagattattaatctcaaattcgtcgtcctcgcaaatcggatcagcatggctgccatcctgctgctgctgc

SEQ ID NO: 53054 - DNA, 1501 bp, Oryza sativa
atagggaataaaagaatgcataaacatataaataaaaaacacatgagaagagttgacgatagaaatcagaccgttcaatagtacctgcgtgcaattaactatggaataagctgcagaccagaaaaatggatatatgacacaaggttgtttattaaacattgttaagcctagtcattggaagattatttatataactgcatgaccttgctgtaatgatcctctgattgacagagcctcatgttgagttaaaaacggctttctggatttcatttcctccaaccagtttcagtgacttgccatgtactgaatcatagtgttgaaaacctgaatagtttatccttcatttcttcaccaagaaggcaaaatatagtagagatatattagcaatgctaatgctgccgatttataccgttttgtgacaacatctgcacatgggtaacaattaacaaatcccatgtagtcaaattacttctaccccaatcgctgattttctcaatcccgataaacaaaacctatggttacacccaacaagtgtggtccaggatcatgctacatatcagagagttgactatgctgatcagtggctgttagctcaacactggatcttgcaatgttcactgaagcatgcctttcaaacaagcattaaatacaagctccatcccgttgcttcacttgataaaacagtaaagcaaagtgaaatgtattattgcctactgcctaatgacgaaaacgaagcacgtccaaacccataagagtggtcatgcattagtagtttggactaaccatctagcttgctaattggtactgtaaatcaccatctattcttagcttagctcacattataggatgactcagccctgacaccagccacgtttgctcctcctgaaagacaatcatataaatagtcgtcactagcagaatcgacaatcgagttagtttaaccaaaaaccgaacctggaaatgctcctacaaaacaatctctgcagacagaggaatcattgtttcattagtcacagtgaatgtgcgcctagctgtaccttgcaagaaaatttttaattgtcagacaaaatccatctgcatcgaaaccatttgattctgattgcttcctaatacctaccatgtatagtgtcatccgtgtctgaagagggcggctttcttgttgcaattgacatagagctctgggttacagatgtgttcgttcttttcactgatttccattatatataaaaaaaagtagaacttttcagtgaacatggagagggttgtaactttaaacttttgtctcgttgtcgccatggaatcgatcgagaccaggtcgaaggcttgatgacaacgcaaagccgcacggtttcttctcctctctcgcctgcggtctgtctgcgtcgatgggcacgggtagaagaagaccaaaggccctgttacatccttcaaaatggcaaaagttttgttattttgtagcactttttgtcattttggatctaaacactaataggaaaagttg

SEQ ID NO: 53055 - DNA, 1501 bp, Oryza sativa
ttaggttcaaggacttcctgttgttgcatcaaaagcctctaaattgactgatttggatgcacctatttcaactagtcaaaccaagtatcttgagctgctagccaggtattatgttctcaagggggagcatattgctgctgctagaatgttgttgatattggcagaaagacagtgctccagtgcggaagaagcttcaactcttgaccagaggtctcccaattttgactcaacttctttttgtttacttatttgatttttgctcagtttttgtccttgctttcataaggtccatgtgtcatatggaatgagacctactttttttgcatccaggtatcaatatctgagcagtgctgcggttcagggcaaaagtgaagggattactgcagattcctcgaggaaccctattgatagcagcgcagtagatcgacttgaaggcaaacttgcagttcttcagttccaaatgcaaatcaagtaagaatagttcatggcttcacggcttgaaaatctgccaggcagtactgaatcaccaaatgatgccttcctcatgataacattctagctgatgtggagactgctagatgtcccatggacaaggctaaagagctttcactgaatctcaagagtattactcaacttttcaacaattatgctgttccttttaatctttgggaggtatggctatctttgtttcttggagattttttccttgatcctgctttcttctctcttgtaagagggttactaggcaataagcattttttttactattgatagcagcacagcagatccacttgtttttaccaggaataaccaacatatctatggggatcgtgacagttagtagaactgtgaaattcacttgataagttctaaactgtcataaagattgcacttcttttactgttaaagtcatatgaactgataccacaaatcagtaggatagactatgacgtgttgtggacttgcggtggtagtgtgatcatacaatgaaaaccggtgatctgagcatatcctcagcattccattgcgtctttatacatttaataaatatacttgactggttactatatacagaattaccaataaggtttcggaagctttccacataactacattaaatgggtaatacaactttctcagtgtaaattgtatctcaaaagagtttacttagttgtgtgaaaataagcaagcactttatcaatattttttacatgttacgataggtatatctaaatcctctgaatttgcatccacaaaaaactcttttcgaatttctcatgttgctgagtttacagtttgtgatatagtaatatagctctataactgggtgtgggatcacagtaaattctcacaagttgctgctctaaagttatatattatggtctgcatttttcttgtgcagctgtatgtagtgctttacttgcacttattcacttggtaaggtaaatctgttttagatagtcactgtaatttttcatgatgacttgaaccttcttgttaa

SEQ ID NO: 53056 - DNA, 1501 bp, Oryza sativa
aacctaggcttaaacatcaattttttgttggcattgcagctttgtgttgggcggtttggctttgtagaaatgatgtagtctttaatggctccaaaactaactcctttgtgcaggtaatcttcaaggggacgtattgggcacgtcaatggtctttgctacttaaggaggatgatagggacaaagtcaaggaggggcgcactttgttggaaggaagaattttggatttcttctctaagcatggatggaatttaaggcgaaggttggatgtctagatgtatctttgtcttgttttgtgttgtttgtcaaagttgtaagatcacccttgtgaggactgagaggctaagttctcttgtgttggtgttgatgtgtcgtgatgtttgtttgtgaacctttgtaaggtggagtctaagaactcttgttttattgttggctgtgtacatccgatcggatgtagaggccgggtttatctcattttctaaaaatgattagtttagtagaacgtggggtgaatttttctacagctacggtggtgtatcatttgaaaattatggtttatcttccgtgtcataatttgagatcccgggaggccgaggccgggacaaaaacagagatcatcaatgttgggccaatttagttttttatattaaattttaggatcttgctaaccctggattatgtataataaattatggaatgaactctccagttatatttgaaatctggggaaaactctaggggagatatatacgttaatagtgacacttttttgcagcatcatttatcattctgtgagcttattttcctgtctcccttaaattccttctttctgggagaacatccatagtttgagtgtagtttgggggatctcgggggcatattctaggtaggcaatgcaattttatgaaactaggaaccaacttttatttccttttaacagatgggacaaagggtttagagttcgcctctcaacttttttttttttgctttcttgcattttggcccttcttcgcccctttccttgtatgtgcttactgtcctgataggatccatgtgttctgacccatgtatgatgtatctttaacaagacaaacaaactatttggcatgatttacctgattaatatcctttcagtacaaacaaactattggaaagatacacatgaagcagctcgtcatgacttaaataatgccagctagatctcttactatcgtgtaccatcctacgaaataatgtgctctctgcattaagtatctggacaagtctttcttatatgctggctatatgaatccacagataactttgagtttgctatatctttccaattcatcaagtggttacatcaaactcagtttatgtctctaccgtgttatggatatctgcatgttatgtctctactgtgttatggatatctgcatgttatgctatcctgaccagttatttcatttaggttcaaggacttcctgtggttgcatcaaaagcctctaaatttatttcatttagg

SEQ ID NO: 53057 - DNA, 1501 bp, Oryza sativa
cggtgaagtcgtagacgcccaacagcggcggcataataggccagccgtgtaggcggaggcaccactcggcggcgacggaggcaggccggcggtgaagtcgtagacgcccaacagcggtggcataataggccagccgtgtaggcggaggcaccactcggcggcgacggaggcaggccggcggtgaagtcgtagacgcccaacagcggcggcataataggccagccgtgtaggcggaggcaccagtcggcgacgacggaggcaggccggcggtgaagtcgtagacgcccatgaacggtggtgtgaccaaccaaccgtataggcgaggacaccagtcggcggagacggaggcaggccggcggtgtagtcgtagacgcccaacagcggtggcataataggccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccagcaactaacagctaactcgatgttctttcggcatgatgccatcatcggaggtagccggcggagcccatcaaccatcatacatgcaaacaggaatcgaatcctggcggcctgtgccactcctgcaacacgtccatctgccaggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgggtgtagtatagatctgacgatcaggttgtctcatgcccctagaggggctccctgccctccttatataggttggggggcagggttacaagatagaaaccttaaccaagacggtatcggtttcctaaatctactttacaatcttatcaaaccaggactttaggccgttccataatatacagggaaacgt

SEQ ID NO: 53058 - DNA, 1501 bp, Oryza sativa
taagtgtgcagtaaacactataagttcagtaacaatgcgttttgctgtattttttggatagtgttactgcacaaacacgtggtaacgtgtacctgccgtgcagtaacacttttacttttgtgcagtaacaagtatatggttagtatatgacacttttaacctatatatttttgtttcagttcatgatttactgcaattcaccataatattactgtcaaaagtgcagtaatgtcatatacaagcagtaacactatattggagggaggagaccggttttcttgagaagaggaaggaagaacggtttcttggagaggggagtacgtagatacattttgaattttaaccctccacatgcagtaacactatagcatcatggtgggaacgatttgtttaaaaaaatgcatatcttgtgagattttgcttttcgaagattggcattttgaactttatccctccacatgcagtaacagaatgtgtaacttgcagtaacaaaggcatatacatgcagtaacatggttttaccaaatgtataaaattgttcaaaacactcctacatcaatcagacctcgctcaaagccacctacagactttacctatagcccagatactcgatcttcatctcgaaaaaatcacatagtaaaactacaattatcgtgcaataacatagctacttggaagtagtaacatgtacctattatgtagtaacacttctaattctgtgcagtaacaagtatatggttagcatgttagacttttaacccatatatatatatatatatatatatttgaatttttatttacggaggatgatacacgcgcgctgagctacgggttaggagcggctacaacaatccgaataagggatagtagatatatttactaattactgcacactaagtatatcgttactatatttgattgacaatgttactaccgggatgcagtaacacatggtacaattgacaataatgtgtgaaggtaaatgctagtatagtttaggaatgattaattgctgcacgtcgggattaaatggcaatgcgtctcatatgttgctgcaataatctataattatcatgatcatgttaccgtagttgagtagtaactgatgtgcaatggtgtagtaacatgcatggtttgaagcgtacaataacgaccatcacaatgtaattactaatgtttaagtgcagtaacggcttatgagttctctcgtctggtggaatgatggatgttatacatttgaggtgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtcttggttaaggtttctatcttgtaaccctgccccccaacctatataaggagggcagggagcccctctaggggca

SEQ ID NO: 53059 - DNA, 474 bp, Oryza sativa
tgtttaataatatggtatagctctaggaccgtatttacaaaatagctttgagcaactaagtgtcttttaatgctgtttactgcaaaccctaaccctttatattataacccccttgtactcccttgcatttattctgcacttgtgggtgtgtcttgttgagtacggtggttgtactcagtcttgttcaattttttcccaaacccagaagaggagttcctggaagatgaaggctttggtgtctagctcgtgcctgccgtcaagtgcctgtggtcgtcgccctagtcttccgttgtttcccgtttgtctttgtgtgtgctgggccttcgccgcccatgtaataaattaactatttacgcttccgcttgttaaactctgtattgtatcaacttttggtgtaccttgcctcctgggacaaggaataatacacgcacgtcgggaacgcctgttgggtgatttccggtcgtgacacgtcct

SEQ ID NO: 53060 - DNA, 1014 bp, Oryza sativa
gcgcgcgcgggggaaaccgatggtccgcgggggaaaatataaagggagggactgggccgagccggcccaagaaggaagggggggggggaaaagaggacttcttttagggtttttcttttcataaaccttttcaactttgtttatttcttttcaattattatttgtgctctgaaaattccactaaaatttgagggctccttttagaccaaggagaatttaacaaaatcctccgggccacatttgaatttttcttgtacgtattttagggtttgccaatttcttttcgaattttaattaattctattattccttttagaagatgatttttatttcgggatgaatttatcaggacgtgacatcgttgccctagtcttccgctgtttttcgttgtctttgagtgtgctgggccttcgttgcccatgtagtaattttatatacgcttccgcttgttaaactctgtattgtatcaacttttggtgtaccttgcctcctgggacaaggaataatacacgcacgtcgggaacgcctgttgggtgatttccggtcgtgacaagttggtatcagagcctcccttgaccctaggacgagccgtagatcccaagccttagctatattttcaaaaaaataaaaatcctttattatttgtgaaaacccgctactctctctttgtcttgctgcttcatttatcgtcaaaatctgatcttttaaatgttgcttttcttttgtttttgtttgtagatggccggcagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacc

SEQ ID NO: 53061 - DNA, 1501 bp, Oryza sativa
ccaccgccaaacgccattccaccgtgcatccgagccaccaccgcctcccgtcgcgtccagccggccaccactactgccctaatggccgctgcgctgtgccgccgccgccgtcagcatcgccatgccgagctccaccccggcagccgctcctcttccttcaaccaccaccgaaaaaccacccccaccaccaacctgaggccgccgccgcatttgccgcctcctgttgccgtcccagaccacctcgcgatgcgccgtcgcctccttcggctttgcaatgacgaggagtcccttggctgcctcctcaacatcgccatcccccgccggaacgccatctgccccgcgcgaggtgagctccgtcgccgtgctttgttgcctccggctgcccaccccgcgctcgcctaacccatccatcaccttcctcaggtcacggtgccccttggccgcccctctgttggcgccgcccgtcgccggagcgccgccgccccctctccgcccgagctctgtcgtaccgtcactggcgcccctcggtgaggaccccctccgtctcctctcccattcccctctttccgccgctgcgtcgcgccaccgccgccggtggccgtccggccttgtgccaccgacgcctggcaagccagctccctccgttgccgattttgggcgctgcctgtggaccgcccgtgctcttggtccacggcgccgcctaggccgcggtggacttggtccaccgtgtgccctccccttggagccgctgacgtgcggggcccgcgtgtcggcgccggcttcccctgctgacatcagcggcagcccttttcctttgtgaaaatatttaattaatgcgtcataaaccgataataattatagaaattcatttaatggctcaacaacttctaaaattcatatctaattcattcgaactccaaatagggcgattcaacttgcaaaattcatctaaaattgagctgtacatgtctgtttactttttatgtactgttttcttggtttttattagagtttttcctcgttttgcgtgctagagtgtagtttctgccgttttggaagtccgctgttgcgaggaaaggagtttagaagatcaaagtgaagaagtaaggcaagtcacacattccccttgagcattttgatcctactttacaaatgttttaccgtttggaaataaaattgcatgtcttgctaatacatgggatcagggtttacctatcttctcgcttgtgccatgtttacttgatatctatcctttgtcaacattgggtaataaattgactagctcatgttacttttgtgacctagctagaactatatgcttaaccatgcttaattaccactagcctagttgatgggataattacagtattggaccttgttagtatcagaacgagctgcgtgctcgagacacccggacatgtttaattggtcataattatccaactaaaatgcgactgaatggtgggctgtggatgcatggttttgtgagtcgcacccatgt

SEQ ID NO: 53062 - DNA, 1320 bp, Oryza sativa
ttcgtgagggttcacggccgtgattaataatactgtatagctctaggatcgtctttataaaatggctttgggcaactaagtgacttttaaatgctgtttactgcaaaacttaatccctattattattctcttgtacctcccttgcattaattatgcatccgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacatggattaatacactagcgttcgggaaaaggcaattttcccggtcgcgacaagctggtatcagagccatctcgactgtaggataagccaagtggataaaacctaaggacatattttataaatgaaactatttgcgaaagctcctctttttctccttcccctaatgctatttgcaaaaggtttactcccttcttccttcttcggatttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacctgcagaataagtgaaacaaacaacacatcagcaagaagagttagttcctttaaggtcctatccttagtttctaatctgtctctcccctttgttttccctctctccctctccaaacctttgcaacagatggctgacaatgagaaaggcaataaggttagaagtcaggacattggtacctcaagctcccgagtgaatgaagcaccagacaccagttgtgcggcagtggtccaacacctgattaaccagaacaaattgcttatagagatactacagcagcatcggatgccaattttgaacccgagtcagatgcaatctcaagtgcagttggaggcagtccaagcactcacaccacaagtcagagcaccgccaacatcccagaaggcccctcatgccatgccaca

SEQ ID NO: 53063 - DNA, 1501 bp, Oryza sativa
tatttccctgaaggtagtcagtgcagcttttgacgaaccacatcaaggtttcactgaaaggcagcaagccaaaggacctcatcgtccccagaagcgtccgcaatccacattaaagaataccacctgttagagataagccgaaagatgattgaaaaaagagattggcaaagatgttctctagcataaaagaagtaggccgaaaggtgattgataaacagaaacatgctctgcatcgctcacggaagacccctgattgtaattgccccgcaacagtcaccttgtcattaagtaagcaagatgacctaggtaaaaatgtttctatgaaggcaaggagtgaaatcttcaactcggtatcagatgctacacggagtgaaaagtgcaagcaccggttaccaggtaatgccatgtcttgggagatgatccaatgggaaagaacacatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctacagaggtcagattaaaatcacctctaacaacgaagcttcagatctggcaggatcacgatcagacaataagaagtccagcagtaaaactatttgggaagacgtcaaagcatgccaagtgggataagttggctctgttgagaaacataattcaaaggcaaaattatcgaccctcgcatcgaatagcagaagtagctagcacccggagaccaggaaagctaatatgaggcagtttgtggcaagttagaagtaaatgacaagcctgatatccttatgatgacaagcatggtatcctagtaatgacaagcaggttacgacgcatgacatgaagtggtaacttgtatgaggttgactccaaagatatgaactatgcgaagttctggaacggaagcatcactgaactaccgcaacctagtctgagtcagccaaaaggtgcaccctggtccaagtcaggtgaagagaagattccatccgcaacaggaggtcgagccaagcagtccagagtggagaagttttgctaggcaagtttgttataaaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggaggattttgttaaattctccttggtctaaaaggagccctcaaattttagtggaattttcagagcacaaataataattgaaaagaaataaacaaagttgaaaaggtttataaaaagaaaaaccctaaaagaagtcc

SEQ ID NO: 53064 - DNA, 1501 bp, Oryza sativa
tatgtaacagtactcccttcgggttgtttgtttggaggggctaatcataagtcccttcactttagtctattttagcccctaaaatactaaacaggagggactaaaagaggctaaaattacctaggtccataaatctctaggggaggtgctaatttagactaaaggcctatagcgcacctactattgaatggatgaagcatgtaggtgttggatgaagtgctaaaagataggtcatttaatgaggttttagtcccttttagtccctccaaacaaacagggtatgactaaagatgacttatgttttagccctagaactaatttttagccctaagacttatggaaagaaacatggccaaaatagggcaacttctaaattctacttcctttctttacgttgttttgaatttttttctagtcaatattttttttaagtccaaacaagtttatagaaaaaattagaaatattttcaacacaaaacaaacatatatatatatatatatatatataggacaaatttactatataggacactcatatggggcaccatggtatctaatgtacaaaatcactcaaatttttcaaaattttcaaattgtgagtatatacctagttataataattcgattcatatctatacctatcaacaaaacaactcaaatttaactttatttcacaatccatgattacatacctaactaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatataggaagcctatattctactcccaggagtagctactcctattgtaaccatcggacacctgtccaactcacatcagggtttcgggcttcaactcactaacggattgtgagaaaagatccattaaaccagtgatgcagaaacttgaatattcttttttttttgaaaattcggatcactgcgctatgttctgcatggtgagtcattttgaatgttctgcatgcatggtttgttacccgcacgcatgcacgaccgagcgaccaggagagtagttagtgtggaggttgctgtattgatactctatttaagttgacggtgatggaggacagaaaatgaggaccacaattatctttcggatttgtgaggaagaagattttgttctgcaggtttttgatggagcagaaactctccggtggaaagggcagaatgtcgtcggcgaggtctgttgcgtcgccttccgcggcgcgagtaggcggaggctcgtcggcgcctgatgtcgagcagcagaagtcggtggcggccgtaggcgtgtcgtcgccggtgagtagtagcaagcac

SEQ ID NO: 53065 - DNA, 1501 bp, Oryza sativa
cgcgcgaatatcacggagtgagcaccaagcgcatctcttcctaggatttctcatgggaagaggatgacatccatcgaaatgaatgacatatttctggagagagtggttcatcacttcactccgagcagcagtatccatgcaacgcacaaaaccattcctgatgaccaaataacgcaataaccagttagagccaaacaaacaaacaagagaaaaaatttcaacagaacataaactaaaactaaacttcaatgtgtacctatctgcggcaggattctgctgcttgtcaccattaattgtaatggttccatcttctgccttcgccatatgatggtgcttgctactactcaccggcgacgacacgcctacggccgccaccgacttctgctgctcgacatcaggcgccgacgagcctccgcctactcgcgccgcggaaggcgacgcaacagacctcgccgacgacattctgccctttccaccggagagtttctgctccatcaaaaacctgcagaacaaaatcttcttcctcacaaatccgaaagataattgtggtcctcattttctgtcctccatcaccgtcaacttaaatagagtatcaatacagcaacctccacactaactactctcctggtcgctcggtcgtgcatgcgtgcgggtaacaaaccatgcatgcagaacattcaaaatgactcaccatgcagaacatagcgcagtgatccgaattttcaaaaaaaaaagaatattcaagtttctgcatcactggtttaatggatcttttctcacaatccgttagtgagttgaagcccgaaaccctgatgtgagttggacaggtgtccgatggttacaataggagtagctactcctgggagtagaatataggcttcctatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccccatatgagtgtcctatatagtaaatttgtcctatatatatatatatatatatatatgtttgttttgtgttgaaaatatttctaattttttctataaacttgtttggacttaaaaaaaatattgactagaaaaaaattcaaaacaacgtaaagaaaggaagtagaatttagaagttgccctattttggccatgtttctttccataagtct

SEQ ID NO: 53066 - DNA, 1501 bp, Oryza sativa
gggctaaaaattagttctagggctaaaacataagtcatctttagtcataccctgtttgtttggagggactaaaagggactaaaacctcattaaatgacctatcttttagcacttcatccaacacctacatgcttcatccattcaatagtaggtgcgctataggcctttagtctaaattagcacctcccctagagatttatggacctaggtaattttagcctcttttagtccctcctgtttagtattttaggggctaaaatagactaaagtgaagggacttatgattagcccctccaaacaaacaacccgaagggagtactgttacatagtgattgacacatgaactgttgacagatggaactgtcagtacacgttggatccatgctttagacgtctcgacaataactttggatttggatatactagggaaacaacgagggaatacaatcttcgaattctagccttcgaccaagtcacccgcgcgcatgtaccttggacgacgatgttgtccacttgccgtgcgaacgtgtggaggtaaagcgaaaaaagactaggtaaaaccatgcaagcagcacacgcgtgcttatttactgtttagttacatggacggatgcaccaaataatttcagctagacagcaatcattccacacgttctcctctcctgctccagctccccatcccagatgaggtggcaacaacactgcttaaacacgccaccatctcggccgccgtccggccggccgtcttcgcgagtgacgcagctcccatcagcagcaacgagctctgctagctttcgtctcagcgctccgtcctgcggtcttttgggtctcgaatcgcctcatgtggaccccacaatcacgttggcaaatagcagctgccctggtgctgcttctcacgttttagagcaagtttaatagtggccactgctagctccaattcatcaatagccaataaaataattgcttactatactattaatatatggtctcatctgtcatacatatattatgtcttagagtccgcgctgcagctggttacagatctatagcctgctgctcttctctctcatcttttatctcattaaaatatgtttacaggctattagcctgctattgtacctgctcttagagagagtgtgtcgtgggtgactattcagtctcccctctcatttctctgccacctcatcacttttgccatcgtggacacactatcaccaggctccagctaatttttttcaattgtacgtgctcttagtcgacgtacgtccaatttctttctccaagaaagaacgccgaacaagcgccgacgaaaaacggttcctcgttatttctctccaacgcgcgcgcacgggctatttctacccccgccgccgagtagttaggcgtccaaagtttcgggagttcatcgtgaacggtgatcgatccaaagaacaacaactcggagcaaagctagctaacgaagttagttccaaacaaagctagcttatcgcgattagctagc

SEQ ID NO: 53067 - DNA, 1501 bp, Oryza sativa
acgtatgccaagggaatcgtacgagtacgatggaattcaaacggtaaccagaaagtttcggaaattttcagtttttcacacaaaaggaaactgtgaccagaaaacgaggtgatcaccctgctcctggcggacccacacgaccagccgatcggacgatcgccgctgccagacaatgggtctacacgaatctcaaagcccaaagtttgaatcgtcccgctcttggccctcccggcgctgatcagtcttcgcccaatgacacgtgggtcccactgagagatcacagatgctgctgacatcgcgggaaggacaagccattgactagtctctaggctatccccaccggagagaaaaagaagaccaacagaactgaggatttgaggaaggaaagtgtccgtcactgcaagtggggcccactcggaagccacgaccccctcttttgcatgagctgcggcgagcacgggcccaccgcccaccgcccctgctctctccgatttccattccaatcttccgcgtcggcacgagaccacgacgtcacgcattcccgcgaatccggcctgctcgagacctcctcccgtcgcgacgccgcaagccatcaaagcgcctcctgcttccgctcctatccaaggcgaaccacactctgcgatcgagagctcgctgagccgtaaaaccctagctaatccttctctctccccccctctcgctgtcgtctccgtctccgtctccgatctccgcggcctcggttgcgggctgcggctgcgccggtgcggctccatggtcccggagccggctcccgcggcggcgacggagccgaggcgctccacgcgcaggcgcctaatgacggccgccgcgatggaggccgaggcggaggcggtggccgacctcgacgagatcgaccgcgagatgtcgcgcgccgagtcgcgcaagcgccagcgcaggacggcgaaggagaagcctggtgcccgtaagggagcgaccgaatggaagccggaggacgtggagaaggcggcggcggcggagggggtggccgagctcgacgagatcgaccgcgagatgccgcgccccgagttgcgcaagcgccagcgcaggacggcgaaggagaagcctagtgcccatgagggagcgaccgaatggaagccggaggacgtggagaaggcggcggcgcaggagcccgaggggaccgagctcgacagtgggttgtcgcccgcagagtcacgcggcaagcggcagcgcggggtggagaaggtcaagcgtcgtacccgtaagaagacggccaaggagaagacgaaggagacgaccgagaagtcggcggctcaggcgcccgagaagatgaaggtgaacgatgcgggtggcgcgctggccgaagacgtgtgcgcggatgagccggacgccgaacagatggccatggaggaggaggaggaggcagccgacgtgctggaagcagaggagaggatgggtaagtgtgtcggagaaggatcagccgagaaggctgcgacgaggaaga

SEQ ID NO: 53068 - DNA, 1501 bp, Oryza sativa
gcgcttgcgcaactcggggcgcggcatctcgcggtcgatctcgtcgagctcggccaccccctccgccgccgccgccttctccacgtcctccggcttccattcggtcgctcccttacgggcaccaggcttctccttcgccgtcctgcgctggcgcttgcgcgactcggcgcgcgacatctcgcggtcgatctcgtcgaggtcggccaccgcctccgcctcggcctccatcgcggcggccgtcattaggcgcctgcgcgtggagcgcctcggctccgtcgccgccgcgggagccggctccgggaccatggagccgcaccggcgcagccgcagcccgcaaccgaggccgcggagatcggagacggagacggagacgacagcgagagggggggagagagaaggattagctagggttttacggctcagcgagctctcgatcgcagagtgtggttcgccttggataggagcggaagcaggaggcgctttgatggcttgcggcgtcgcgacgggaggaggtctcgagcaggccggattcgcgggaatgcgtgacgtcgtggtctcgtgccgacgcggaagattggaatggaaatcggagagagcaggggcggtgggcggtgggcccgtgctcgccgcagctcatgcaaaagagggggtcgtggcttccgagtgggccccacttgcagtgacggacactttccttcctcaaatcctcagttctgttggtcttctttttctctccggtggggatagcctagagactagtcaatggcttgtccttcccgcgatgtcagcagcatctgtgatctctcagtgggacccacgtgtcattgggcgaagactgatcagcgccgggagggccaagagcgggacgattcaaactttgggctttgagattcgtgtagacccattgtctggcagcggcgatcgtccgatcggctggtcgtgtgggtccgccaggagcagggtgatcacctcgttttctggtcacagtttccttttgtgtgaaaaactgaaaatttccgaaactttctggttaccgtttgaattccatcgtactcgtacgattcccttggcatacgttttgtatgggaaaaaaaggaagcattttcatgcatatctctatgctcaatctgtgattgattatacttactgtttgaattttgaatcaccgtgcagaaaaaaaattttgctcggcatgaactattcatcttcgccatggatggtgattggtcatggactcgcggttcgggggctcgcggcaagagtaccaaacatagttaccgctatttcagaagcccgtaactatttcagaagcccgtaacaaacaggccgtgagatacagtacactatttcagaagcccgtaactctctaaccagcaactagctaattgggccgaattattaatggctatggtttcctggcccggcccatagttaccgctactactcactctgccgagactgcattgtctacctttccaccttcccatcctcctcccgttcc

SEQ ID NO: 53069 - DNA, 1501 bp, Oryza sativa
tttacaacattacaagaatcccaaaagattgatatatgcaaaaacgaagaaattatgttttcaaatatactacgaaatcttttttgaagaaaggtgctatgaaacaaaatagcatatgatccctctattttttttacagccttgattagtcaaagaactaaccaacgtcaaacaaaaagaaatggaggtactccattgaatttatcgtatcctagctctttccttaccttgttgcttgacgggatgggtttggagccaaagggaaacatgatggctgagagcagaaagcttgcaccttgcagagctcaatgattttcacgaacatgagcaaatagtactgtgccaaagaggactgggtttttatgaagctagaggcaaaggtggcacttggctgtagaaggaaagaaacgcaacacgttaaactaaacagcggacatttttcactctacatttgccctctgtatgacaactggatcccacagagttttaacgttcgcattaaatctatccaactatatgtcaaggggtaaatgcatacacgttctaaagatgccgtttcatacccattctaaaaaggaaaaccatttcatatgcatttttgagagcatcgcgatatatatattcacgtttccatttttttcactggaacaatggacacaccaaccgagaatctctccagcatacggtatataagaaactttgattccgaatcggaatcggacatataatttttcggtgtataaatgttcgattccgaatagaacatacttatttttatatataaattctcggtgtatagactttaaaaaaaaggaaatatatggttgtagaaatattaaagcgtgggtgctcacgtgagttagccatgcaaatgtttgcgaattagccttgcaatatggtggctttacaatagaaatgtagttttttcacttcccatgaaatgatcaaagattatcaaaaactggttcactcatgttcgttctccttttctactaacagagaagtgacattatgcatgcaaagagtggcttaaataaagagaattaatacatgaaccatgaaaattgtggagctaggcgttcgcggaaaagaaaaattgtggagctatgaataagaagagacttttaataggacccaccattaaacttgaggcataaaaaaccaccgacttataaactaaactgtaaaaaaaaatcagtttaaaaacttaaaccattgttcctacgaattataccgacacaaaagtaaaccaatagaaaacacaatatttatgggtgagtttcttgttccaaaattccaatgaatattgtgttctgaagctttcttgttttttttatttcaactattgtccgcctttgatctcgctcaaattcttcccagccttatcagttcatttctgaaattgattttaacttttaagaaaggtgaatcaattttgagtttcaaaaaaacaactcgaaagtaaattctccctggagtactggattcacccatccacctc

SEQ ID NO: 53070 - DNA, 1501 bp, Oryza sativa
ttgtttcctttcttctgcacgggtgagagaaaggagaagaaaggggaaaaaagagaagaaaaaaaggaaaaaaatttaaatgtgtcctatttgtcagttaaaataatgccacgtcatgtatgtatggcatattacatcaacgccacgtaggatcctgaaggggttgtggcgatttgagacctagataacacactatgatgagttcttagacttgaatatgcattttgagagtttatggacctaaatgacacacctgtacaagtttaagaaccgccagtacattctacccatgaaagagtaaatatatattgtttgagagtttctaacagctgtaactaaaataatttttttataagctgtagcagttagtagctccaaaaatgactcctaacctctcgcttagcaaaagcaaaacacatctcactctagcaatagcatttccttgttcggcactgtaaaagtttccagttcctggtttatgctcattgcctcattgacacgtggtattgagacccacatcccagtggcacgaggagtgataaacaaagaagaattttcatattttagtgaaatggaagaatgataaataggaaacttttagaaaataccgagaaataagaaacgtctacagcagagtgcaaattaaagcagtcccaggtatcgctgagatgctagtatttgtaaaatcaaaagtgtttttattattattctgtgatgaacaattatgcatcggagatgattggttttgttatttggaatttattcatgaagtggttttggagatgattggatttcacaggtgaatctacaggttatcattttatgtggaccggtcagactgggcaggtgttgccggtcagaccggcggtgatcgagcggtcggaccggccagcccgcggtctgaccggccgacactgtgtcggtttcggtttcgggttgtttatttggatatccgagtttatttcatgattataacttccagatggatactatatacgtatgtaatactattgtttgctgctaatgagtcaagttggagatagcttggtctcggaatatggtttctttgtttgttccatgtgtaggtgactcgatgtttcgggagagtatttgcggtgatggaccgggagtcgacttggggataagacgacgtccgtggtggtcagagatcatgcgggatacttaggctagaattgatgcacgtggttgatggagattccatatggcatacgatggaggtattgtgtgcgtatgggatgtggagtcaaatttggaaggagtccaaatttggtacgattggttatgtaaagtttctttcttgtactagagggtttcctaaggtgtttaggactcctcgtatgagtttggttcgtggctttaggctgcctacctcatgtataaatagagggggagcgtgaggcttcccggtatcgctttagagagcaattgagttgagttttgagttagggtttcgagtttaatcgaaatttttgtaaggagt

SEQ ID NO: 53071 - DNA, 1501 bp, Oryza sativa
ttatttttgattgtcaggccttaagtgcctttgtaataatgtaaatattatcgatataataaagatgtgtcttttatatcatgtttgtatggtgtatcccggcttttcctgggacggggattaatacactagcgttcgggaaaatgcaattttctcggtcgcgacaagctggtatcagagccatctcgactgtaggataagccaagtggataaacctaaggacatgttttataaataaaactatttgcgaaagttccttttttctccttcccctaatgctatttgcaaaaggtttactcccttcttccttcttcgaatttcaactagtactagatggtcagttttgcgaagaagaagatgtcgtcagttgtttgccgaagctccggaagactgcaggatccgctagcgaagcgaaggaagcagtgaagccagctgtgaagcaggagtgaagatcttgagaacccgtcaccgaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaacagttgtgtgacactggtccaacacctaattaaccagaaccgattgcttatagagatactacagcagcatcagacgccaattctgaacctgagtcagatacaacctcaagtgcagttggaggcagtccaatcactcacaccacaagtcagcatgccgccagcatcccaaaagacccatggtggcgtgccacatgttgactcaaaagaagcaagtatcatttgttttatgtgtgatgagcaagggcactatgcaaggaactgtccctagcagaaaagaaaaacaccaatgcgaaccgaagatgaagtccgtaagatgatcattaccagcacagaatggcctccaccaggaatgaccaaacgtcagagaagaaataccttccgaggtgcaccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgcgaggaagaccatccacccgataggtgtccaacgagcaggatcacttgtttcttttgtgaaggaactgatcatgtaccaaaagattgtcaattcagttttctgctgacgaagaaga

SEQ ID NO: 53072 - DNA, 1501 bp, Oryza sativa
gtagtatctctataagcaatcggttctggttaattaggtgttggaccagtgtcacacaactgttgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcggtgacgggttctcaagatcttcactcctgcttcacagctggcttcactgcttccttcgcttcgctagcggatcctgcagtcttccggagcttcggcaaacaactgacgacatcttcttcttcgcaaaactgaccatctagtactagttgaaattcgaagaaggaagaagggagtaaaccttttgcaaatagcattaggggaaggagaaaaaaggaactttcgcaaatagttttatttataaaacatgtccttaggtttatccacttggcttatcctacagtcgagatggctctgataccagcttgtcgcgaccgagaaaattgcattttcccgaacgctagtgtattaatccccgtcccaggaaaagccgggatacaccatacaaacatgatataaaagacacatctttattatatcgataatatttacattattacaaaggcacttaaggcctgacaatcaaaaataaacagcagcggactagtgggcctacggctccatcttcacaggcgctcagctggggtataagccaggactccacctaagacttcttctccaaagcttctcttactgaaggggggagaaaggtagagcaagaatgagtacaaccacagtactcagcaagtcacaccggcagatgcatgattaatgcaagggggtacaaggggataataatataggggttaagttttgcagtaaacagcatttaaaagtcacttagttgcccaaagccatttataaagacgatcctagagctacacagtattattaaacaaggccgtgaaccctcacgaacctaccttaacccaaggcctacgatgattcagaccgaactggcaacccgaccctgggtcccagctcgtcccaagccaacccaggccaaccattccacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatctta

SEQ ID NO: 53073 - DNA, 1501 bp, Oryza sativa
aattttccctccctctctcccttggattcgtttggaaaccctcccctaatcccgccagcgccattgatggagcccgagagcgccgcgccagtttccttcccctccggccaccctctcccccttccaaccctatataaaccctccccgcacctcatccgttcgtttccgcctcttgccgcccttcctcccgactggaatcgagctcgcgccgtcgctctctctctccgccgtcgccgccgagctccggtccgccgccgtcgtcgccccggaccacctcccacctcggcgccgcctccttcggcttcgccgcatcctcgccgaccttgtccacccctccgttttgctcgtcgaccgccggagcgccgccgtccccgtcgacccgagccgcgccgccgccttcctccgctccggccaccttttcgtcgtcgctgtcgacctagggtgagccgtggaccgccgcctcgtttccccctttccctcccttctctcggccgccgctccgccgtgcctatggccgctgccggcgaccataggggcgcgggcgcgccgcctcccgccggccgcgcagcagtggccgccttcgggcgcaccgagcggctgccgcgtggggcccggctgtcagccacccgcgccctcgggtgcggctgacgcgtggggcccacagcgccggccggtgtgagcccaggtgcacccggtccaccgtggaccgtgaggctgccgcgtgggtcccacccccgtggacccggtccgcgcgccccctcccctcggctgacgcaataaactttttttaaaattaacatttaaatgaggaaattcgcaaatattcatttaaagagcatataaacttcaaatggccataacttggccatttgaactcggaattggaccattcaagtctctaatttttccttaagaagtcaagaacccatttttgtgctttgttcctgcatgttatatggagtttattagagtaaaagccttttcttttccgttggtcgtgtagacgttgcagcttcggaagatccgcttttcatggaagttgaagccgacgtttgggaaagcgagcaaggcaagtcgcatcatccttgaacatattgaatcccagtttataaaagtatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaaaattaggtggttttacaactctagactttgggatattctcatcacctggacactatggaatggatggattattgtggaattggattcacacctccccctctattcaaaatcatcaaaatggttttaggctgggctcgtggtgcatggttttgatagtagcatctcgg

SEQ ID NO: 53074 - DNA, 1501 bp, Oryza sativa
tgttggccgatgagatcacgcgctcggcgccctgcttgcaaagttcgctgccgtcgatcctcagcctccttcgcagtccgctgtcacgtcccaaatcgactctaaaatatatcctcgaaattgtgccgagaaaaattaaaattcatgtgaaagcctccaacaattaaaatgtgcaaatctaaaagtcaaataaggcttggaggatttttgtatatttcctaaaagcctaaaatgcgtaaataaattttagtggaattttcagagtacaaataataattgaaaagaaataaacaaagttaaaaaggtttataaaaagaaaaaccctaaaagaagtcttcttttccccccccttccctcttgggccggctcggcccaatcttctctccctccctctctctcctctcccccgcggcccatcggcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctcccgtttcccccgttttcccctctctctctccctcggattcgtccggattcatcccgcaaacctcgccggcgctttcaatggacccgagatctccgcgcccgtttcctctctctccggccgctctctccccctcccggtgctatttaaacgttccccgtgctctcctcctccgtttccgccgttcgccgctcgctctcaccgtcggaatcgggatcgcgccgtcgcatcttctctccgccgtcgccgacgagctccggttcaccgccgccgtcgctccggacttcctccccactcggcgtcacctccgtcggcttcgccgcgtcgtcgtcgaccccgtccgctcctccgtttcgctcgccgaccgccggagcaccgtcgccctcgccgtcccgaaccgcgccgccgccttcctccgcttcggccgccgttcccgtcgtcgccgtcgaccggggtgagccgaagactgctccattcgcttcccccttccctcctctctctcgggtgccgctccgccgcgccggaggtcgccgccggtgaccatcggggcgcgggcgcgtccccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgaggggctgacgcgtgggccccactcctgtggacccggtccgcgcgccctctcccccggctgacgcaataaatgggatttttaattaaaatttaaatgaagaaattcgcaaatatccattcaaagagcatataaacttcaaatggccatatcttggccatttg

SEQ ID NO: 53075 - DNA, 1501 bp, Oryza sativa
tcacccatcaaaccccaactgtctgacgaataaatcccaataattttactaaaaccctagactgacttgttttgaaaaaccccacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgtataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccagagctattgccaataatcaagtctatgctttaatgtggtccccttttatgcactagttgaactaagcatggctaagcatctcctaaaccaacatctagtcattttaatacccaagttatcaatggcataaggaaaacaacatatagctgagtaataggacccatcccacatgatattgtaa

SEQ ID NO: 53076 - DNA, 1501 bp, Oryza sativa
catggacacccgttcccacttccctcccgtcgctgtcacggctcagcgttcttccggtcttccctgccgccgtggccgtggaccggcgactctcgcctcgcctcacacccgttccagttccacccttaaaacacgttgcgccacttgcccggtccgcctgccagcgcacgaaaccctcgaactaatccaaatctgaacgacaaacctacggtctgaccaaacggaggacacaaacgaacatggagcggttggacggttttcttcttggtaaatacggcgtagaataatttgttcaagttcgaggtccatgcacatataatgtcgatacggagttaataggtgaaatggtgaattaaggactcaaccagaccaacgtttaaagattagatgaaactaatttagttgtactagtattagtagttagtagtacgctagcacagtaaaggacaccggcattacattaactattccatcaagacaatggagcaaaccaactttttgtaggtctctacttaatacgtttttgttcatagggaagatgtggaattaacttgtactagaggaaacttgaaggtttactgaatcctttcaacgaagttgctgttgatgtaccgcaaagtatccagtcagttaaaattaggagacatgcctaacccaatttcagttctgatttctgaaaggagaaaatgtcataacaggacaaacaagacgtgctcgtggaaattaaggacaccaaaatgattgtcataaaaatgaatggagtaaggccctgtttagtttccaaaaagtttttcccaaaaacatcacatcaaatctttaaacatatgcatgaagcattaaatatagataaaaacaaaaactaattgcttgagcctaattagtccatgattagccataaatgctatagtaacccacatgtgctaatgacggattaattaggctcaaaagattcgtctcgcggtttccatgcgagttatgaaattagttttttcattcgtgtccgaaaaccccttccgacatccggtcaaacgtccgatgtgacacccaaaaattttcatttcgcgaactaaacggggcctaatattcaaccaaacctgtgtaacttgtcaggttgcccctgattagcagcacttatttccaacctgccaaacttcagattttctttccttgctgcagtcaaccactccagctggtccatgcgccaaatcagcgcaaaaaggagcttggatagaactataaggggccacaaggaaagctgaaacaagatcaattataagtgtgcactagtactgaaaatacagaggatacagttaatttggatgctctgcaacttaaaaagagagaaggttatgcaaatggatcgagaaaagacagaaacttaccaatctgcatatgagcaaccgaactgccagtttgactttattggttggcacgttggatgtagttttctagaaaaagcaaatcatatgcatccattttttaagagggtactcatgcatta

SEQ ID NO: 53077 - DNA, 1501 bp, Oryza sativa
  unsure (1)..(1501): unsure at all n locations
atctttgatgtcatgcaaaacaaattccgcccagttgtacttgtgaatattttctacatcaaccaaagccttcatataccttatagatatgtgattgttaacagattgaggagccaagaatttggttacaacgaagattataaaagcagtcttgaatacaatctgttcgtgaacagtcatcgtcctgttaaattttttctccaatatcctctgaattgttacaatggtaagtccatcaaaggaatctttctcaaagatttaacacatataagccttaacatcttttacctcgttttttattgcaggcaaaatctccttccgtccacaagggattcccaaaagtaggctgacatcctcacatgtcaaacaaatttcatgtctagatcnnnnnnnnnnnnnnnnnnnnnnngggtctagcttgcacagaatccatgctccgaattgcttgttcagtttagtcagcctcatggaaagcaacccataaaactccatctgtttcactagctctttttgctaatcaccaaaacctgagaatagatctgagagaatagcaggagtgcacctggtgtaaattttttcttgtactacctttttacccttgatgccacttgtttttttggaatttgatactgcagaaccaggtagctgcttccgctgatgcatctttcttgcttgagcagcatgaagggctctagtgaaaacagaactagagccaccaccacctgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggcgttggggcgctcggcgtgcacgcggcacattggggcgctcctctccggcagcctgcagcctgacactgctataccgtaccaatgtcgggttggtgctgttcattgtcgccatggccggcaccacattcactgcaaaataacagatgaatatggcaacaaaccttggaactggagttctccatgctagacctttcaacgttatctgcaacgcagccgccggcgaggctactaatctgagtttagatgggttaagaactctcaaaacgcaaagaacggttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaaatacgggtaaaagaaaacgggtaaaagtattcgattcaataaacccgttaatagtcattaccattatctgggcaaacgaattgaattggtggcggacagggagggagtagctactcccggtagtagtatataattttccta

SEQ ID NO: 53078 - DNA, 1501 bp, Oryza sativa
gttcgtgaaaatcattgagctctgcaaggtgcaagctttctgctctcagccatcatgtttccctttggctccaaacccatcccgtcaagcaacaaggtaaggaaagagctaggatacgataaattcaatggagtacctccatttctttttgtttgacgttggttagttctttgactaatcaaggctgtaaaaaaaatagagggatcatatgctattttgtttcatagcacctttcttcaaaaaagatttcgtagtatatttgaaaacataatttcttcgtttttgcatatatcaatcttttgggattcttgtaatgttgtaaagcctggttttgaagaccatgaactcaactatagtgttttcagtcgttttttttaatttttgtagaaacggtatgcttaatttctaatatatgaacatgttgtttgaatgattggagattatgttcaatccgtttggattggcacgagaattacagatctctggatatccaagaaaattggatctactgtctttttatttagtcaagccctgaatggatggcaaataaattataaaggggtaatggagggcaaaagccagctgttcacaggaaaccaaaaccgtttgaatttttggcagttctcaaaccttgtctgtcatatatttcttcttttagttccacatatatatcttaggtttaatgataatagcaataacaagatgaaattgcttgcgaagttaagaaaaaataacacttgtttgtgtacttgccggtcgatctgagtgtcttatgtaatttttcagttttctttgtgggggtatggcttgcctattttcctgtcaatgtttaacttttaaaactatccttccaatcttaatgaattttggttagtctaatcctttggctgatccggccaaaataaaaagtatagcctaagctcaattgcctatttattttggtgccaaggaccccatcatttcgcttattgacggaataagcgagaaatgacatatttgtaaacagaaaataatttataaataaaacttttatgtatgtgttcttagtgatctaaaagcaaatactgaaaaataaactacgatgataaaaccccaaaattaacttaaaattttaggttgaaaattcaattttttacctataagcataagcataagccaaaagatattttttatgaaatcaaactatctggcactggcatacctgtcagtgtttcatgtcgagaaaataaaaatgacaacatagttgcagcagagttcatgatcctattatttgacactctatattctacttagtgttaacaaactatttgccgttatcttccccaaaggggggaaaaatccaatctatccaaatacaaactgactaatcaatcagcccatcagtttgtggtgcagcttaagggtaaggagaccagggcggagccggaggtttccagcgtcagcaaggcctcggggggcagcagcgagcacatcaacaagctgccaccgccggtgccggtgc

SEQ ID NO: 53079 - DNA, 1501 bp, Oryza sativa
accaggaactggaaacttttacagtgccgaacaaggaaatgctattgctagagtgagatgtgttttgcttttgctaagcgagaggttaggagtcatttttggagctactaactgctacagcttataaaaaaattattttagttacagctgttagaaactctcaaacaatatatatttactctttcatgggtagaatgtactggcggttcttaaacttgtacaggtgtgtcatttaggtccataaactctcaaaatgcatattcaagtctaagaactcatcatagtgtgttatctaggtctcaaatcgccacaaccccttcaggatcctacgtggcgttgatgtaatatgccatacatacatgacgtggcattattttaactgacaaataggacacatttaaatttttttcctttttttcttctcttttttcccctttcttctcctttctctcacccgtgcagaagaaaggaaacaaaagaagaatgagaagaaaacgaaaaagaaaaagaaaagaagaaaaaaaaagaaaatgacatgtcacgtccatatggcattgccacatcagcgccacataggatcgcagaggggatgtgtcaatttgggacctaaatgatacactttgacaagttctgggacctgaatatgtattttgagagtttaggggcttatatgacacaattctataagtttaaggaccgccaatgcactttactctattttgatttagattatgacaatatgtagttgtagcatcgaaaaatgaagtaagttagaagctggaaaatttaatattttcatattagttttatatgaaaactttcgcctgagttagttcaaagtaaaactttgaaaaaaaagcttagcccaaagtatacattactctttgattaatcatacaattcgttgcgttttctgcgccggaatacaacaccttcgaactaagtactaaggccctatttagttccagaggtaaaaagttttgacgtgtcacatcggatataaggacacacatttaaagtattaaatatagactaataacaaaacaaattatagattgcgcctgtaactgcgagacgaacttattaagcctaattattccgtcattagcaaatgtttattgtagcacattatcaaatcatagagcaattaggcttaaaagattcgtctcgcaatatgtgtaattagtactccatacatgtgtccaaacattcgatattacagagccaaaagtttttacgtgggatctaaacatggcctagtacttggaaatgaacatttcaaaacgggaagtcgctccaaatgatattcccgtaatattaaccgccaggaggggccaaagcgcaaaaactgagaactggggagctcaaaacactcctaaaaccctagcctaccggagcgagcgccgacgccgagacgccgagagcccaaggccggctagtcggagagtgcggccgcgtgcgggtggctgctgcgctgcgcgaactcccccgccgccaaaga

SEQ ID NO: 53080 - DNA, 1501 bp, Oryza sativa
gcaacacgccatcgccagatgccaacctctcccccgtcgcccccacgagggttagggttctggagcacgtggattgattggtgggaggggatggaggcgaaggcgttcgacgaaatgcgcgagtggcggctggcggggggaaccagacgactggagcagagactgctagatgaggaggagccactcttcaccgcactccccacggcgagcaagccgcacttcaccgtggaccaccgcgagcgcgccccctcccgcgcctcacggcgagcgccgccgcccctccctgtgaggtcgcgacttgtgatgctcaggattttctccgccctccaggacttccgcctgagttcgattctatagtgaaatgcgattagaagggttttggaggaaaaaaaattacaaaatcaattcaaaaaaaataactaagtcatttgtttgtctgtagtatatattgttttaaagagatttttatagaatagaaaagaaaactcttcatattttgaagaaatctggcattaggtataacctaatattttatgaaaaaaaacttttgatacgtataatcttcctctctcgtcgtaacatcatttaaccatgtttatcaaccacaactaagttttaatgttaaacttgattttaaagttaattttgtgtggacgaggagaggaaagggagtttctcgtagtctattttcaacattggtttcaatcacaaataatacatatataaaaattgtacctataaattattgttgtctcttcttttatttatctataggttatcagccatacattaatcaattggaatgttgtgtttttgtatttttgtgtgagacatccatattattgttttgagcaattataaggttttatctgctttatactatctctgtcccaaaatataaaaacctaggtagtaggattcaataggtcatggcagtgacagagctagtggcaccgtcaagtctacacaaccaataatgttttatggtgctccatccatttatcctatattcctttaaagttgatccccgctaactataattaataccatttttctactttgtggtgcatccacgtcaccagaattgtttacccccgttagattttattttcaaggctgtgattagtctagatgtagcttcggtctgcagaccacaacctatcaagtgagtctagcccagcgaggaggccggccccaaaccaattaactcccatgagtttttttttgagaggtactcccatgataattgggttgcatgcatcgtttaattttctatcttaattactaccacctgtaggatcgagatgtcgactagagggggggtgaataggcgatttaaaactaaataacacctaatcaaaactaacctaagttgctaggcttggtgagggtgaactctaactaagcaactaagttatgttttgcaaacctagggtgatagtggctcaattatatctctaggaaagtaaatcacactcctatgtcaaagtatgtctctaga

SEQ ID NO: 53081 - DNA, 1501 bp, Oryza sativa
gtactaatgaggtattttgcaaggaatttggtgatatgatgtctagggaatttgagatgtccatgattggagagttgagcttcttccatggacttcaaatcaagcaactcaaggatgggacgtttggcttggaggatgcgaagcccatcaagacacctatggcaaccaacgggcatctcgaccttgatgagggaggtaaaccggtagatttaaaactttatcgttccatgattggtagcttgctttaccttactgcatctaggccggatatcatgtttagtgtttgcatgtgtgcacggtttcaagccgctcctaaggagtgtcacttagtggccgtgaaaaggattctaagatatttaaagcattcctcaactattggcttgtggtacccaaaaggtgctaaatttaagcttgttggctattccgattcggattatgccggttgcaaagtggatagaaagagcacatccggtagttgccaaatgcttggtagatcccttgtgtcatggtcatccaagaaacaaaacttcgtagccctctttatcgccgaggcggaatatgtttcggcgggtagttgttgtgcccaattgctttggatgaaacaaatcttgttggactatggcatatccttcactaaaaccccactcctatgtgaaaatgatagtgccataaagatagccaacaacccggtccaacattctagaaccaagcatattgacattcgccatcacttcctaagagaccatgttgccaagtgtgacatagtcattagccacataagaaccgaggaccaactagccgacatctttaccaagcctcttgatgaaacccgcttttgcaagttgaggaatgagttaaatgtcatatatttctctaatgtggcttgagatggtgcaccatggttgcttcctttgcatattgtatatttgctcctatttgctcttatgctttggatttattgccatttggttcttcattgcgaaaatggagcatatcacattaagggggagttttgcactcttgcatgtgctctacttccttttatatgtaagcaaatcaactagtggtgctagtagtattttcaaaatgcccaagtcaacataagtcaaaacttttgcaaaatcaatgtaatttgaaaactatctcttggaaaatgtttcacaaggttccctatatgttttccaactctcactttgtaagaaaaatgatttttgaatgaaaatgccattttggccttcttttgaagaatctagaatcttgtttttggtcaaaatgagattaaaccccaaaatgagattgagaaggaatttgagaaaagtttcaaaacaaagttggtagtgaagaagatttgaaatgtttttggtattcaaatcatattcaaaaaccaaatatttcaaaagttgtttgaaaatcaaattcgcccaaaaacccctatagaccataaatggtcacctcctagcactcaagtgagttttgttgcaaatcttcataaatttcaaat

SEQ ID NO: 53082 - DNA, 1501 bp, Oryza sativa
ttgtctttgagctatacattttaagttaggtccacgtcatatgtgcgcatggatgattatcgatggattaaaattgacggcgcaaagcaaagggaaagaaaacggtaaaactagcgctttaatttagaattgatcgaggtgtagggcgatcaaatttgctagtttatttttagtttcgccgtactattaaaaggggtaatgacctagcaaagagatgattttaattgccacattaggtcattatacatttagacttgtgctcacatttcacacacacacacttcactaggttcggcttgaccaggggtggtcagaccggccacatagtggcgatctgactggcgtgccctggccggtctgaccggccgcaagaaggcggtctgaccaacgcataaggccggtctgaccggcggcacatgcgcggtcagaccggccccctggaggccgggatggtgctgctcgggatggccgatacagagccgacggagccgtattcggtcagaccgagccgatggcggtttgaccggccaccccatgtcggtctgaccgaccaggctgatggggccctctgacagggctacaacggctagttttctagccgttgcagagtagcacggtctgaccggccacatacctccggtcagaccggcagagcacagagttgggggatttcgctcccaacggctagttttggtgggtgggagtataaatactcccccaccagcagcaagggggctctcttggcacccaattcaattgcatacaccccttgcatctctctcacactcacttgagctttgtgttcatccatctagtgtgttagagggttgtttagccaagagtcaagtgcatttgcttccattgtagagctagtgtggcatttgatcatctccacgccgggtcattgcttgttactcttgaggattgccacctcctagacggcttgtggaggagttgcccggtgacctctccgagaagattgtgaaggaggcccggcgccggtttgtgagtggtttgggttcaccaccttcggagtgaaggaagaactaccctggtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctccttgtctcatttgattgtcgcatttacatttgtgcaatttacatttctagagacatactttgacataggagtgtgatttactttcctagagatataattgagccactatcaccctaggtttgcaaaacataacttagttgcttagttagagttcaccctcaccaagcctagcaacttaggttagttttgattaggtgttatttagttttaaatcgcctattcaccccccctctagtcgacatctcgatcctacaggtggtagtaattaagatagaaaat

SEQ ID NO: 53083 - DNA, 238 bp, Oryza sativa
gcggaaacggtggagtgaggcacggggagcgtttatatagtgttgggagtgaaagagggcgaccggaggggaaggaaaccggcgcggcgatctcgggctgcatcaatggcgccggcgaggtttgcgggagtatttccaaacgaatccgaggaagagagagagggaaaagtggggggaaagggagagggaatcacggggagtgatttccccctctttattgcgcgcgggggcggcggga

SEQ ID NO: 53084 - DNA, 1501 bp, Oryza sativa
agctttttccccacggcatgcaaccaatccaaagcatccacggggttattggagctagagaaggtaggtgggcggatgcggaggaactcggcgagtttagagtgttgtgggggtggtggtggagcattctgttgtggcgggttttggaggtggtggaggaaagcggtcatcatgttggcttgctgggcgaggatttgggtgagaatggcgttggtgtctggtggtggtggtggaggcggaggaggaggtggaggtgggttgccctggtggtggtggttgctgccttcaggttggtcgccatcaccggtagcagcatttctcctggtcgtcaccatctgaaaaccccacacagaaccagcaaacagagaaagagctaacaattaaaactaaccacccacgactaccattattcttaattttattactgctattaaattggttcattaatgttcaagttgcttaggcaaataaaataagacaggctccgacatagttatgccacacaccggcataaccatgccccacacaactcaaaaagacaaacgagaaagaacacacgcgcaagcctactaactgctcgtctactgctgcgacgggccaggacggaaggtgagcaacagcgcaccctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgatcttgagctgatgcagctgtgcctccaccgcgtcgaggtccttcttgagctgcaggttctcctgacgcagctccaggatcttcatgttgttctcgaccatcccgcggcgcaccatctgatggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcaacgaagtccgctcgggagagccagagaggatcactgcggtgacctcccaaccagcgtggggctccgcgtcgtctccctcctgatccggaagcggcctggcctggtagtccactccgtgtggataccccagggccacgcacatgcctcgcagctccaagacgaagccagtcatatccaaaccacgacgggtgacgctgccggccatctacaaacaaaaacaaaaagagaaacaacattttaaaggtcagattttgatgataagtgaagcagcaagacagagagagactagacagttttcacaagtaacaaaggatt

SEQ ID NO: 53085 - DNA, 1501 bp, Oryza sativa
tccatgcatcctggcagcacgaagatgtacttggacttgaaagaaaaatattggtgggttagtatgaagcgggaaattgcagagttcgtggccctttgtgatgtgtgccagcgtgtcaaggcagagcatcaacggccggtcggatttctccaacctctacaagtaacagaatggaaatgggatgaaattgggatggatttcatcaccggacttccaaaaacccaaggcgggtatgactctatatgggtagtcgtggaccgactaaccaaggtagctcggttcattccggtgaagaccacctatggagggaacaaactagctgaactctacttcgctaggatcgtgagtctccatggcgttcctaagaaaattgtatctgatcggggaagccagttcacctctcatttctggaagaagctccaagaagagttgggtacctgcttaaatttcagcaccgcgtatcacccacagacagatggacagaccgagcgtctaaatcagatcctagaagatatgcttcgcgcatgtgtcctagattttgggaagacatgggataagagtctcccctacgccgagttctcctacaataacagctaccaacccagcatacagatggcaccgtacgaagcgttgtatggccgcaaatgccggacaccgctattgtgggaccaagttggggaaagcgaagtgttcgggactgatatcctgagagaagctgaagcgaaggtcaaaaccattcgggataatctaaaggtggcacagtcccagcagaagagctatgcagataaccgacgccgtaacctggaatttgcagtggatgactttgtgtatctccgggtcacgctgttgcgaggcatacactggtttcagaagaaagggaagctcgcacctcggtttatgggtcctttccgtatcattgcttgacgcggagaagtcgcttaccagttggagctgcccgcctccttgggcaacgtgcatgatgtgttccatgtgtcgcaactcaagaaatgtcttcgagtgccatccgagcaggccgactcagagcagattgaagttcgcgaagacttcacctacgtggagaggccagtgaaaatcctggacaccatggagcgcaggaccaggaaccgggtaatccgtttttgcaaggtccaatggagcaaccacgccgaggaagaagctacatgggagcgtgaagacgagctgaaggcagcccatcccgatctcttcgccagttcttccgaatctcggggtcgagattccgtttaaggggggtaggtttgtcacgttccaaaacgactctaaaatatatcccttaaatgatgcctagaataattaaaatccgtgtgaaagcctccaacaattaaaatgtgcaaagttaaaagccaaataaggcttagaggatttttgtaaatttcctaaaagactaaaatgcgtaaataaattttagtggaattttcagagcacaaataataattattaagaaataaacaaagttaaaatg

SEQ ID NO: 53086 - DNA, 1501 bp, Oryza sativa
gcgctgtttcccgtttgtctttgtgtgtgctgggccttcgccgcccatgtaataaagtaactattcacgcttccgcttgataaactctgaaatgtatcaacttttggtgtaccttgcctcctgggacaaggaataatgcacgcacgtaaggaacgcccgttgggttatttccagtcgtgacatgcattgtggacgaaacttttaccattatgtggtcgacggcgctatcgaccgatgttggattttccgccaactcagttgatgcgcaactgctgcgtttttaggtgggacttcctaactcttcatacgcagcagcagcggcggcctgggggttctgttgctcttcttggatctcttgcctaatcttggccctcattgactcgagcttttcgtcgaattcagatgtcagctcagctcttattgacgcccggatcttggcttcaaggcgtgcatctttctccgccttgttggaagtccgcttcttgtactgccacgcgtagtctggaaatccatacttctagggaacggaagacccaacgccccgtgtccgtccacgatgttccttgttgcccaacgctttcgtgagaaggtcgtcctcgcgtctttgagagcaggcctcttgcgaggcttattgctcggcaaccaactccttctgcattataatttagtggggttaaataaactgcacgatgggaaacaatgtgaatatctagtttgactagacacttagtatagcttcgtacactcgttgatcttctggattgtcacgtcccaaaacgactctaaaatacatcctctaagatatgcctagaataattaaaaaccgtgtgaaagcctccaacaattaaaatgtgcaaagttaaaagtcaattaaggcttagaggatttttatatatttcctaaaagcctaaaatgcgtaaataaattttcgtggaatttttagagcacaaataataattattaaggaataaacaaagttaaaatgattttataaaaagaaaaactctaaaaagtcccctttcccttcctctccttcttgggccggctcggcccatctccctccccctccctctcctctccccacggcccatccggcctatccccgcgcgcgcgccgctgacgggcgggcccgcccgccaccctcgccgacgggtggggcccacccgtcatccccttcctcccgccgctcccgccgcctcgcccgcgcctagcgccgccgcctccgcgaatcttgccgcctcccgccgtccccgcgcgcaataaagtggggggaattattccccgtgattccctctccctttccccccatttttccctccctctctccctcggattcgtttggaaaccgttcccctaacctcgccggcgccattaatggcggccgggtctcccgcgcccatttccccctcctccggccgccctctctcactcccaaccctatataaaccctccccgagctcccaccaccgtttccgccactcgccgccctctcttcccgccg

SEQ ID NO: 53087 - DNA, 1501 bp, Oryza sativa
tgcacatctcatccttataaaatgaattgaatgtcacatataaataaactaaactgtcacgaccggaaataacccaacgggcgtttcttacgtgcgtgcattattcctcttcccaggaggcaaggtacaccaaaagttgatacagctcatagtttaacaagcggaagcataaatagttaatttattacatgggcggcgaaggcccagcacacacaaagacaaacgggaaacagcggaagactagggcgacgaccacaggcacttgacggcaggcacgagctagacaccaaagccttcatcttccaggaactccttttctgggtttgggaaaaaattgaacaagactgagtacaaccaccgtacttaacaagacacacccacaagtgcagaataaatgcaagggagtacaagcgggttataatataaagggttagggtttgcagtaaacagcattaaaagacacttagttgctcaaagctattttgtaaatacggtcctagagctataccatattattaaacaaggccgtgaacccacacgaacctgccttaacccaaggcctacgatgattcaaaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctggccatagacaagagtaccgacccaaccccacctacggccggaacctccgggacaggtaggcaggactgagcccccagcagcaggacaccggccctgtgccatgacatctcgactaccgggccgcagctcgtatagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatacggccgagatgctactatcaaaaccatgcaccacgagcccagcctaaaaccattttgatgattttgaatagagggggaggtgtgaatccaattccacaataatccatccattccatagtgtccaggtgatgagaatatcccaaagtctagagttgtaaaaccacctaattttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcggg

SEQ ID NO: 53088 - DNA, 1501 bp, Oryza sativa
gtcggcgaccacgttggccttaccaggatgatagtgaattcccacatcataatccttgatgagctctaaccatcttctctgccgaagattcagatctgactgagtgaagatgtatttcaaactcttatgatcagtatatatttcgcagcgattcccgatgagataatgccgccagatttttagagcatgaaccacagcggccaactccaaatcatgggtagggtagttgccttcatggggccgtagctggcgtgaggcataggctaccacatgaccttcctgcatgagcacgcaccccagtccttggcgcgaagcgtcacagtacaccatgaagtccttgcgagtatccggtaagattaacaccgacgaggaaaccagcttttccttgagagtttggaacgccatctcgcactgcgggctccacacaaatttctcttctttcttcaacaactgggtcatgggtcgagcgatattggagaagttctcgatgaacctccggtagtatcctgccaaacccaagaaactgcgaatttgagtgactgtcttgggttgcttccaatcagtgacggcggtcactgtttcggggtccacagcaactcctttagcagatatcacgtgccctaagaatttgacttcggacaaccagaactcaaccagagctgacaactaaaactaaccactcacgactaccataattcttgaatttatttctgctattaaattggttcattaaagttcaagttgcttaagcaaataaaataaagacaggctccgacacagttataccacacaccggcataaccatgccccatacgactctagcagaaaaacaaacgagaagaacacacacgtaagcctactaactgctcgtctactgctgcgacgggccagggcggaaggtgagcagcagcgcatcctccatgctgccaacgccggaggctccatcctcctgaggaaccacgggcgcgggcttggcacgaggggtctcgacgaagcaggtccacgccaggtgtggagattatggatatcccatatctacacggtgatgatatttgggctgaatataggataccgaatatggatagaatatcttatttgtatttcgggtttgtttctcaacttgtacgtcaaggaattaccttgagacttagtcggttacgactgtattttatctgtatctgcatattccgttagggatatagattatcttttgtaacacggactccttcccatatataagggggatccgggtgcctctaggggcagttgttgattttctccaaattatacaatcaataagacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggtaggggtagcgtcaagcttctcgccgatcagtgcaa

SEQ ID NO: 53089 - DNA, 1501 bp, Oryza sativa; identical to SEQ ID NO: 37850

SEQ ID NO: 53090 - DNA, 762 bp, Oryza sativa
tgaccaaaataaaagttgtagatcttgatgagaggatcaactttgttgttgttgactttttcatttgaaatcatttactatttacaaatgctgtttaaattagtcatattgtgaaaatcaatttcaagctgttgggaacaaagttatctagacaaatgaccaaaataaaagttgtagatcttgataacctctacaattttgttgttgaccatatttcgatttgaaatcatttactatccgaaaatgtattatgactaataaaataaattattatatagctgctatatattttgtactaacaaatataaagacttgattggaaaaatgcaaaaaaagtcatcggtgacgggccttagttaaagcccgatagagattaatctatctctatcgggcattatcttagagcccgtcacagatgagtcatctgtgacgggcctgaatgtcatctcaatcgagcattagtatggagcccgtcaccaatgagtcatctgtgacgggccctacggcaatgcccgattgagatgacttatcactctactataacaagggtttctcatatcggatcgaaaaattttctaagtcctgctacagtttcacacctccttagaaccctagcgccgccgccttcgtcctccctcgccaccaccgccaccgagcccgccgcttccaccgagcctctacaccgaccagcgtcggccttcctcgtcgtggtcgcctgcctcttcaccgacgcgaatagctgacccccaccgagcccggcga

SEQ ID NO: 53091 - DNA, 1126 bp, Oryza sativa
tcctgcagccctacctcccttgcattaattatgcatccgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaacgaccacaggcgcttgacggcaagcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgtagtaaacagcatttaaagacatttagttgctcaaagctactttgtaaacgcgatcctagaacgctacaatgttattaatcaaggccgtgaacccacacgaacctgccttaacccaaggcctacgatgattcagaccgaactggccacccgaccctgggtcccagctcgtcccaagccaacccaggccaaccattccacatttttgttgttaagcaggttttaagaattaaaacacaaacttggatacattgctcggcttgcccataaccgagggcgcggctatttgaatagattatactctgatcagaggtgtacatctttacccacaagacatatcttcctcacgtgtaaccacgtgccacataccaccatggtatacggacggaagacgtgacatagtttccaacccatcctggccatagacaagagtacagacccaaccccacctacggccggaacctccgggacaggtaggcaggactgagcccccagcagcaggacaccggccctgtgccatgacatctcgactaccgagccacagctcgtgtagctttcatttgtcctaga

SEQ ID NO: 53092 - DNA, 1501 bp, Oryza sativa
gatgaattctactgtgaagtatcaaatatgaaatgttgtgaattatctgtgaaccctgacatatatgcactactgtcaagacgttgtaattttttttctaaatctttcaggttaataataagagaaaattcgacctatagcacaggaaaaaaagcggtaccaaaaaatagcataaaaagttcccactttcgatctatagcataggccaccgtttttttcgcccggtagcacttccgtcgcattttgaagtaacggcgttagatcggagtggagaaaatttttgtcggactcatttacccttcgttccccacttgtttggccgcgtgttcggtgacgcctgcgccggcggcggcggaggtcacggaggagtagaggccgctgcttaggaggctgttcctcgaggaggggcggaactcgtccatcaggttgtcgtcgtcgtcgttggacatcaccgagctggacggcatgtcgccggacagctactgtgtctgggtgtcctcgccgtcgccagcatcctcgccgtcgcgccccccacggaagagcgggtcgacggggtccatcacgtggtggcgctgcatcagcaagctcgtcatcggccgcaaccacagcgacggcaaggagaagttccgcgctgtcgtccccggccagggagcaccccaaaccgaagcccaccgacgaagggcgccaccgccaccaaaccgcgttcttcactgacggcggcaaagaggccgcttgaggacgaggacgacgatgatgacgtgggcggccctagcgtcgatgtggatggatgtgggccgttgtacgccctcgggctcattagctccgtcatcgccgatggcgctggcgaacaacgccatggtggccgtactcggcgtcgcagcccacacctccgctgtcctatccctgctgctactcgccgtcgaggttgctgcctacctccaggggtggaacctcgaggaggtggcgtcactccccgctatcgacggcctcttcgccgcgcctccattgccctcttgctcgggaaaaagggcaaatgagtcatttttcatgtcgactcacatgtttggatggcaaatgtgacgggagtgctataaatcgcaagaaaattagtgtcatgtgcttctggtcgaagtagaaaatttgtcgtgctattttttggtaccgggttttttcctatgctacggatcgaattttctctaataataagcactactggatcgtagcagcgtcatgcacagggagaaagagatcgtaaagctagggatcgtcttcgccttccttctccacatgtgcaacccgacgtacgatgaactgtagcggcaaaaaggaaaatcagatagcggcgacgggcgaggcgtcgaggtactgtagcggcaccggcaccgtatgcacagcaagaaaattagatggatcaactgaactaggcccacctgctgactccagcctctaaacgggttttgggttttgagggaaaaaaaaaggttaattggattcatgccat

SEQ ID NO: 53093 - DNA, 1501 bp, Oryza sativa
cagggagaaagagatcgtaaagctagggatcgtcttcgccttccttctccacatgtgcaacccgacgtacgatgaactgtagcggcaaaaaggaaaatcagatagcggcgacgggcgaggcgtcgaggtactgtagcggcaccggcaccgtatgcacagcaagaaaattagatggatcaactgaactaggcccacctgctgactccagcctctaaacgggttttgggttttgagggaaaaaaaaaggttaattggattcatgccatcgtaaatatgcatacttagataaataccattacaattcacctattcgtagctatactattgaaattttataaaattaggatacaagccactgcccgtcatgtttccatccatctcttttttttccgttttctcccggccggcgacacgagttgagctgtcccccggcgtgcatgagccggcgacgcgccatggtcgcgagcccgcgcatgcgacaccacggacgagagtccacgctggtaacgcacaagtcacgccacaccgagcgccgacaaggctgcagcgccaaggtgccgcccgccgtgcctgcgtcacgctgtcgcacggcctcgccgagcagcgccatcgttgcagagctgctgcggctgccaagccactgggttgcggcgcaccgccccacggcgactggcaccatcaaagaagaaaagaaaacgaaaaaagaaaaagaaaaaaaaaactgagagcagcaccggatgaccgagctactagcctggtgcgcgtcgccgttgctcgcgttgtgccccggccgccgcagccgcacagccacgccagcgccgtcgatccgggcgttccccggccgctgcagatggcagagtcatcaggggagaagaaggaaaaggaaagagaaggggaacgcgggaggcagtgtcgatggcgacgccgttcaccgtcgcccacgctgcgccagcacggaggccactgcacccgcgccgaggccgccgccccccgagctcgcgctgaaacgtaggcatcgatgcaggcgtactcgaccttcgccgcgtcgagatcccgtttctcctagttgcttatggtgacgcttggcttctccgtgagtccgtgtcgaggccgagccagtggttgcaggcatcctccaggtccaccggccggcgcggcgcacgagacaccgtagtcggcgtccagcttcgccgcgtcctctccaacgccaatgcttgcgtcggggcgctgcacgccatgctttcttgtgccatgccattgtaaatcggtagctcaggaagaagacgggagaaaaaaaatggaagaaaacggaagaagatggttggaacgagacggaagtggcatgattctaattttgtaaaatttcaatggcacggttataaatagataaattgtaatgacatttatctaaatacgcatatttacaatggcatggattcaattaacaaaaaaaagaaaaaaagaggtccaacgtacagggtccctactactagagtcctag

SEQ ID NO: 53094 - DNA, 1501 bp, Oryza sativa
ccatttgacctttcaactcatgtttggcgttttcagaaggactttcaaccgtttccacaatgataacggtattctctccggtccggtgcgcttcaccgttgaactggcttaggttgacatgaatgtttgtgttgtcgagataggccacttgcctctacattgaggtgcaatggcttgtttgttgtcgacagtagatagagcggaggtgggccaagttcgcaccaataattcacgcttagcaaacaggatcaaggaatcgcatgaatatggacggagacaatgaagggaaggagaggagcaaaatatgaatgatatgatacaacataccacatagagtagggttttgtaataaaaaatgcctagcttgtggcgaggagatgatacctcatttggtttattgctaaaattttggtaaccgaaaaccagcaacacacacatttcaagagatttgccaacaaaccaaatgagcaactttattaattttctcacaaatgactaaactttgtcagtgccaaaattttgatatggttaagtttagcaaacatccgaacacaatcaacatcactgcatatagtgtttcgcacgtcaacatgcatttctaaaatatgcacttctaagttgtttaaaaaagattgatggcttgtttgtattgaggtcaacttgtcggtaccaattatttggtaacttcaattgtataacatagaacccaccattctataaggaactacttcgtaggtgtgaatttggatatagttatgtcttagttcgtactagtcgggaattgtttttttcttgagacggtgcaagtaaatatttgctttgttattagtagaacaatagttcctagccataaatatttatagcatatgttttaatttgtagcagagaccagacgacgtacctcatgtttgatcaagacataacctcgaaataacctcgaaccttgaacgagcatatccaaggtagagactgatgcatctcgagtttccaaacaggtaatccgaatgagttccaagcaagtctataaacaagatccaatactccagagcaaccgtggtgctacagcaacatcagcaatcttttgccaccggatcaacagcttatatcgccagcagatgctgttcaggggactactgtagcggatcccggtatgggtactgtagcatacgaagtgggacagtgctgcagacctgcagtgtcaattttggccattggctccattgatctgatggtgataataggttgcaacttctgatgttgtagtcgctatctacaaaaattatatatagctagaactaagagctaaatatacattaagccataccactcatacaaagtaagagccattagataattcacatacttaatcgtaaccatccaatacatattaactatatgtagctactatctatatttaatttccagataactcaacattcattatcctattgtagtcatcagtttccacaacaacgcgcgcagtgtcatgtattcgaacatg

SEQ ID NO: 53095 - DNA, 501 bp, Oryza sativa
acaagcagagaataagggtgagcaggatgagtagtcaaatccaaaccccaaaagctactactgactgggtagctactacaagtactccattacagaccactctagctaggagtaataactcattaactaagattagccatgttttgtgatttgtgttaatctattgtcaagagaaagctactaccaacggtgaactttaaccatcaaggggtacaggacaactccaataacaccagagaccacaatacgacaagcagaaatccgggtagaaagggacatcgctcactcgaccagtcccaatcacagtcgctatcattcaaggtctccaggattgcagcaagaaaactagcctaataaacaaagatattatcgatgatgtaatagcaaagatggcgagatcgagccatgcaaccacatccaagaatgggatagcagagtcagtgtcaaaagggtcaatatgagatcaagcaacacaagagaaaaagaaagaagggaaatctc

SEQ ID NO: 53096 - DNA, 1501 bp, Oryza sativa
agcttgcagcttgccgccgtcctcctccagtcatcctcctcctgcccccgtcatctatctctatatgcctctatagttgcaagccctaagctagcctaatcagtgcaaaattttggaaaagggaggcaaacctaccagggaaaggctttagtgctttacacatgagaaatttcttcgattggggctgccgggctgggtccccggtgaggcggcgagaaaagggcgacctcccggggagaggtgacaggtcagacgaatgcgaggagagagattgggcgttgaggcgactcaggcgagaaaatcgaaactaccgcttcggtatcacgcgaggcttcgaggggaagcgtcgttggacgtttcagtttctcccactgcttaatttttggtttgggagtacctatacatctttcaaaagatttttataatcgtatcacacagatttttaatatttgtattaaaatccgatagatataataaaaagcaaaaagcaattaagaaacaccataatgaacattaaattaccatatcctcgagaaaaagaccaaatccaatacaaaatttaaaatttacatgtgaagattcaaaaattacagtgtaacttacaaaagttacagtgtaagtttcataaattacactgtaacttacaagaaaatgcactgtaaatttaagtgagaaaatcgagtgagagataagaaaaaatcttccgagtgagatatagcaaaatcgttttggttttggggctttcttctggttgggcctttcaaatttgggccggacgagaggagggtgtggtgcctctatgctgtaggtatgaggaaaaagtgcatccaaggtccctcaacttgtcatcgagatataaaatcatcctccaaacgcaaaatctgataccgggcgtccctcaactgataaaaccgttcactttaggtctctcggtggttttgatcctggttttgtctgacgtggcggctgagtcagcgtaggacccacgtgggccctacatgtcaaactatccatgttagcctcctctcccttcctcctctcttcctctctcctacacacacccagatgagtcgtcggctctgtcgacggcggtggcggaagcgcgtctgcccaggagcggttccgtcggcggcgacgactgtagcgcatcggcagcagcggcagtagcgcgtccgcgcgtcggcggcggcggcggtagcacgtctgcccaggagcggcttcgtcagcggcgacagcggatgtagcgcgttggtgcgtcttcgtcgtcgttgccgccaccgccgtcggcgacaacctcctagggccggtaccgtcatcgcgggcaccatcaaaggagcagcgggagcggatgaggacagcggcggcgaaaaatcccgcatgcaaagtaattaagatcgatcgacaaccacatatttacaacagccaccacgcacatcatctcttcatcatgcatatatatacgcccgcatgcggagtaattaagatcgatcgataacaagga

SEQ ID NO: 53097 - DNA, 1501 bp, Oryza sativa
gcatttgtacggaagatcttggaattgctcttggcgcatttggagattttttaggagcgcagttttaaaagaaacacatggaagaggtttccatacaaacattaacagaaacagttgataccagcaagatggcaatccacataagactccctcctaaagaattaattttactcgtttcaaaggaaaaagaaatgtcctttgtagctgctattagatgtagataaaagtaatgttcaacaatggtggagggtgagaaaaattgaggagcggtgatgactgattacaaatttacaatagctgttcaattatttctcataaaggtatattccgtcatgttcagctctgaccaaaaccgcacgtccacaaaagcaaaagaacggtaacacaagaaatgcggttttcattcgaatgccggacgacaagagcaggaaaagatttacaactttacaccgtctaaccgtctaataaccacacgcaaaaatcaaaagaaacccacctgctgcgccgctccgccggaatcctccgccgccgccgccgcggcgctagcctcccgcctgcgccggaacaacacaaagatgaggactccaaaaaagaaacatctgcaggacagaacaaggagaaaagggaggcgcggcacctctccggagcgggaggctttgactccgccggcgggcggagcagccgccgccgtcgctcggcgagcgggaggtcctcgtggtcggagtcgacgcaggggggaggaggcgggccgacctccttgtccttggccatcaccgcattagggtttgagcgggaggaagcgggggtacggaggattaaggtgagatttaggcgagatgacggcggatttgatcgccggtgagaacgtgggtttggggatggttcacggtgagaaagtgaggctaatgccgatcaggttctcgggcgagctcgcaattttggcccagagcgcgaacgtccaaaatgtagcgatctggcccatgtatcattgaaaatctgctcggtttcgatggcggatctcggcctttacccaacagttctatgggccttgggatgctcgagtaggtccgagtcgtgttaattgacggcctttttgcacacttgggcagatcatgttcgaatacatgacactgcgcgcgttgttgtggaaactgatgactacaataggataatgaatgttgagttatctggaaattaaatatagatagtagctacatatagttaatatgtattggatggttacgattaagtatgtgaattatctaatggctcttactttgtatgagtggtatggcttaatgtatatttagctcttagttctagctatatataatttttgtagatagcgactacaacatcagaagttgcaacctattatcaccatcagatcaatggagccaatggccaaaattgacactgcaggtctgcagcactgtcccacttcgtatgctacagtacccataccgggatccgctacagtagtcccctgaacagcatctgc

SEQ ID NO: 53098 - DNA, 1501 bp, Oryza sativa
tcatgaattaccagaactacgtgattcaagttttatcaggaatgtaaccaatcgtatgttgctgtagcaacgcatttagaacttgataatatattcggaggaaatttggaacgtaagaaaattttgcagcttctgtttgtgtgctttacttcattactacattgtttggtaaccttgcatatcttatacagtcatctattgacatatgaatgtgagtagggttgcgcctttgttcgtcataaatgagtcatattgattaccagcttattcatatcatcggaaattgtgtttcaggtccatatattcttacattgtccaatgaaaccattgcgtcctcaatagtcattttactttgtccatgtgagtagtaaagttggaaattttcttgtagtagcattgtgttttctagttttggtgttgggaattgggaagcatacacaattacacattgttgacatatctttctattatactggtgggttaaccaaggcgttgctgcaggaatttgaaccgactaattgtgtaaaaaaacaaggaaatttgcaagtattggttaaagatggtgtggccgttgggctgtcagacatctaatggctgaaacaattatgatgacctggctcaacgtgagggcttcttcatagccataaggccatttccaacccaagacactagtcatagttttcataaactctacatcatcaagaaactagtactagatttcaatgcaaacaccactttttcatacttaaatttaatgctacttatctcacatgatatcttggatgttgtgtagaaaccatgtctcatgcaagacctggttttcttctctttcctcatttattcacttggcacatcatctttcatcctaggtggtagcttatttaatgctatggacaacatcctagtcattgggttgggaatggcctaagttaactgcaattagtggattgtacttatatagatagtaaggattattatagataaataaaagataaatgtgctgtagagctgtgtcgaaagggatacagtgaatggattgaagaatcaagcgccccataaccccattgaaggttgaagatagtctcattttatgccataaatttggcatgccttcattgttatttatgtggaagaggtaactagtacccaagacgtttgtagcaccccaccgctgtgactgtaaacgtgttcccatgatatatactaatatcccacaactgtaaacttgtaaatgcatcccatgactgcaaaaaagagttgtatcctagagtatagaatttgttttttataatagtcttggcttcatactgatttgcctgcaaacaaggctgaaagtttagtacgtatcactctgatttacatactatggcccaatagcatacaggtatgagccagataagtcctaatgttgtgtagttccataagtttgtgtgtattatatgtacagccagcatacatggttaaccaagcttaggccctctttgtttaggcttataagcca

SEQ ID NO: 53099 - DNA, 1501 bp, Oryza sativa
cacaaaatttttttaaaaaaacaaaagttagaaaaaattatgtataaaaaatttgaattcaaattcaaatttgaatcgggtatgtaaacttttgacttataaactttggatctataaactttaggtgtataaactttagatgtatagaaatactatatacaaaaaatatttgaattcaaattcaaatttgaatcggatatttgaattcaaattcgaatcggatatataaactttaggtctataaactttaagtctacaaattttaggtgtataaactttagatgtatagaaatactatatataaaaaatatttgaattcaaattcaaatttgaatcggatatataaacttttggtctctaaactttagatgtgtaaacttgaggtgtataaactttaggtgtataaatttactaaaataggaaagtaatacggcgccaaaaaaggaaaccaggtggagggagggagggggaggaggagggggatctgatcgccctgggcgggcgagggcaatcgctcgcccagtagcatttccaagctagtgttgtatgttggtcaatttggcgttgtcgtaatgataaagtttttaatggtaaccaattatctaaccctatgcaggttatcttaatgtcttcttactggctccacttttggtctaaaatgctaccacaggaggagcaggatactatgcgcaatggtgctacactcttcgaatcggtagccaagggtctattattccactatgggtgatgtagttccattataattgctaactaaaaaaatttatgtgatttaacgctagtcaatagtaaaggggagttggagatttgtcccatcactttatttctcattttgatttacttttatctttacctttttttattactataaaatttatggttgtgtgtcataacagaagctggagatgtaatccattttcattaatgtaaaaattaaacaggagcagcttcgacaatcaatagtcacatacttgtatattatagttaacaatcaaactattcgagggatctaaagtattgaaagaaataaagtttcttgcaatctggttgggccacgtcatccataaaacagggaccgtccgatacaactgctggtaaacgaccaccgtcggatctgcttaatgtgagccgttggatgcaacagaaattcagtccatgccgtacgatctagtgaaagaagctcagtacaaaaagagcaaacagtctagagacatcgggaagaagccaacgaggggccagatgctgtgcttgcctaattcttttaccccagctcataaaaacatactaggaactcaacaagcacttcagtagtatgagcataaaatgagcatttttttattggaaccaacagtaaacggtcaattttgaatataacgtttgaaccttttagttggaaataaaggtctttctagatttaattatcatgtcatacaatcttgcaaatattcaaatttcaagcatataatttcatgattatacacct

SEQ ID NO: 53100 - DNA, 1501 bp, Oryza sativa
acacggggatgataaggtttggttttttaaaatcttaagacaatgagatagctatttaataaatttgaagtaaaatcagattaaaaatatataaattttgtatgtgtgctagccgcgcaattgcgcgggtcacccagctagttaaactttaaaacttacactacaattaattttgataattctccctcgcaaaaaaaatgataattctttttatctcagtttattttccaagtagtttttaagtaaaaaaaatataaaagttttacacattttttttcctaataagcgccatgactcgtaatcaacaaatgatgaaattgctaacacctagatggccatgttctgtacattgttcaatgtgttggaccaaatcaaaatagatgaaatcttgtactaggaaaatacaaactaaaattatttaacatcgaaggtagtctttggcatatattacaaaacaataaaaaaaattggttaacgaaacaatacgcgcatatattacaaaacaataaaaaaaataaaattggttaacgaaacaatacgcgccaggtaggggtcgaacctacgacgttctgcttaggaaacagacgctctatccactgagctacaggcgctcagtgtttgagcgttgaaacaaattttaaatgaacgcgttaacctatcattgcccccacaatttccccttccttgtacacacgcgacgcgagcggcgagctgttacgatctaaagagaagctctccgcttcgccggcgccgctccccccacccccgcgcgcggaagattgtcctcgtggcggagcgcgtgctgcggctgttgtgctgcacagccgccgggcaccacatttgcagcagcgccgcctccgccgcactcgtccatcgccggagcttccgctagggtttcggcgagccggggggaggggggggggggtgaggtgggccgtccgccgccgcctccgcggagttcctgcctgacgactggatcacgcaggtttactgactaaaaaccgtctgttttactgactttgtttggtttgctggtgtaatttcttctctttatctgttgatgtttttcatgttttctgttcttgcgtatctacatatttgtattctgtacatcattgtagataaatctcacatttgtattcgctcaaatctaaaaatgtacatgcacataatcttgatacccaaactttgtaggaagactctgtctgttttgggcttttctctaaagccgggtaatgaaatttgcctgagatcaaaaaaaaaaaaaactttgtaggaagattttgtatgctatgcaatcttactaccgttaaatgtattcattcaaaacacaataaaggaaatggctttcattacaccatcaagccaaacaaagtttaggattgcttgaatctgattccattaacagttttatttgattcagttaccatttgcgtttacagactctaaccaaacaccacccgactgatttcgctcgcctcttcctcatccccatcagcca

SEQ ID NO: 53101 - DNA, 274 bp, Oryza sativa
caagattggaagaatcaaaagttataaaactgtaaaaataaactaaccaaaagctgaatagataagctttttcatattcacattgtctcgtaaaatctcattgaattttcagctatccaaataagggctgaaatgaccgtgcgtggactcgcaattaagcagaggcggccatgcatggcctctgcctctctgatctctgatccctgatccctggtcgttggcggagagatcatgtcaccactactttagcccagctactcgctgtgatgcgaaa

SEQ ID NO: 53102 - DNA, 1501 bp, Oryza sativa
ctttacttttttttttttgaagaaagtgtttgcaattgcatacagattgactaaaagtctaagatagtggcaggttacataacaaacgagagaaatcaactgacattagagcaaggagctttcaaaaattcctatgtcagttccagcatatgcttgtattttagcaagatttattacaagatcagtcttggagagggttcattaccggtccaaagattgcatcaaccttgacgaaattgctgacactgtccggccttgcagacaacactgcaaaacgtgcttcacaaatcaagcatactacgtataatcgtatacaaaaggtgaagagcaggaaagtagactgtgggtgatacatacactggaagacgccgcggacgaggtcctgatgcttctcggggggctgcatccaataaccaatccatgaagcagagaatagatagaaggggagagcaaagtggtcaaaagcatttcgtcaatcacgtaagctgctattggtcttgggtggggaaattgacccagcacttgtcgggtgggcgaagattggaggggtgggtgaacggggtagaatcgaaacctggtagctgtagaacttgaggaggcgcggcttgccctgcgtgctcatcaccatcacggcctggatcatggctgatggggatgaggaagaggcgagcgaaatcagtcgggtggtgtttggttagagtctgtaaacgcaaatggtaactgaatcaaataaaactgttaatggaatcagattcaagcaatcctaaactttgtttggcttgatggtgtaatgaaagccatttcctttattgtgttttgaatgaatacatttaacggtagtaagattgcatagcatacaaaatcttcctacaaagttttttttttttttgatctcaggcaaatttcattacccggctttagagaaaagcccaaaacagacagagtcttcctacaaagtttgggtatcaagattatgtgcatgtacatttttagatttgagcgaatacaaatgtgagatttatctacaatgatgtacagaatacaaatatgtagatacgcaagaacagaaaacatgaaaaacatcaacagataaagagaagaaattacaccagcaaaccaaacaaagtcagtaaaacagacggtttttagtcagtaaacctgcgtgatccagtcgtcaggcaggaactccgcggaggcggcggcggacggcccacctcacccccccccccctccccccggctcgccgaaaccctagcggaagctccggcgatggacgagtgcggcggaggcggcgctgctgcaaatgtggtgcccggcggctgtgcagcacaacagccgcagcacgcgctccgccacgaggacaatcttccgcgcgcgggggtggggggagcggcgccggcgaagcggagagcttctctttagatcgtaacagctcgccgctcgcgtcgcgtgtgtacaaggaaggggaaattgtgggggcaatgataggttaacgcgttca

SEQ ID NO: 53103 - DNA, 1501 bp, Oryza sativa
attcatgtctttgtagtttgtaacatgaatgctactggatacattttcagccactttgcaaaaatgatatcgacatgtcagaaacacaaaccacaaaaaaacagagaaacaacaaaatacacaagtggtttcatgtcctttgtgtgtgcataggtggctgtaaacgaaatacgtatgtgaagctaaataatagctgagatgttggattcgatgttttgccactatttagattgggcaattgaacgcacgttaaaaggccccaatcagttacatatgggcatctgttcacagttacacattgagaaattaaataaaaaattgccatcaaaagcaatttccattttccttcatggacaactatatattttattatttccttttactttttcgaatggcaactttatatttttttttcttctgggctgccaaaagtaccaaacggaattatgcagtcatgcatgaagaggtgttttttggactttcgtgtgcaatgtgtgaggtgtcagttgagggatttacggggctcaattccttggagaaataaattcgtataattgagaggaaagcctcttttcaggactactagtccactgttcgtctcttccttagcatactgtgtgcataagtgaagaggggaagggggagccaggcatcttcgagcctaggagctcaatctggtaaggaattatgtccttgcttagctctgtgctcttcgatactgttcatggaaacactacgcaggattccttgtttgggagatgcttcaggtgttcagtgttaagtcagaaactggaaatcaaatttcttgttctctgattccccaaaatcttatactctgtgcaagtggggatcatgattatgattacattatgattttatcatcctcttcttccccgttccatcttatgcaggagtatgaaagaactatcaaattattcagcagtacttcatccttagtttagaaaatcaaaggggatttctaaaaggaaccttaacactgcatcctaataagttcttgagttgtttgcgagtttgatttgcttttgttaaataatttctagttatgattcttatcattggggaaaaaaattcttccatttatgtcctgtatgcagaattcatcgtagttcttgagaagtatccggtatctgtatgtatttcatattcagaatttagcaaggtgttcgtccaagaatctatcttctgctcctatgttttgtatgaataggtcataggttttcattttcatccgtcatgtcctatgtagaattcataatacatgagcagtatcagtgtcaatgacttgcacagttgtgctcggctgaaaaatttgtcatatggtgcagttcatcacagatgcctaaaatccttccattttaacaccttttctttagtttttgattgttgcagatggaatacccaaggacactcacttcctgaccgctcaaatatcccatccattccatgctctgatgtgagcaactcggttccaagaatcttg

SEQ ID NO: 53104 - DNA, 788 bp, Oryza sativa
cactcccgtggacccggtccgcgcgcccccttccctcatctgacgcaataaacttttttttaaattaaaatttaaatgaggaaattcgcaaatattcatttaaagagcatagaaacttcaaatggccataacttggccatttgaactcggaattggaccagtcaagtctctaagttttccttaagaagtcaagaacccatttttgtgctttgttcctgcttgttatatggagtttattagagtaaaagccttttcttttccgttggtcgtgtagacgctgcagcttcggaagatccgcttttcgtggaagttgaagccgacgtttgggaaagcgagcaaggcaagtcgcatcatccttgaacatattgaatcgcagtttataaaactatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggatactctactcatggtaccactagtatgattttaggtagacgcttcgccgcttaattaggcaacattaggtggttttacaactctagactttgggatactcttatcacctggacactatggaatggatggactattgtggaattggattcacacctccccctctattcaaaatcctcaaaatggttttaggctgggctcggggtgcatggtttagatagtagcacctcggccatataaggaccggt

SEQ ID NO: 53105 - DNA, 1501 bp, Oryza sativa
aggaaagcagtcatcatgttggcttgttgggcgaggatctgggtgagaatggcgttggtgtctggtggtggtggtgggggtgggttgccttgggggttggggttgctgccctcgggttggttgccttcaccggtgttaacatttctcctggtcgtcaccatctgaaaaccccacacggaaccagcaaacagagagagagctaacaattaaaactaaccacccacgactaccattattcttaaatttatcactgctattaaattggttcattaaagttcaagttgcttaggcaaataaaataagacaggctccgacatagttacaccacacaccggcgtaaccatgccccacacgactcaacaagaagataaacgagaaagaacacacgcgcaggcctactaactgctcgtctaccgctgcgacgggccagggcggaaggtgagcaacaggcatcctccgtgctacctacgccggaggcttccccctcctggggaaccacgggcgcaggtgcggcacgaggggtctcgacgaagcaggtccatgccagggactgacgaacaagctcaggcctggaggtgctcttgcgggcggtgatcttctggctgcagcagacgcggcgacacttgggacggcagacctctccctgggcgaccttgagttgacacagctgcgcctccagcgcgtctaggtccttcttcagctgcagattctcctgacgcagctccaggatcttcatgttgttcttgaccaacccgcgacgcaccatctgatggaagtcgatacgggccgcgtcgtacgcctccaccatgcgcgccaggtgcatgatggtagtgtcatcctccgagctagcatcccggaaggtggcgtagtcgcgggctcctccgcggcgagggttgtagcggtagggcgagtgctgcaactcgtccgggtagcgctggtgaagagtgtcgatggtgaggagagcgtcgttctggcaagcggcggagaaagaatctccacccgcggtgactgccaacgaagtcctctcgggtgagctagtgaggatcactgcggtaacctcccaagcagcgtggggctctgcatcgtcaccctcctgctccgggagctgcttgccctggtagtccactccatgcggataccccaggacaacgcacatgccccgcagatccaaaacgaagccagtcaggtccagaccacgacggttgatgctgccggccatctacaaacaaaaacaaaagagaaaagcaacattttaaaggtcagattttgacgataaatgaagcagcaggacagagagagactaaaggattttcacaaataagaaaggatttttattttgaaaatattgctaaggcttgggatctacggctcgtcctagggtcaaggggggctctgataccaacttgtcacgaccggaattaacccaacgggcgctccttatgtcacgaccggaaataacccaacgggcgttccttacgtacgtgtattattccttatccca

SEQ ID NO: 53106 - DNA, 1501 bp, Oryza sativa
tcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggataaggaataatacacgtacgtaaggaacgcccgttgggttatttccggtcgtgacataaggagcgcccgttgggttaattccggtcgtgacaagttggtatcagagccccccttgaccctaggacgagccgtagatcccaagccttagcaatattttcaaaataaaaatcctttcttatttgtgaaaatcctttagtctctctctgtcctgctgcttcatttatcgtcaaaatctgacctttaaaatgttgcttttctcttttgtttttgtttgtagatggccggcagcatcaaccgtcgtggtctggacctgactggcttcgttttggatctgcggggcatgtgcgttgtcctggggtatccgcatggagtggactaccagggcaagcagctcccggagcaggagggtgacgatgcagagccccacgctgcttgggaggttaccgcagtgatcctcactagctcacccgagaggacttcgttggcagtcaccgcgggtggagattctttctccgccgcttgccagaacgacgctctcctcaccatcgacactcttcaccagcgctacccggacgagttgcagcactcgccctaccgctacaaccctcgccgcggaggagcccgcgactacgccaccttccgggatgctagctcggaggatgacactaccatcatgcacctggcgcgcatggtggaggcgtacgacgcggcccgtatcgacttccatcagatggtgcgtcgcgggttggtcaagaacaacatgaagatcctggagctgcgtcaggagaatctgcagctgaagaaggacctagacgcgctggaggcgcagctgtgtcaactcaaggtcgcccagggagaggtctgccgtcccaagtgtcgccgcgtctgctgcagccagaagatcaccgcccgcaagagcacctccaggcctgagcttgttcgtcagtccctggcatggacctgcttcgtcgagacccctcgtgccgcacctgcgcccgtggttccccaggagggggaagcctccggcgtaggtagcacggaggatgcctgttgctcaccttccgccctggcccgtcgcagcggtagacgagcagttagtaggcctgcgcgtgtgttctttctcgtttatcttcttgttgagtcgtgtggggcatggttacgccggtgtgtggtgtaactatgtcggagcctgtcttattttatttgcctaagcaacttgaactttaatgaaccaatttaatagcagtgataaatttaagaataatggtagtcgtgggtggttagttttaattgttagctctctctctgtttgctggttccgtgtggggttttc

SEQ ID NO: 53107 - DNA, 716 bp, Oryza sativa
aattcctgcagcccaaatgattattacaattttaatatgagattagtagccatttaatataagattattagacttagcatatatatatatatatatatatatatatatatatatatatatatatatatatatatatatatatatatatatatatgactattacaattctaatataagattattagggattaaatataagattgttagagatttaatataagattgttagacttagcatatataaatgattattacaattttaatatgacattagtagccatttaatataagattattagacttagcatatatatatatgactattacaattctaatataagattattagagattaaatataagattgttagagatttaatatacgattgttagacttagcatatataaatgattattacaattttaatatgagattagtagccatttaatataagattattagacttagcatatatatatatatgactattacaattctaatataagattattagagattaaatataagattgttagagatttaatataagattgttagacttagcatatataaatgattattacaattttaatatgacattagtagccatttaatataagattataagagatttaatataagattagcagagtttcaatattacggttagcaaatacatcctatatacctaacaaatattttttgtatgcacaga

SEQ ID NO: 53108 - DNA, 1501 bp, Oryza sativa
attggcagtatccagataaataattaccttagttgatataagaggtgacggtgttacacctacaaatacaatgtttaaaagactaagggggtgtttagatccaggtgtataaagttttggtgtctcatatcgcgtattatatagggtatcgcatggggtgttcgggcactactaaaaaaactaatttcagaatctgtcagtaaaccgcaagacgaatttattaagtctaattaatccatcattagcaaatgtttattgtagcatcacattatcaaatcatgcagcaattaggattaaaagatttgtctcgtaaattagtcgcaatatgagcaattagttattttttagcctatatttaatacttcatgtatgtgttcaaacatttgatgtgacatgatgtaaagttttgggatgggatctaaaacaatgcctacaataatcttcgctttatcacatctcgatgtatgtatctaactttattaaattctaatatatttgattgtttcaaaataaagtctttgcggcgataaatgggtgggggaagttatgttattttatgacggagggaataatagagaaatgattatatcttaacataaagtttaaacaaatcaaatacttcatctgtatcacgatataagtcattctagaatttttcacatttatattggtgggaatgaatatacacaccaccgcaccgtatgaagtagggaccacgacacgttaaaataaataaaaagaaatcccaaacactctcgcctcgtctcctctcacaccacacgcctcgcatcgcatccccacctccgccgatcccgccgtctccggccatctccgccgccggcaaccaccaccacctcctcctcttcccctctcccccttccgcccaattggttgccccgaccaaaccctacgcgcggaagggctcgctcgctcgatccggtgcgggcagcgcgcgcgcggggctcgacgcgggcggcgacggggggcgggctcgatccggcggagcagtgggcgctctcttccacgatgcgtctaccctcttcgcgcgagcacgacaaggtttgcagtagcagagaattttgtttcgtgtttatcgattgggcatcttcggcgcgggagaccggggagtaggttggtaggtaggcttgccgaatccagcattttcgcgtgccccctcgtagcttccgccctgctactgctgctgcaatcggtgtggagagagataattgggggcattgtgacctgcattcccgcagggcaggggcaacgtcgccatcgtgcgcggcaccgtcgtctagtctcccatctttttcaagaaagaataatcgaagattaatcttgaccaattcaattcatttgtgctgcaggttctttttgcggggtcaacaataatgaggagaatttgagttggtctggaattactctgggatgttatcattggcgaaaagtatagatcccttttggtagctgaggagagatctcaattttttcagagagtaga

SEQ ID NO: 53109 - DNA, 635 bp, Oryza sativa
caccttagtgtctaaagtcatacacccacaactccaccttctcttgattatgaatatactccctccatcctaaaatgtagcaaacgatgttcagattggacagaggtgtcacgaacccctcttgagaattcaatcgaacagcttgagaacgaggaaggaaggaagagtccaggaagaatagaggagttgggagaggagagaggattggaattgatttggggaagatagtttgtacataatatttttcaacgattctctctccttgctcgggtaacatctttatagactcagatgttcccttacacaacccagtccggcccactcacacgggtattgggcttcctttgtcttgtgcctttgggccttgtcttgataggattagggtcggtaacattcccctcttcttgagaaccagcttgtccccaagctggagcatccgagaaacgctccttcaatcgctccaagtcttcccaagttgcttccgaggaagaacacccagtccaacacaccttgacttgaggcacagcggccgctcctcgacggacaagccgccgcgccaacacttgtgctggaactggatcaacctccgcgaccacaggagggagtgctggagcatcaggtacttgaggttgaga

SEQ ID NO: 53110 - DNA, 1501 bp, Oryza sativa
atgcattatttgaaagcatcaattttacaagatttttaaaaaatatatcaaatcccacaaaaataattttaagagtgaaaattcagtctggactccttactgaagttccatgttacaccccctttagcccatactagaaaattggctgccggttggctcgccttgtagctagcccgtccatatggctttaaaaaaatcatttaatcaatatagcctcttatattgctacatcgatttctattttgttgtaacctatagcaggtagtatttttccttgtcatatgctaatcaccatctattacatatatgcaggtaattttcagggcaacgcactggctccggttttaggcaagctacaaagatgtgagtatgatggggagttcctaaaggttgcatgccgcaggttggagtcaatgcttatgtaactatttgctaattatgggtgaaggttaacaaatagacttcaataaatgtgttcttcttaaatgtgttcttcttattttggctaggttacctttgtttactcgtttctggggtgctactttgtaataattggatgtaactctttttaagcaaatgctgggatgatatattctattatcttaaaaaaatgcatattggctctgcgctagcttgttgcaacccgcagggaatggggttagaccggctgtgctgtgctcgggtggagcatgctaaggtatagctttgtaaaaaaagaaaaaaaaaagtacgaattacccaattacagtactagactattttaaccctaaattttttaaactggataaattacctcctataactcagctcgaagcggttttaatcttagtctcgaagcggttttaatcccacaggcacacaagtggcagtctaatcgataaaaataataaaaaatagtgggccccgcttatcagcatcttctctcttttgctttcttccacctccttcccctcccatccatctctctctccagtcaccaaggagcactgagtaatggcagcaacggcatcaccaacgcgggaggagaggagcagcaggtagcgtgcgtcttgcagcctcaacggcacgcgctaggggtggcggaggacggcgcgacagtctaggcgagggcggcggcagcattcccggcggcaggcggcaatggtgtgcgagacgagggcggcgaaacgggatgcggcctcggcttccatcaacacgcgggagctagggcgagctccggcgctgaacctctccggtaaccggctcaccggcgagttactggaggggttcttctcgctggcgctgctcgagaaggtggatctctccgggatgccggcgagcgccttcctcggcacgacgctctgcggcgccctgctcgccccgtgcgccaaccccgcgctgctgccgtcatcgctcgggaacagcaagggcggagggaagctcacccgtggcgcggtcatcggcatcatcctcgacgtcgtggctgtgctcatcgtcatgcttgttgggaatagtcccacgt

SEQ ID NO: 53111 - DNA, 1501 bp, Oryza sativa
aaccaattgaactatgtgtatttcgtttgctaagaaaaaaaaagtcaaaggtccgctgaactcccaagacaagagtatatttacatattttttatgtcgaaaacaaactatactagaaacacaacacgagggccgcttgatgcatatgatacaaatgaagcaaatacatgatgcaaaccacatatatagtgcaaacatataaactaccgtaaacatttgagatttatccatatctccatgagttaaacttttactctttgtaaaacttttactcatcattaaatttgtgaataaaagttttaatcatagtgatgtggataaatttcagacgtctatttctttatgatatggtagttcataggtcttcatggacaacatttggatttcccccaaatgtttgatgcatcatcgcaaaacaaacgagccctcgtgtctaccagttctctcggttggagggacagggatggttaaatctcaatatgcacaactcttcccttgtgcaccttcatattgcgttcgcttccacgtatatttatctctttgaaaatgccaacaaccgtgcccagtaaatggaatttctagtagttggctacggtttggatcgtcgttgtcatcacattctggcagaatagtcatgcacgtgattgaagttgagcacccaaacaagaaactcacgaggtgcatctcttgatctgttcctgtgaagccaattatacttgcctcatgtaggaaatccatggtaatgttgggttggctcgccaatgtatttgggtcctcaaatagtggtatctgtggataaagaaaacagaaaagcattaatgtaagccgcctgtattttgaggatgcgatattgcatatatatagtagctaattatatagagaacaacatagtactagatatatatttcaggaaatcaactcaccttatccctaccactaatcttgacgcaaaacgatcttaggccaggacacatcaggagcaacggccgtacacatgtcacaaaacgatgttccggccacaagtaagatgttttcactaccatgctcctaactttgtgaagacgaggtgcgcccttgtccatcaggtcaatgagcccattcatggagaacatgtgtcgaagatatatgtctaaatgctcgatgttaggacagttcttgaggagccataaaccgtagtcagtattgcacgagtactgtccgcgcatgcgtaggccaaggttcctgagatggcgaacgcttgttcgatcgtgtatatgcatatacagggagtcggagccgaaaagaggacagtcttagctcgatggacgtcgtcctcgcattgctgggcaactcgagaattggcagcgggtgatcatcatccgtctcatagcttgaatgataaggcgaacaaagtttgaatgtcttgatggtgtgttgcatggcgtagcggagccagtcattgatctgctctggcgtggcgctgtcgctggtgggcatggagatactgagagattgtatgtta

SEQ ID NO: 53112 - DNA, 1501 bp, Oryza sativa; identical to SEQ ID NO: 52883

SEQ ID NO: 53113 - DNA, 1501 bp, Oryza sativa
gtcgctgtagaacaggacgcaaccaacatcgagaagcttgttgcgtgcgacaatcctcccaagaacgccggtgcttgcaatggagtctgttggcaactttttgtgacaagttaacaagcacaatcacaacactgtacctaaacgccttacggtgattgtagagtcaccaaccaccctaacccagcaagcactaggtcaagatgggttttgatagattaaaccagctagcagagccgatttagatgaaaactagggataactatccatctcgtaggcaaatggaaggttttcagaacaaacctacaaagaggtgtcgcactctcacagcggcagtggataatttacaacgcaaatcgacaaagatagacgaactaaactagaactaattgaaagtaaaaaagcaatattgaaaaaaacgattctattgattgatcgttggatagattacaattgaaccggccttgtcccttatataggggttgatcttaccctctacaggctctcctccacgtccaactcgggatagaaaccaaaagaaatccgaaacatgccttcccaagcaagaaaaattcgagacccgacaaaacagactcgggctcggactctgccggtcagaccagccacatgtcggcggtctgaccggagttcaggccacggtctgaccggcctatacacggcggtcagatcggcctgctagaggaaaacaccgttggatcccaaactttggcaattattcctatttcaatcctaggtgctaaatttgggtgtaaacacataccccctacctttttggtgaacaacgtgaacctgaaggcatagaacatgttgtcttagggtgataatccaattaccggccatagaactttctaaatatcttgccaaacactcgggaagtatttcttcaagtagttcccattgactgctctctgaaaacgctctccatgaagtgtctccaaaaaatacgcgttccctgaacaatcccgcatactcgataaggacattcccaactaggagaccaattaccgaactccttagatcgagtaccctctcccacttgaaacaattttgctttcacccttttgttgtatgctttagccactctcttcttctctttctctatttcttccaaagcctttaaacgtttgttgataacatcatcaagattatccctatcaaggtcttgtagtctccactcaacaaatcgtcttgcttgatataccgaagagagtcaagatttacctcgaccgacaaaacggcttcatatacataaatcaactcaaaaggagtgaccttagtagcaccatgtttagatatcctatgcgcccataatgcttcagaaagcaccttatgccacttatttgggtgttcttcaatcttctttttgactaatttcaacaatgttttattactcgattcagcttgtccattagcctgagcgtagtaaggagaagaactcaacaatttaataccgtaagattcggcaaaattcttcacttcctta

SEQ ID NO: 53114 - DNA, 1501 bp, Oryza sativa
tttatgatgtttgcaatgatcaccacctcatgatatagtcttgttctttctttttgtatgtgcatgttccaaatttaccctcatttatttttaaaatcaaggtgaagttacgcttgttgattcgtgttgcgcttatttaagcgtcatattaacgtatttgttccggaagtttaaacatataattctccccccaaaaaattgagctatatctgataaactgagaagggaccataaaaaataatttataggttaaatttaaaataactccaaaataattttaaaatttttagtgttattagaggtttaaaagccaatgttaaaaaataaactacaataaaataattataaaacaagctgtataactaaaatttaaatttaaattttggttgtagttaataaatcaataaggagactatagatgatgatgggaggcatgcacaattgtttcaaaatagtaaactccaaattatgtattgtaatgcacataagcactcctcccatcccaagtctcaactatatagattttgctaaattgagttcgaatttgatgcgtccaaaatgtgttatccggcaactcatatttgagatttcttttgctgtataatatttttttattaagaaggaaaatccatcgaaggacttgttcaatttgttgcccaaataaagtataccaaattttggtaatgctaaatgacacattttagcattattaaatttggtaaattttaagagagagcttctgaaaatacctaaattcgattatggagggcatgctgtgtgttgtcgttaaatgaacagttatttttttagtttttgttttggtgtatcggagctttccagaattctagtcacgtgacatctctatattaatgaaaaatggaggggcgtcgcccttttgattaaagaaattctaaaatttgatactcccagtcaaactatgttaaatttaattaagttttaaaaaatacggtaattttcaacccaaaatagcatttatgtgataaatattgataaatttgtctttaaacttagtaaatctaaataagtttgacttagaaaaaaaatcaaaacaacttgtaacgtgagacggagaaagtactaggtagtaatggctaaagtaagtttagtttattatctaattttgataatattaaaattcggtaaagtcgaaagtgataacaaaagttgccgatcatccgagccgttgcgagcttcaactgaacggtcaagcgtgttcggttcgtctggtttagctcccctcactggaacacctctccgtcgtgaaaaccaactgccggcggcgtggaagtcgccggcgagttcatggccgccgcgctcatcgtccccgcaaacccaaaccctactccaaaccccacctcctccctccgtcccccatcgcgtgccgcctccagtgtgctccgcttcccccgccgcgaccgcgctcgaacccatctcactgccgcgtttgggaggggatcacccgcggcggcggccgagcgcg

SEQ ID NO: 53115 - DNA, 1501 bp, Oryza sativa
gaacggaaaggaaggaaagagtacgaaaggtaccataaaaaaaacaaaccaaaaaaaggaaatcgccgaaacgacacgtcggaggcgcgattcctcgtggcacggtatcggctactgtcgcctaccgctgacacgcggggcccaccgacagggggcccaccgaccagggggcccacatgtcatcttcacggtgatggcgtggggacggtgaggcacggcggcgcggttcccacgttccgttccgtttcgcgttacgggggtgggtggggcccgcatcacagcggggccatgacggcagcaaccgaaccccattctctctggttggggggtttattattggttatgggcttgtggcaggatgcagatgacacctgaagaaaagaaaatataaacacacttggtgattaattgttgcatttgcatggagtttaatagtcaaaaagtgatttcactggatgttatgatgcgaaaggagtcgtctaattgcacttgtaatggcgttgtttttgacaaaaatctatttgttgacttttggttatgtcagggtgtccggttgttcataaattctgatggggaatgtcaaaattgtactgcaagggtgaaaaagattgcagagccaggacactcttccgaatcagacgagtgcaatacaccaactgtgtattgtctgctgatctgacgagctcaatcagtagacagaagtttagttcggagcatttggctaacgtgtttcctaaaccatcattgatttgccgaatttagaaaacaattatcacaccaaaatgaactagtatactgaaccatccagagatgccatgcctatctcttgggcatcatcaagaggcagttcgctgattcctgaaaatattttctgaaactttcagcacaccaacttggagagtagcagtactaaatttactcttggcgatcgcatgatccgaggaatctttgaacaagctacggacaaacaaaacaaacaacgcatgacgtcaaccacgatctgatcagaacatttctttactcccattaatttggtgatcctgctttgtaatcttccattgacagaaaaaaaaaaggctcctctgccaatctgccatcagggcttgtaatcaactgctccctcttgttaccgaccctaatcctatcaagacaaggcccaaaggcacaagacaaaggaagcccaatacccatgtgagtgggccggactgggttgtgtaagggaacatctgagtctataaagatgttacccaggcaaggagagaggatcgttgaaaaatattatgtacagactatcttccccaaatcaattccaatcctctctcctctcccaactcctctgttcttcctggactcttccttccttccttccttcctcgttctcaagttgttcgaccgaattctcaagaggggttcgtgacaaatctggtatcagagcagtcgatcctggagtacttggagaaaccccgctatcactcgcgagcgcaactcaaggcaaacaaga

SEQ ID NO: 53116 - DNA, 1501 bp, Oryza sativa
aggtggcgatttatcccgactataatgttttcatgcatgctcctaggcaaaggtcattcgttatatgttctttaaaaaatgctaagcagctatcaattgtgtacgaaaaatctttcaggacaatgttatttctttcttgctctgatgctctctctaacggacatgctcttttttttttagccaaagggggaagaagagtacatagttcaagagatacaaccaatataaagaaaaggcggtagcttgggtagggggagggctatctcgcagcccatctagagttcttttttttaaaaaaaaaatctaaattgctagaaaggaaactgttgtcgaagttaaaggaattacacatcaaggagaacatctccgtttgatctttctgtctcctctgcatttcttctttgtccaggagaaccaggacttccactgttccacagtctatttcctccaccagaacagtactttttctccggtcctggtcaacgtaatacaaaacatgggtataccggcctttgtttacctgaaattttagctgtgccttttttaattctgcctgcctgccgttcaattcattttagcactatatacttccctttccaactttggtctttatgtcttttgaaattgtagcttagatactaaaacacgtcaagactaaattacagtttgtcaaaccgaggtgatatgtagattatacaaaaaccagccggcgttggctgttaataccaatatatttgtaaggatgttctgcatctaccagtggaaatttttgacttctctaccaatagcatgtactaaaaatttggttacgagatttcattggttgtacatttaattattgtattgccattttgttccctgtctctttctttaaaataagtgaggtgggtgggatgtattttatttatttttaatccacgatttgatgtaaccctgcctagctgtatcaggattgtgagactgtcaattgtcgctaagtggaaaaacatacacctttacttttcataaacgactacaaactgtgttaaaaatggtgggatgaaaacacttaatgcaaatattacgaaataagtaatactctttgtatcagggagagaaatatagaagtataatgtggtgtttactctttagtatttcttatgcagtaagttctcagttgtatgaatcaccacatatctttcttgtactgacattaagtatagagataagatttgcaaatcctggactataataaactagtttttattgttcctatattcacatcattttttagagtttgttcttattaataattttttcactacaaactcttaatataactgttaagataaggtgtgcccaatgtgttatacggcttattcctaatatttcataaccctggacaaactccccatgatccatatgaagggtaacaccaattaaattctctctttttatatgctcaaaagacactgctttccttcatgtgatatggttaccttttgggctaatataggagaga

SEQ ID NO: 53117 - DNA, 802 bp, Oryza sativa
aaatttagtaagcccctaagagaattatcacgtcgccaatagccggattcctgctatattcggttaaggaaattaatatgttaaaaggaatcttatctacaagtgatcgagttcaaggaggatgcggcatggcagtttatctattaattaggcagtatttgttagtttcgttttatctttaggaaagtgtgtttagtgtcctataaggactttatgttctcatttttatcttttaggaaagtttatttcttatcctacgaggactagtatctccacatgggtataaatatgtatatccgtggtcattgtaaaatatatccacgatcaatacaattcggcgcatcgccaccttttaccttttctacctttttatttatcatccggcgggacttagcacctgacgcggggctgcatcggcgttcgatctccggcgaaggggtaagtccaatgttccgttggtccaagcaattgtctcatctacgtcggcatcgttcagggctacatcagtacattcgacctcttggattgctccgatttggatgatatatgtgtctgcctatttatcatatgtcttagttaatttagtcttagtatctcaatttagctctatcggttgtctctcgctttagggtttctaccggtatcggctaaattgttttactagattagattagccaaggcatctaccaccctaaaaatcagtcaacggcttgattctctagatattgtgtttctttttatacttagtgccgcatcaattaagtttgatctactaagttgtgtttagaccataatccctagc

SEQ ID NO: 53118 - DNA, 1501 bp, Oryza sativa
taatatttaccttttaatttattataatagagtagataatccttggtaataatttgctcagtgatgcaaatcaaactgggccttaccctgccgtagggctcgtttgggctgggggcccagttaccagcgaccattccaagcatgcacgttcctcctctcacggagcgccaccaccacaacacctcgcgaggtcccccgccatcgccggcggccttttgccccatgaggaggtaaacgccgctcgccgccaccgccgccgccgccgccgccgccgacgccgtccgccggcccgccgcgatgatcacccacgtcaaatcggctctcctctccggccaccgcggcccgcaccacctcgccgcctccgccgccgccgccgcctcgttccactccacccctcccctccagcggaagcgcaagacgcagtggcaccacgtaatccgccttctttcctccctcccctctctctgttgtgtttgttagcggatcctcgtctccgttgaggaaaaaaagattgctcccttttttgttttgatctgccggaaggtgtgggttgggttggtcggtaaggtgttcgatgaaacgcctgtgtgtattgggggggtgggggaagccttgcgaattcagtcgttttatttctcgtgcgctcgtgatgaatttttgcgcgaggagatctgtgagctcgcgctgtgtagctcctgcgtttcatctgctgggatgggttttggatgtggaactgattggcgtttgaatttgattctcgttataactgacatgcaggggataatgcatgcgaaaattgaggaatttattgtcagtgctcgtgtgtgttcccatgggtaaattgttaggctgttttgtgtattgctcagtgttcttagaaaaatggtctacaaggttgcatagattgaaggaacggttgtcctgacctagtaccacccctaaggtaccgcatgagcgctataaagtggaatgcctgaaacaaaacatcgcactaccttttagaacattgatattgcgatctgcactttgtacattttgtaatatgatactccctccgtttcaggttataagactttctagcattgcccatattcatatagatgctaatgaatctaggcacacatatatgtctagattcattaacatatatatgaatgcggacaatgctagaaagtcttataatatgaaacggaggtagtaatttgctgactttgttagctaattgtacttgattgcagaggctcgagcgtggttaattttctgttgtgcttattaaaatgattggttttccttgattctatttttagtttgcttgtttcagtttgtctggtcatcacgtaatcatgctttaagttttactatcctctatccctttgttatgttcgatgtttaaagtagcaacaattgacaagggattattgttttttgttgcaaagtagttcatgtgatgaatagagctaacatttttttcttttgctcccccacagaggttcagttatta

SEQ ID NO: 53119 - DNA, 1011 bp, Oryza sativa
  unsure (1)..(1011): unsure at all n locations
ctaagcatggctaagcaatccctagtccaatctctagtcatgttataaccccaagctgacaaagggacatggtacaacaatagcatggctatgacaataggtaaacaccccttagtaacattataaaacgatgcagtatttgaaggaaaacaatagagcatttgcaatataggatcaacatgttcaagtgacaagcatgacttgccttgctctgctgctggaggaacctcggcgactatttcaaagtacaccggagcgtcggaggaaccggaatctagcgacatacaaggcaaacattgcaaacaggctataagactactgaaacagggaacaaaaccgtttttaatggattctacacatttttcttgatttactgagacttgaatgggcttaaacggagctcggatgaattagttatgaattttagaagattcattgtgtttattactataaaaaaaccttaaatcatttattgcgcaataattcccagggctgacgtcagcacggagagggtgcggcgccggcaagcgaggcccactggtcagcggctcagggggggcggttcaccgtggaccgggaccacgcaggtggtccaccgccggtccacgggaccgacggcccagatcgtcctcgggccgatcggacgggccgcgatagaggcggccgccaggctcggctcggcatcaaagccgaccggccggccagggctagcggcgacggcacgcgcgcgcgaacgcgttgccggcaatggcatccggcggcggaggcgacggcgcaaaagcgacgcgaaagcggcggcagcggacggcggcaacgaccgaaggcgacggcgagcgcgggcggcggcgacgcacggggaatcggggaaggaaaagaaaggggagggagtcctcaccgaaggggacggcggcgaccggcgacgaggagcgacggagggaggtcgacacgcggcggacggcgaccgggacgacctanagaacgaaaagaaatagattagagaggaagagaggg

SEQ ID NO: 53120 - DNA, 960 bp, Oryza sativa
tcacaaatagaacttttatcatgattgcttcttagttcttacaatttccgcaacaacgcacgaggtatcatttagtcatcttgatattaaggatccataattttattgggcagatagacgaaaacttttactggcatgtgatacttaataaataattagcatgtgattaattgagtattaattatgataaatttagaaataaattatttgtaaagaaactttatatattttatcagaaaatacattgtttaatggtacagaaaatatgatctaccactctaaaagactccaatggtggtggtggaccaccactcactatcacatgggtccttgttgcagtgtaccaatcgtatgttcaaaattcaaacaactttagagtgatcaatacccaatatacttatgcataacttctaaattttacatgattctccaagatagcaagtgaccgtcccctccgtaaggaatgaggtctcttaaaaaggtaaatgggttattttttagataaaataaagttttccaactataatatctatattgattaggcacatagtcgaattaaaactgatgtatgtatcaactaacaactctaacatgtcctagtcaaaactcctacgatttagtctataagaagacacatatattttttcttatagctttgctgggtaaaattttgcacttagtcagcatagattttcaaaatatttccaaatatctgaaatttccaaatctcattgtcctcacaaaagaaaagaaagaaacaaagaaaaccaaccaagccaaggatcagccacagaagtgcaaattaacaggcgcgttggcgagagaccagacagaggctagaggggataacggtcgccgaactatcctccatccacgtggcactcacctattggtccacgaatcggcaccgctcatccattctctctctctcacctcttcgctcgccgccggccaccgtca

SEQ ID NO: 53121 - DNA, 1501 bp, Oryza sativa
tctctagctgcttaggtcatgcatgatccatggttggaacagcatcttcttgctgctttggtagttctcactagcattagtaatgacatgactttgcttgattgcattgcacttcaattttagtattagttacgaattaatttatggaaatgagcagcttttgcacttactattcctagtataagaggtgctacttatgattcaaattgagctgtttggttcatttcttatgtgtgtactttccattttgtcccgccatttgaaattgcaacttatttgcttgtttttattgtgaacagctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtggtatgctttgcacaattgcgttagttctcaacatcctgtctagttttgctttgtttctcacctatcactggcttattcctgtagagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgcgtgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaag

SEQ ID NO: 53122 - DNA, 1501 bp, Oryza sativa
cgtcatcgttcctcctcgccggctcgtcgtctcgcggcgccgcctccgtcgtcggattcgcagcggcgtgttccacaccgtcctcgtctccgtgcagccgctgccggctgccctcgttgcctcctcgccggtcccggtcgtcgtcctcatcgtcgtggcgttcgtccctccgtcaagccgttctcgtccgtcgtccgcgtccgtcaagtgtgccgctgcagccccgtcgtcgtcttcgtcctcgcctccgcgtcgccaagcgttgcgtcggccgcgtctcgccttcgtccaaggatcgccgctgaagtcgtcccctcgcctttcgtctccatcgttcctggccgtctccgccgcgcccgttcgtcgttgtcgttccctcgcctcgtcgcgtggtggtaaggatctctccttcgctgccccgtcctcgtcctttcggtgtcgcccgtgcccgttgtgcggttgtcgaccccggtactcgtgtaccagtgtcggtagtcgttcgcttgtgcgtgtggtgaccgtgttagtgtgcccgctcggtagccgcgtggtttccacgtgtgcaggccgtgtggtgtctagtggagtccgtttgtcggccactcgcctcggttgagacacggggtccgcttccgtcgacctgtggaccgtctctgtgtacccggtctgccgtggtcccttaggttgacatgtggggtccgcatgtcaacagcgcagccttcctgtcttttccaggctagcgcttacacatgttttataattgcaaaacctaatcacaataattcataaatctccatgtaacagcattaaacttcagatgatcatatcttggtcatacgaactctgaatcgacccgttcaagtctcctaatgtttgttataacctaaagaaccatgtgctttcatttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttgtaaaattattttgatttaaattaatgcattatcgctttatttaaattcccgcgttatcactgttttatttagccatgcctatttatctttgttatgaacttatcattgttgttattgttattattaccttgttcaccctaggataaacaaaaccccaactagtgagtactctatttatggttccactagtacgaacttaggtagatgcttcgctggttaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggttctataaggattaa

SEQ ID NO: 53123 - DNA, 656 bp, Oryza sativa
tgcttgcgaactagccgtgagcccatgagttcgatcgggcagtgtacgtgatttgtggacatgccaatcgccaccgtctcctctcctctctccgttcgcgcccccgcgaaacgcggtggtctaccgatgcgtgtttctttcctacctatattaggctcccatttgtgttcccatttgccgccttctccttcttctccgacggcgaacaccgtccatcgcgagaactcttacctcgtcggcgtcggcgtcggcgtcggcgaggaggagcaaacatttacggctggcttgcaatcttaatcgtacgtacttcttcatggcatatcttgtacagtatttattttttttaatccattaaaagcgtggttgtttttcattgtcctgtccgacgaacaaggccttaaaagttgacatgcatctcgtgaaaaggaaaaaaaaagaagcaacgttttctattgatttgttgcggccagcaacaccttttccattccgtgttctatccatgcgcggtttttctctatctgacgctcgtgacaatttcagttttgcagtgttcgtcattcaggaggctcccggccgatccggtggatcggatcggagcgggagcacaaactgcaaattgccacggtccttgcacttgatttccggagccaggagga

SEQ ID NO: 53124 - DNA, 1501 bp, Oryza sativa
aaaagatatttattttataagatatattttttaaaaagtaacataatttttgtaacatttctaaaagagatacattcaagcgggcttgtttgccctaatcgagtgaaactttcaagttgtctcgtcggacgcttggtgcctcaatcagtctgccgtgtcgcctctttctccctctctcagactttttcttctgcatctcgccgatggcacctttttccttctctgtcctcaccagcgacggctacgatgatgccctctccttcccctcccatctcgccaggaggcttatggtacttggtaccttaggttgcccgatctgatgttggccgtgttggcagatgtcagatccatgtggaaagagggatgtagagacagaggacacatctgatctggtggcagttgtgctcctaccaactcgatcagatggctactcttggggcattgattccgggggtgccaagatgcaagatcgatggattcgaagacggctatctgaactccagcgtcagccatgtaaatgtggtggcatggaagttccggcatagctgaaaacggggcacgtctgaccagcgagagggtggcggtacgtggtgtgagcccgacaagcatgtcgttcactgcaatggcaaagtccaattgatcaacaagtcttcggtagcactgcattgttcatggaagagccatttagtgcgagcaccatcacttgttcgatccagtattgcagtcactaccaccaccattgctcatgttcgatcttattgcttggctcaattcttctttcgattgttagctccttctttgatttaatcaggtgaatgcgacccatataaatgttgtttttgaaacttttttcctcgattagtttgactacaatattgtcttatttactcctaaatcatttgaaatgagaccagactcgaagatactagagttaattgtgtgggaagagttctctagatttttagtattttgtttttctaaatacttgtccagccacactcttagcctcttgggggagagaaagagggacacgtgtcaacgtataattgtgcatcatctcaatcaatcagcgagcatcaaccttgccagcttgagatataaggaattagggaagaaatgtggcaactcaattgactacatagaaaaatattatgatatatccaaatatccctagtaaatacacaaaaaaaatgtgaaactgagagagagcatatggctttgatgtatatgattcagatccatttttctcaaggtggttagaaagtggacataaagccccaaacaagagtgtttgcttttgttgactaatgttgttggatataagtcagtcatagctctcaattaggaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggcc

SEQ ID NO: 53125 - DNA, 1501 bp, Oryza sativa
gaaactcgtaaaaacttaatagagttagaaagaaaaaaaacattctacacgagccaatggcttgctttcctaaaattattctgacagaattttattttcctaacaagaacattttcatacatcagatttcatcagcataacagcacttacaggctactcaaataatcatgaacgacctaaaaccagtccccaacttttttacttcatttcaaatcaagtgccccatgctcttgcaaaacgaggaatgactgattcaattccaaaattcatacaggaagtaatcggtaacactattttgccccccacgtttatataccaaaccaggcgtacaaatctacctgccaccatagcttagagcaatgtaccgccagaatcagctcaaagccagtacaatcgagcctatcagaagtcaaaattaggatatatgcccatgaccaagtgcaacccgattgaatctaagcatgaaaattcaccactcaaatggactcacaagcttagataaaacaaaaacagatcaaccaaacaacctagctttccccgacgccatttgcagacaactcttctgcgaattacgcacaaacaaaaaacgctaatccaacccacacgcaagcaactgtctcagtccgatcctcggataacaccaccatcgattcaccccgaattcccaccgctcacatcaaacccagccccccgaccagaccaaagtcgttgcccacgcgagcctaccttctggaggcgatccaacgtgatctcgtcccgccgccgcgaccagatccccgatcccgacgccgacgccaccgccgtctccgccgccacacccggcatcacgcccctcaagcctcccgcagacgccctcaacacaacgacgagctcgcccccgatccaccgcccatccaagtggccgccgccagcgacgacgcagccggaggtgacccgccgcttcgccgcagcttggccccgggtccgatcggccgccgccggtggctagccgagtgggttttggctcagacggcgagcgagatgggaggaggggagcggagcgccgaggcgagacgaggcgaggcgaggcgaggtgtgggggtaaaaggcgaggagaaggggaggagaaggggagggatgaaatgggggagggaacgcgacgacgccgtacgctttttaaccgccacggttaggccccgcggtgcgagctgcgatgtctggaacatgggtttctagctgtttcgggatttttagcgggattttccgctgtaaaaatcagtttaaccgaggcggcggttcgctaatttggtgtcaaatgctgtcgcgtgacgttttcctcgggtggctgtctttgttttcttctttttttttattttagttttatttatttccttttgtgggatgatttctttttggtatttggtatggtgtgtgcgagtagctagtactatcttgactatatatcggagctatttttcttgtatgtttttaattaaaccgtatggttggtatgtctagttgg

SEQ ID NO: 53126 - DNA, 1501 bp, Oryza sativa
aacaaaggccggtatacccatgttttgtattacgttgaccaggaccggagaaaaagtactgttctggtggaggaaatagactgtggaacagtggaagtcctggttctcctggacaaagaagaaatgcagaggagacagaaagatcaaacggagatgttctccttgatgtgtaattcctttaacttcgacaacagtttcctttctagcaatttagattttttttttaaaaaaaagaactctagatgggctgcgagatagccctccccctacccaagctaccgccttttctttatattggttgtatctcttgaactatgtactcttcttccccctttggctaaaaaaaaaagagcatgtccgttagagagagcatcagagcaagaaagaaataacattgtcctgaaagatttttcgtacacaattgatagctgcttagcattttttaaagaacatataacgaatgacctttgcctaggagcatgcatgaaaacattatagtcgggataaatcgccacctgttattctttagaaccagaaggagatctgcgtgtcattctattaggagtcattcaatatgttacaatcgctaaaaccatatgaaaagaccgtaaaaatgcgaaccaaaagatagtaaacccacgaacttgatccgtcaccgtcaaacggtataccaaaggacgacacacaactaccaagcacgcgcaagtggatggtgaatcaagaatagaaggcgatttccatccatacaacaacatcgaccgcgcgatcaccagcaagaacggcattatccaccgtaattctgaaaagctactacagccaaaccccaaagacaaactcaccaacacccaagtgatgactaacaaaaaggagagcctaaaaagaatcacaactttcatgcaacgttgccacagccaaacctaaaaggacaaaggacagatcgaaaacgggggaaagatcagaacgcgctttacaaagaagtaatgcggggagggctgtccagcgtggtaccttcgcggaggcccttggagcgggagaagtcgacgtgggacggcctctcggggtcgacggcgtcgagcaccttcttgggcagccgcgacacgaactccccgcgcatcgacccgaccgagttgcgccgccgctccgccaggagcggcgcccgcgcgtcattctcccccttcgcctccatcgaatcacctctctcctttctctccccctccctccctcccggccgcgagtggggagcagtcgagctcgagccggcgagccgcctctctcctccgctctctctctctctctctctctcttctctccctgtctcctctccctgcgattcgcgatcgggtcgtggtttgtttgttatttttggcgttcgggcggaaggccgggtgtcgcgctaccgtggcgtgctgcggacgtgcggactgcggtgcggctgggacgccctcttaaaagggattttgtaataataagataagaaaaaggggaaaatagaaggggacta

SEQ ID NO: 53127 - DNA, 1501 bp, Oryza sativa
tgcacagcacgatgacagatggagtacttttacagcccagcacgctatctgaactagtcggacttttacagcccggagcgttcgtgggttcggcccaaccccaagtacctcccaaaacatatgggcctatttctatacgaaatttggtctagtatccgggccgtgtgcactgggcctagatctccgctgcatttccaggcccacggaagccacgcttcttctccagcggcgtctcgccgcttcccgacgcttcgggagcccggctccgcactgtcggcgtgcgcgccgcgtgccgcctcccgtcctctccggaaaactccggcgcggctttctttcttcctccgccttcttcaaggctccagtccagctgctcgctcccaccacccttcgcctccccaagcttcgtcttcgcccgcactccctcccagcaaccgccgccccggagagtcccggatttcgtggccatctccgtcgcacgatcgagtggcgaggtatctccgcacaccctgcgcttgccttgttttctttacctgcttcggtttgttccccgtcgtagtgctgtaactgtaagcccggatctgtgaacctgttgtggtcgctgaatactttctcttgatggaagcctaatgcgatgcgatgcgattgtctgctagctagtagctaggtgttactactggaaaatcccgacatttaatcctatcccgttgatgttggatgtgttgttgtcagtgctagaggttggagaaattcctgaaccccggcaaggcatgaaattggcataatcagtggaatcgaagtacgtgacctactaagtcctaagtttgtcttgtcgcagagaactcaactcattacttggttcattggtttttagcaatcttattccttggtcgatccaggatagtgtcatctagttacatgagttgagaccactatatacaactgtactgcaagacaagttacttgtttcaaatacgcgaattggttatctataattcaagctgccttcgcgggtgcatcaagtgagtccgatatgcatggatgaggacagagccagaaaaaaaaaaggaatttctttttatctgtatgtgaaatgtacaagtactgtcaggactcctgaaaaaagaaaaggaaatactgttaggattcagaaaatatcacttgaatggattgcttattttgaaatagtttcatgggtagctcctttaaatggctcgaataggtcatttctgagtcatggacatgtttggtttgctaggatttcacaccgtttcatcgagtgtcattggaattctgttttcttgcttgtttttttgccttatgtattggcttacacttttatgttacattttgcaaatgcaataaaatagtactatcataaacccttggccttaaaactactaattcaaatggcgggcatagtttggattaaccagatctttttccctttttagaacaagaagaatgttaggtacacaatactgacgctgcattgtttgcagga

SEQ ID NO: 53128 - DNA, 1501 bp, Oryza sativa
cttctgtatgagctgtgagcaggcgtgtttgaattttcttggtgtggaaaagcttgagctgcgaatgatgattgttcagagcaccagtcgcgagctaagggagcttatcattagatcttgttcgagtcatcgtcgttcgtattggggattctctgccggtgaaaggtaactacgtactactactactatcgatcaccgaaaaaaaaaggaaggaaaaaaacattgctgcccatcaaacatcggcaaaatgtttagaggttgtttggttaccaacatccctcttggggtcatagaaatggtttaaagtttcggtctctgccaacaatcaaacggttaatgagtcaagaaaagataaataactaatgttattatggggcaggcacgtgcggtgccggccgatggtgctcgcagacgccggtcgttggtgcttgcaggcggcggggatggcgattgcggcgggcgcgaaggcggctgcggtggtccctacgcagcggcggcgcggtgctcggcggcggtctccctcagatctgcgcctcttggctggatctggagggtggccggcggtggtcgtcggcgacggcggctgacttgcgacggctggtgacggcagcgacagtggtggtcgcggcagttggcggcgacggcgtcggctgacgacgcctatggaggacttggcggcgacgtggcggacgacgacagcgaagcggccgctggcagtggctggcgtcagtggcagcggtgacagcggccgatttgcggcggctgtgactgtggaggcgctggcgatgtcggcagatgcgggtcgctggtggcagcaagtggaggtgcgcggtgaggatggcgacggcgaggtggctaggcgttcaacagcagcggctgtggtggtggtggccgtaattgcggtcaccggaggcatgatggcctcagatggctagccgagggagtgggagacggctacatttggccgccgcggcatcgtttggtggagggtcggagaccggcttggcgcagagaggcgcagccgatggcagcggaggtcagctcggcgcgagaggcgcggacggcggagatggaggccggcttggccaagaggcgcgacagatggagggaggctggattggcgcgagaggcacgtccggtggagaaggccggcttggcacgagaggcgcggccggcgatggaggaggcgacctaggtgtgaggaggagttgccggtgggtgtggcgcgatcttcggcgctcgaaggctggccggcaggggacgccggtgcaggggtcccacaggtcagcagagcttctgtggtggtagggcatcggtgcgtcagtcgtggatttgcaggtggtgaacggcgggtgaaaactcagtccggccttggccggaccgacaacgatggttcattccccctcctaagggcgttgtcgtgctgtctcacccctcaagggtgtttgtcgggcgaaaacccagtcttggctcctttgagtcccgacggacggacggcggc

SEQ ID NO: 53129 - DNA, 1501 bp, Oryza sativa
atttgattcatcatcaaatgttctttaagcatgacataaatattttcatatttgcacaaatgtatagaaatactatatatagaaaatatttgaattcaaattcaaatttgaatcgaatataatttaaattcaaatttgaatcaggtatataaactttaggtctataaaatttaggtgtataaactttagatgtatagaaatactatatatgaaaaatatttgaattcaaattcaaatttgaatcggatatataaactttaggtctataaactttaggtgtataaactttagatgtatagaaatactatatataaaaaaaatatttgaattcaaattcaaatttgaatcggatatataaacttttgacttataaacttttggtctctaaactttagatgtgtaaacttgagatatataaactttaggtgcataaatttactaaaataagaaagtaatgcggtgtcaaaataggaaaccaggtggagagagaggaatggggaggcagggtggggcgaattgatcgctacccccatctccagacgagcgatcgccctttagcatttccgctgaagaattatgataccaatgcagtccgtaaaaaacagaaacagtgaccattatggttttcacacctactctgaatttgcaatgattgatcacactgtcttaatttatcagagttcaccttcagctcgatcgtctgagtttagtctgtaactagtgggtgcccgtgtgcgcgttctggccatgaaattgacgtgacaatgtgtcccacagtttttctgttttggtgcctacgtgaatggaatcgcttctacgtttcagattgcatacagaaaaatatcttatcggaagtttggacaaggtttgtttgtttgtttgttttttgaaaacaggccgggcaatttggacaagacttgatcccgtcagtttgatggagttccctatcggagtatttgtaaataaattactacctacagataggtatgttcgaacctaaaactaattaattaatgttgcccaatcattgttgctgattgttgctttggtcgaaacttaggtcatggttagttacttaaacaaaaaaaatttcacgctgttacgtcaaatgtttatgcacatacatgaagtattaaatataagaaaaaaacaaattacacagattgcgtgtaaattgtgagataaatcttttaaacctaattgcgccatggtttgacaatgtggtgctacagtaaacatttgctaatgacaaattaattaggcttaataaatttgtctcgcagtttcctagcggaatatgtaatttgttttgttattagactacatttaatacttcaaatatgtgtctatatatttgatgtgacaaccaaaccaaaaaacttttcccaactaaacaaggccttagcatgccaatagaatcttgaacacggcaatgatcacatgtactccctccatcccacaaaaagtccattcctagcatctaaggagagattagtgaaga

SEQ ID NO: 53130 - DNA, 1501 bp, Oryza sativa
tattttactgagtcggcactgttcaacactgtttctggttcaacactgtttcgggtactgtttgcacggtagcggcctgtttaggggccggttccgcacggtgaacctgcggtaccgcgcgtgtgaacggtgccaaatagtttcaaacagtatcgaaacagtgctacacagtgctaaaccacgttgaaaatcacaggctgcctcgctcccgcattttgaacctgcggaccgtcgtggccccacgaccattctgcgggaccgatgatcctgcgttttggagctgcgggatcatcgcagtcccgcgtttctatcgtgcgggacatgtatatttttacgaatccgtccgatgtatgtatataaatgtaaattattaaaaaaataagtatattaacaaatttttttcttatatatactactatattattttattattttaggatgaagataatgtatccatacatcgatgattatgcaggaaagtcacaacgcaagtgcaaattcccatgcacttttatgtcatcaaatttgcttcaagattcgcccatgtaagggtatgtacaatgcaagccacaagcaacagtggtctcaagttgccacgtagaatagaaccacataaaggtcacacaacccacagtggtaaccactccaaaacatattttgcatttcagcccctatctatttatatgtcagcccttgtgttgtatgatattatcaaacctattaaggccctgtttctttcagtttgggattattataatccagattattgggagtaagctgaaagattcagacaacttattgaagtagcttattataatctggagcccaacttattataatatgataagctcatttaggtgagctttttctagattattgggtaaaaaattacccaccatgccaccccactccctctttagacttgcaaacccaataatctaggctctaataatttaggaaagagacaactaaccgcttattctactacagattataacaatctagattatagtaatctgactcaataatctagattataataatcccaagctgaaagaaatgaggcctaaaattttatattttgaatcccatagcaaccaaaataagtacatatgcacccctaaatatcataagaacccattgtcagcctcttccaacctatttcttttttactctcccccttctctctcctgtcccccttctcatacgccaccgacgttgctcctccgatccccttctccacctccactgacgcctactccaccccgccggcgagatccctcccctctccggcgcgagctcgccagcttctcccctcccctctgcggcgcgagacggcttctcccttcccctctccgccgcgagctccccatcagcggcgctcgagctctggcggcggtggggagcagcggtagcggcggcggggagtggcggcggcggtggatctagcggtggcattgagtagcagtgtcggcggatctggcggcggcgttgagcagcg

SEQ ID NO: 53131 - DNA, 1501 bp, Oryza sativa
acaatgatcaaaccagtccatcttctcatccaaataaattctgctactgccaactccaaaaaaaaaaaaaatccaccacgatacagtgcaattgtgaattcttcttcctcatgacctgcaatacaaaataattggttgatgtgttataccgcataaggaaaataatacactaagattatttgcaaattattcaactaattatatctgctgacaagggtacaacacatctagcaagaatttctcattgccaatgtttctcttatatcatatacaattacaggaaacaccaataatttcagtaaaaccaatctagtggctagtaccattagatcacttcattgaattgtaataacaaataacatgatattcaagtgaaaacccaaaaaaatgtagccattgtacagatcaatgaaaccttaacttcgaaatcatccatcaaatgaacgaaaaatagaaatctacaaccatcagcaagtgatttaccataataagctaggagcagatgctccaaaaactcgtcgattcagagccatcccaaagcttacggtgatcatgtcgacggtagcaaattgtcggcttgaattggtttggttactggtttagggcttgaactaatgtggcacacgaagccctcgccgccgcggcgatgtaacggtttccctcgttgccgtcgtcactgccgccgccaccgtcgctacgccgccatcgccacaaccgcagccgcctctcaattaggaacacgtcaagaaagatggaaggagatatgcatacgtttgttctgtttgtcgagttaaaaaggaaatgtgattggaaaaaaaaagctatttggggttttttataaaatgagataggtctttcatataaagctgatgtggcaattttgctaaggtggaatagcaacgtggcaattttttttacatggctacttttgcaccatgagcgcactcacctagccaagttattgtaccgctatgcttgattttcaaatttttacatctaatcgcacacacctgccaagttcttgtaccgccaacgcaatttactctattatttttatgtttgaaatgaagaaatagcatgtgtccactgtaggcgtacaatatgaaaatattttgaaaatcatggcattttgcagggcattttttaaagccatgaacaatcagagatgaacatgcatgcagtcagtcacggcgagaggctgcaaaaggggtcgattttactcacattttagggctgttattttacacgggttgaagaatatcctaggaggtaaatactggggggaaaatgtcgacaaaagatcaacttagcataattatagcattggattatgctgtaaaatgtatggagaagaacgctagcttcatcggttggattcatgcttcagcaacgggagatcatctggagttcagatcagatcctctggtggtggtggagctggaacagctgctggtggtggagcccggcgtgccgtcgcagcggcggctgcaccgtcttgtgc

SEQ ID NO: 53132 - DNA, 1501 bp, Oryza sativa
cagacagttgataataagcctactgttgatgaactggatgccctaatcaggttaaagcaggctgaagcaaatatgtaccagcaacgtgccaatgatgcacgcaaagaagctgagactctgaaacacgtcaccatggttaaacatgcacaaatagaggaacattatgctactcaaataggtgaactccacataaatgagttacaagagcaacgcaaaagaaagattgaagaactgcaagtcattgaaaggacacaccatcgatttctcagcatgaaaacaaggatggaaggtagtattagggaattattgttgaagatggaagcaacaaaacaaaattttagcacatgagccaagataacagctctgggttgaagataccaggatttactcaacttgcctaatgaaggttccatgtgatgtaagttctaagacttactgcacgattatcaattttctagtattttgatatagtttatgtttctgttgttttatttaacaatctgttattgagttttgatgatgtgcaataaactttagctgttacagtatatacttcacttttatttactgatctgctgttataagtctgtgtggagttaactgtttttgtggctttagacttaacagtcaagactgaagacaatgacctatgacttattgtgcgccaatttggcactggctttgttcttttgcatacttatctttaggtgcaccgcatcacatcccttaattgaaaataaggggaaatagtgacgttttggagtttatcttgtttacaggagggcagttcttatcatcgtggcgtgccttactacatatctggacagttcttatggaagggtgctagactgcaaatctgcaactttaagcatcacaatgaagatgagcatgaatgttctcttatgagaacaggcgagtggatcataatcgttgcaaaacctgtttggtcaaatacaattctgaatccagtatggattgttgttgcaagggagaacacaaactgaagcacagtaatcaggcctgcaaggtcctcgaagcagaatttcagaacgtagctagacagcatctaaattatgaattgatgttggcaatagtataggtaggcatgaattatttctcgtatgtaaattatgataaggtttatggttctgatcttcagtgagaagatgcattaccagtttcctttttttttttatctaaattatgcagcgtttgtacgtcggccacgtacgtgcatgggaatgcgccggcatggaatgagtgtgaaatgcaatccggaaatgtgtcgccagccgctcctgctgggatcacattgctgatatacagtattgaactgtaccctcaccgtcaccgactatatgcataaaaccgtcgaatttcagagctccagaattaaaatttggcaaaaaaaggtgcagatatatggcattctgttctgcaagttacactgaggcgccaactcgtgtcaggcttgctcggagaaacataaaaggatacaact

SEQ ID NO: 53133 - DNA, 1501 bp, Oryza sativa
tgcgtagccagtttgtgaattgcatcctgagttgccatccggagtaagccaattgacttgattctgtccattgtttgaccagcatatagactatcaaaatcaggcatgagatggcgcatgacattctgaaggatatcctctccaccaacagtgcttcctgaaagtgctcttatctgagaaacacctccagcagtggcagccacagcagcatcacagtagccagcacccatgttaaatatcagagcaattttctcaatgccacttcccatattgtcatgtagcaattgctgctgctgttgggcatacaaaagtgcgatagcggtcggctctggcatgagccgtaacacatgcagcccagccatcgcacatgctctctcaatcctggtctgttgaaaccgactgaatgcaactggaatggtaagaacagcattcctcaccggatgtttgagatgcatctctaccaaggccttcaattcaaggagaaagatggcaagaacttcttcaggagtggtagaccgccacatattgttcaccagtgctgcaatgaatggtctcaccccaatacccaatgtctgcacaagaaaaggaaggctcttgctagcttgaaccacttcatctgtgtccattctcccaatcaaacgtttcatgttaaatatggcacttcctgacaaaatatctctttcctcatgtccatgttcccgggttgctcctcctgtaactcctgctgaaaggctgtcatctttgaacatcacatatgacctcatccctttctggttgcgagtgtttttgaggagttcaacctgatggccagtccaaacggcaacactacaatttgaggtcccaatgtcgattccaatagcaacatcaggaaacgacatctgcgacttatcttccccagtggtttcactgtcagatgccacagtgtataattgttcagtcatcctgcaaacaatgcagcgtcagtattgtgtacctaacattcttcttgttctaaaaagggaaaaagatctggttaatccaaactatgcccgccatttgaattagtagttttaaggccaagggtttatgatagtactattttattgcatttgcaaaatgtaacataaaagtgtaagccaatacataaggcaaaaaaacaagcaagaaaacagaattccaatgacactcgatgaaacggtgtgaaatcctagcaaaccaaacatgtccatgactcagaaatgacctattcgagccatttaaaggagctacccatgaaactatttcaaaataagcaatccattcaagtgatattttctgaatcctaacagtatttccttttcttttttcaggagtcctgacagtacttgtacatttcacatacagataaaaagaaattccttttttttttctggctctgtcctcatccatgcatatcggactcacttgatgcacccgcgaaggcagcttgaattatagataaccaattcgcgtatttgaaacaagtaacttgtcttgcagtaca

SEQ ID NO: 53134 - DNA, 561 bp, Oryza sativa
attcctgcagccctctgaattatttggctgtgtaaagcccactagtcactactactaattgtccaagctgaattattttgttgttggctctactctgctactgtaatttccaccttgaattttttttgataactctaatatgtgttatatatgaagtactctacagttataaatattcgatatttggataagatttagttaaactttgaaaattctgattatcattagtagtttcgaaaccaaacatagctgtacaaccatagcaactagtacagcaagtattttgtatgggttatgccactataatttttacggttttgaaatatatcattactattcagctatttgaatttataccattataatttcacacttatttgttactagcaaaaatgtttgtgcattgtaacgggtaaaaaaattctaatgataatatatgtttttcatgcataatcatgtcaatgacaatgtttctattttaataagcggcttgttttttataaacagtgtatttttttccttgcgcgattttctcaaaccatttttcagaaatggcgcatt

SEQ ID NO: 53135 - DNA, 1313 bp, Oryza sativa
aattcctgcagccccaacttgaaagttttggtgaaaaaaaactgtcaacgatttcttagcacatccgtttttttaagtgttgcaatccttttttttttctcgttttgttgcactggttgtgtatgagcgtttaactctctttttatttggaccagtaaataactaaatatgccatgcattgcacggccaacactattgggagtgggttagtcgtaaatttgtcatatatcctaaaagcacatgatctttctgaactaaccgtttcttttttttctatttttctccatcaatattttttctttctatttttctccattaatattttttctttaactaatcgtttctatttgagctggggctaagtcttcggactgagatcctctattttaagtcaagtaactttaaagtcactgacatgtacatggatccatagcaaagaaagtccatatcttaagctcagttcgtttcccatggttcccaactcccttctcatttttcgcgtgcacgcttttcaaactactattttggtgtgtttttttgcaaaaagtttctatacgaaagttgtttaaaaaaattatattgttccatttttgaaaaaaaaatgagctaatacttaattaatcacgtgctaatagattgctccgttttccgtgcggaggagtttggttcccaaccatcctaagcgaacacagccttaagtgacttaaagtcagaggatctcgatcccaagtccctctatcttgctagatcaccatagagaataagaaaagaaaggggaggaagaagaccgaagagaatcagagcaaaccctccaaattcaaagttagatctacccctggatatacgttatgggaggaaagaagtacgactccgtttttacagagaatgttatgtttgtgccttataacgagtcagatccatataataatgggttaaatagatccataccattacaaattatttggtttggaaatatgccattactattcacatatttagaaccataccattataatttttagctatttaaaatatgccactacatacccatctgatgcatccaataaacattttagaccaaattacccttttctttttctactgtccatcttcttcctctcctttctttctttttggatttggatctgatactggcagcttatctttctcctcctcatctactcacccattttcgcttgaacctaagcaaggccactcatgtactctcgcacccaaaggaaggtccagcaacgacatcgagccatcatcaacaacttccctgtttatttttttctcgtttttgtttctctaga

SEQ ID NO: 53136 - DNA, 178 bp, Oryza sativa
taaagaatttaaattttagaaattatttatactaaacacaatcgaggtgccaaggttagatggttaaatacaaattgaggttttatattttttaaaaaacaattttgtggtacgcataaattagcttgcatatccagaaaaataaacggcaagcagaatcaccagaaacagaaacaaa

SEQ ID NO: 53137 - DNA, 1501 bp, Oryza sativa
gcaaatttaaccaacaagatgattggaaggagaatataagcaataattcaaaattcaaaattttatcactaggacatgtcgaaagggaatctttttttataatatctttaatatttgctaaacaacctgaaatatgttatttagaaacagagggagtactaccaactatgaataccatggaggtaaagccccagctgaattataaacacctgcagcctgcagacatatgggacccatatataaacgaccggcgtttgagcccccacgcaccctactgaatgtccttgcagcagtacacaccagtagtgcgatagagcattgttttgtttgcagctgcaatatgcatataagcatatgcccctgactctgaccctgagctagctgaatgtgcgctgtaaaattttgttttcttcggtgtgatggagtacatcgatcgccatcagtagcatcaccatctgcagatcgcttgaggaatattgggatggaagaaggaccacccatgcacctgcgcccgtggccggccaagcagctgcatgctctgctggtggccagtgtcaaaatcgcctaccacagcagcagcagcaaatcgtatggatcgtaatggaatctaggcacagtcattttccctctcggcactgtttggctttaatttggaccaaccctggctgaatgcgagccgcgcgcacgtgtggctgttagtgttaggtagtgctggtttggagctcagctagctagggttcttcaacttcgcttgcatgcagttcgatcgtcggcaggccccaattgattctcgacgtctagagagttttctatagagtgtaaagtgctgaatggttaattatgacagttattcgagagtatagaaacgaataagttatatattagaaaaatatgaaaagtggatttaaaaagagttttcgaagtaatgttgctgaagaatgtttttgcaatagatcgtgcccttcagaaatttagaaagtatgccatatataatccatagtataacatacataaccttagtcttcgtagaagctcaaaatttcataaaccttaagttttttattattatttaaaagggaacactacacattaattatatcaatccattatatcacccaagagggattttatcaaaaggtgccaagagttatcatgacttagggcctgtttggcacagctccagctccagctccaactccacctctaaaatgacttatatcactcaagagagattttactctaaaatgtttgggaccttttggtacctctcaacgatcataaaaactagaatgcatgatactgtacaagcttatattcacatagacagtattaattgtttggttaattttgctacaagacatcacgacttcgtgtttttagctgtaggacaccgtgcaaagtgacttttaggggaagacactctcaaaagttggatatttgctggtggacaccgcgctcattaaaataataatttccggttgaagaggagagagaaatcaca

SEQ ID NO: 53138 - DNA, 984 bp, Oryza sativa
caaaattttaaattatttttaaaatttatttgaatataaggaggttaccgtggtttttcttttaccgtaccctttcagtaagcgcggtaaccatgcggttaccaatggtttgggaaacaggatgaattttctagctggttaatttgatattgatttgtcttcgaaagtgatatgtgtttaacttgaaatccattttagaaatttgattctgtttgagatgaaaggagttttgagcaccactgtaccatggcacaatttctgtaactgaaactctgccggcagaggtcattacattcaaggtctaattatctatcggtaaaggcttcccccgaccattgtccgacagaacttgtggggtcatggtgtcatgtagtactcctcatggttagggcatgcagcttgaaataagtgctaagtacggtcgatcgatcgattaatgcagttgcataaatcaggacatacacatccacgaaggctctacatattgagtgttatgtttggtgtacacaaaaatgtcattgtaccgtggaaactgtattacgataaaaccttttcttttaaaaaaattcataacatacagacagggcacatgggtactgttcttttgttttaccgtaaggttatagttttcagataaagtgatacttatctaaagttatagcaaattagtatcctatggtttgaaggctatctcatgtttacttaattatatggacgaggcgtggttgttacaataaaatgaccaaatctctcttcgtaatcgatatactataccttgaacgtaaatctaatttgtttactttggacatacaatataatattgcaaatcatgaaagggtctgtagcctagtagttacaggaggttccgtagcacctgaggtcctgggttcgactccctataggagcgaatttttcaggatttaacggcgttgcgctttcaatgatttttcaggattttaatggcgttgcgctttcaatggtagg

SEQ ID NO: 53139 - DNA, 1501 bp, Oryza sativa
gtcccggttggtaatctttagtcccggttcaaatgctgtcagggcttgtcaggcccccctggatctttagtcccggttcataacaccaaccgggactaaagtccaacccctatatatatgtcttcttccttctccagcccgagcaagcttcaaaatttcttcaaaaaagaggggaggtcatgccaaaatttctagtaaatttattatggtgattatatacaaatcggaggtgcctaaaaggttagtaacttcatcctccaatgtttttttgtcatattacatttggagctatgttttgcacacttttttgtctccaaaattttgttgtaagttgatgatagagaaaatttgtgtggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataataattatttggtgtaatatttcataatttttgtatgaataatgatatgtcattattgtatgactgttgaaagagtttgtaattattttataattattatatgactgtcattattgtacgaataattatttgtgtacaattttttttcatttcatgtagatggatcgacaatggatgtacgctgaccggcggtccacagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataattgttggacatcacacggagagcaaggtgttgaaatggaagaatatgaagtggaagacgacaatattccggactttgctctatacgctggatttgaaggaaatcaaacgggcgaggaggaaagagatgctcatggtaacgacgttgcggatgatcttggtcagatgttgcaggacgccaaggaggaatgcgaaagtgaaaagggggcccataaattggacaagatgttagaggaccacacaacgtcgttgtacccaggttgcgagtaggggcacaaaaagttggataccactctggagttcttgcagtggaaggcaaaaaatagtgttagtgacaaggcatttgacgatttattgaaactcgtcaagaacattcttccggagggaaacaaattgcccgagacaacgtacgaggctaagaagatagtctgccctctaggactggaagttcaaaagattcacgcatgtctgaatgattgtatcctatatcgcggtgaggagtacgagaacctagaagcatgccctgtttgcaaagcactacgatacaagattagacgagatgatccaggagaagttgacgggcagctaacgaagaagagaattcctgctatgg

SEQ ID NO: 53140 - DNA, 1501 bp, Oryza sativa
tcttccctattttgtttccctgtcttgttcagttagatagatttgtaataagatagcaataattgagatgattctaaatcttttaaaatttctacttttcagaatatatcctggagcactctactttgaccagaggataaaactaaggttgatcgtttggcatgaaaaccatctattgaccctcatatgctaatataagtgggatacccctacttcaaataaaagagagagagagagagagaaataaaagaaaccattgttctttgactgcaaatttctttaacaagccatatgaacgtgcaatatatcgacatatagaataataatatttccacaaccattcatatataatctaaaagtatttctaatagaggcatcgatccatacaaggaaataaggaagccactctagcattgcaggaaacaacttacatatatgcgcgatcaactctaagagaaagccatgcaaaaagattgatatagaccactatttttgctattcatgatttaagcaattcaattatattggtcacaaccaatttgaacggctaaataagtcaacacttacacaatgcattatgtggaccccacttaactaagacgtcagatatgccataaataataaatatacaatagctaacggctataaaattttcaattgtaaaggcgcgtcaatcatatttggcacacttaactttttaaaagctagcgttacaagttaggttttaaccatgccgtcgtatagtagtatttatacgctttgttcaaaacacaacggtaatatgtattattagctactaccttacaaacataaatatagtctcaactatccttatatgacataaataccaacgtttttttttcataaatttttcaacgacttacaatactggaagtgttatactccactattcaatggacaccataggccgccgcagcaacccaggtcattttctagctccctgggactgtatacatgtatgtaggacccatgaattggtgaaaataaggatacgaatcatatgagagccctgaaaacatgaacccaaacaagggaataactatatatgatgatgatgatgatgatcaaataaaagcacaaaagggttgtggttctttaaataaaaccgaacgcaccaacacgggccgttattcgctagggaacgaatcgctagtcgccgaggcgaggcggaagaatacgagcaaaagtcgacgaccaaaccatgggggccagcgcgcgcccaaacgtccgtttcccgtttcgccgtcagcgcgactcggcgagcgagagagcgagcgagcgcctgtgcgcctgtgtggcttgaacggcacacccccgcccgcccacgcttataatactgtcgcttacgcctttattttttcttctctccttcatctgttcgtcctctcctctctcctctctctcgccctctccacactggcacactctctgtgaatctctccttctgttcctggttaattcgctcttcttcctctcgtat

SEQ ID NO: 53141 - DNA, 1501 bp, Oryza sativa
tcgttataaaaaaacaaattattgccgaaatatacgaaggtgattccgcgtgtgatggacgatgaaaaaaaaactttacccgaagacttacttttttttttgttcttcacgtgggttctatttagttagaaataaattaaaacgcacatgtaaaatttacagcaattttatatcttaaaatgatggttcaaagtgattaatttttttatgtaaacatttaatgatttttgggcgaaaaaataagggccaaaacaacgtgcgccggcccgacccgttaggcaaggaggtcctatagacacattacacgagggagcgaaagtagacttattacaggagaggccggagtgaagattttccacattaaccaagcaagcaaattaccacttgtgttatgtgattacatggaagatacatatactatatcaactgcggttttgcaatacaatgaaaaccgaccgacccgactcggattaaaacagattttagtggcgcgtgggatgacggacgaagaaatatcggaatccttacgtatttttttattaggtatagatatagatttcattgaaaaaaaaatatgttggacctacgagaaaatgcgggaatctattaccagaagctgcatgtccatagatcctcgagtatgatttggcagcccttcagaaacgcaagcttcgaatcagcagcgatcgagttgtaaacgagaagagtgcttcgaaaaaaagagcaaatcacatcgaaacgcaatcagaagacgagaaaacagatctgttcttcgaagcgcaaacgagaaaagaaacagattcagattggatctttgatggaagggaaggaacagggagggagccaaggctgcgggatccggcggcgcgcgaggatatggaggagacgcagaggcgctgggttttataggcctcgattaccacgattagggtggaggccggtatctatgggccgcacatagctgtggcattacaccgttccggcccaaactatatgggcctcttgtaagtggctatccctttcggcccaaccaatgcaagtccgcgcgttcgtcgcgatcgaaggaagcggaaagccgcaaaaatccatgaatcgatcaacgattcagaacaaaggaaacgagtgaagcagttggctcagaagaagattttgattgtggtcagcgcacaaacactgacaccttctgcaaatacaacctagtaccaatttccttttccaggcaacgtaccacccaataccaagttcccagacaacatcttagagcaacagatgaacacaggcacatcatcttgttcgttctcaatgatcaccacccacccataacaccgaggccaatcccactcgacaccaaaaaaagaatccccccatgaattcctacggactctgctgccttgcctactaaactaaccactctcgtctcactgcctacaacaggaggacgacgctcaacagcagcgccgcgacgacggcgcggacgaacgacgagacgtccccgatcgcc

SEQ ID NO: 53142 - DNA, 1501 bp, Oryza sativa
cacggtgtacggcagcgccaggaacccgtctccgtgacactcgagagggtgccgcctcacgcagcctccggcggcgttctccagcctccactcctccgacgaccgcggctcgaagccggcggggcaccggcactccgggttggtggcgttgctgcagactccaaagggcccgcacgagccgtacacgtcgcacgcgtcgtggggcaacgagcagaagaggatccacttccccgccgtctcgctccactgccgccgccgcatctgcccgttcacgtccagcatgaagttgccgacggcgcccggcagccggtcgcggtagctgaagaagttgacgctggcgttcggcgcgtaggggacgccggtgaagtagccggaccgcatctccggcacgttcgcgaagatctcgccgtcccagaggccggtcgtccagtaccggtgctcgccgccggcgaggaggtcgaacttggccagcccgcgcgcgtcgatcaccatggagaacgcgccgggcgccgggttctcggagtccgtccacgacgtgaggaagctgtggacgccgcggcccctgtcgtagccgagcctggctccggggagccatgtgtcggtcgggtgatcaaagctctgccacgccacgtgcgtcgtcgtagtcgacgacggcgatcgcgaccgcgaccgcgtcgcgttgctgttcaccacgaggttgccgtcgtcctggagcgtggcgacggtggtgcgcgggggcgacggcgaggaagacgcggacgcgttcgacgaccacagcaaggtgttcgacggcgccgtcgagaacagccgcagatcgccgtggacgctcagctcgaggtggcagctcgacggctcaagaatcgggcgctcacggttggcaacccaaacaaccgtcttcttggagatcttcttgtaccagatgccaaggtagtgcttgttggactttcccggcgagaagaggccgagctcgaagttgccgccattggagaccagcgtctggttccacagcagagactggcctagcgtgagggtgtcaatggcggccgtggggagatgtaggttgaagaagagcagcaggaggacgccgacgaggagcatggtggcgagtgccgagtggcaaccacaattcttacttacttagcgaagagtgattaacttgtttgttggcctcctatatagtactcataggtatctgtcatggcattgattgaagggccaagctttgtttggccatcatgaatccacaagttatgtattagccgtcagccggtcatggcatgatgcagcattggcttcttcaacgatgtttacgtgccaatggactacttttttacagtttatttggattttagacgatatacaaaccgcgacttgtatccaatcagtgtgacaataagtttttggtggcagtaagtttcagcgtgacaataatgtctgtttcaagtttttcggaagtgctagtcaacaagatttctcagattttaaagaagacgaactttta

SEQ ID NO: 53143 - DNA, 315 bp, Oryza sativa
tttatggtttagttatgctaattttttttacattttagagccccattgtgcgtttcgcacgtgttaggaagcgcattcacggagtgtgttgaagtattgcgtaacatgatggcaaattgacttttgcagtccctagacttagcataaacggtaccctgtaatgtttgcggtcggcaatgttaaacatgtaatatgcatatgtgatgtacatgggcatggttagatggacagatgcgaatagatagagcttgttgtaatagaatagtatcatatctatccatccacctgcaccccttatcttgtaacccacggcga

SEQ ID NO: 53144 - DNA, 241 bp, Oryza sativa
ctcttaaccgcgtctaattttccacaattaactagtagtatatctttgcaaaggtttggtttgtttagccttttactttccctgtgagcaaaacactgttcttttttgcttaaaaggaaacttttttttattgcgactttcggtttatgttgttgattatacttagttctgtatttaaatggcagctgggagaaggtccaacttaaattgcttgagaattgtatccatccaagtttggaaa

SEQ ID NO: 53145 - DNA, 226 bp, Oryza sativa
actctagccttagtatcccgcatgatatctgaccaccacggacatcgtcttaccaccaagccgactcctggtccatcaccgcaaatactctctcgaggcatcgagtcacctacacatgaaacaaacaaagaaaccatattccgagaccaagctatctccaacttgactcattgttagcaaacaacagtattacatacgtatagtatccatctagaagccataacca

SEQ ID NO: 53146 - DNA, 1501 bp, Oryza sativa
tcacatgattatattttgataaaaaatcacaaattacttttatgatatgtctaaattacttttaggtttcactaagttacttcttagacatataaaagtaaattcagtaaagcctaaaagtaatttacatatattatagaagtaacttagaacgaatcgaaggtaactttgacatgccatttgaagtaaatctgtcgtagagataaaaacatgactcaatctagaaattaaattaatcagcacaaattatggaattaacttaaaaaataataaaagtaatcacctcagagcattatgaatgtataggaagtattttaatccaatctaaaagcaacttatatatatatatatatatatatatatatatatatatatatatataagataattttttcaatgaaaaaaggcattaattaaagttactttcctttttattataagttacttctataatatatgttacttacttttaggctttactgaatttacttttatatgtctaagaagtaacttagtgaaatctaaaagtaatttgtgatttttcatcaaaatatactcatgtgagatcttgttgtaaagatttaattattacaaacacaacggtgcaatcgaattgtaaatcggatgagtaatttaagagaaaattttatttgaagcatagatgataggaatatttcccctacttgctcaatgaattaatatcaaccaaaactcctgaagtactagcacgtgggtgtctctggatatgactaattggagaggcgcctccaattagatttaccaatatacaaaattttaattcacggtcttatgagatagagggagtagaagtaaatagaagaatgtctttacttagatggaacaataatattaacaatttccattctacaatcaaccatgaaaaccattttcattccacaatcaacatgagtacggtaactatccgtggccattggctagccccctgaatcaccattgatcatagatccattctcactcagttacccttttcttttcctcactaattaattaaccttatcggctcaaccaaattgatattggaaagaaacacatatgtgggggaaagactatttagaaagaacttatgtaataaccatctgatagccctcaaaatttggcgctttatcacactactacaaaaaagcccataaagatcggcactataggtgctggaacagttaaaacatgcacctatagtgattttaccgcgtccattggttgaaaacacataaaaccggcacctttaagcaactataggtgtgtcggttctaaagaaaaaccgacacgtagagtataggtgccggttttttataaaaaaccgacatctatccaaaccgagccgagccgacacctagccaaactggcgacgcattagccttgtcgatccccctatatgagtgagctggccttatcccctctcctatctctctcgtctgtctctctcttgcctccctctctcccggctctctcacatctcagc

SEQ ID NO: 53147 - DNA, 1501 bp, Oryza sativa
gtggtcttttgcagtagatagtatagcagataaatagataaatatcattatcccagtatcaatcaagtgatcaacgaatcctgcgaccatttctgacgaaatgatttctggtaggatttctgactaaatgatttttgctaggatcagcgttgctcccagtcgtcaactggtgcaatgcgctgtgcgcatcaccgcagaaatatcccggtgagatacaaaagaaatcaacgacttgctcaaagtaaaaccaaagcgaatgacaggacaaacaaattgacagcgctcaccattgtcaagtgccaacgacgcgcagctgccaacaaaccttcattaactagggggtggccactccctctgctttcctacgtactccagcgacgagttctgttcaggccgccggttgctttcatccgaggacactagggccgagcagcagagtaactggagtactggacaatctatgcgatgacacttcagtagttcacagcatccaaaatctggcaaactgccctactaattatggtcccataaacctccaataccagcgaaattgcaataacgatcatggtccaagaactagcggctaccggtcggagatgggaccttagctagttattgcccgtaaagatataaatttatttaaaacatttaaaacttagatttaaatttagaaatttatgatataatcttttgattccattctgaaccgtgcgagcaattaaaaaaatgttcgattttgacccggacccatggtgcggtgcaatacaacatcgctcttgcagtttgattgctgctctcgttggttaattaacgtgggggcatatccatccatttctaagggataaagcctcgatgcgtaaccaagaaattactaactttcataaatgcgggctatgcatatgcctatatatcgggggtgctgcatcgctactgaacgggcttcacagcgacatgagaccaactagtgatagacctaaagctaaagcgatgataaagacggatggcttcctgctgaagcaggcagatcaaagaaaatttcagacctgattcacatcaacacgcgagagagaaaggatggaaatgagcatcaggtctttatatagagataaaagttcgtcttctttaaaatctgagaaatcttgttgactagcacttccgaaaaacttgaaacagacattattgtcacgctgaaacttactgccaccaaaaacttattgtcacactgattggatacaagtcgcggtttgtatatcgtctaaaatccaaataaactgtaaaaaagtagtccattggcacgtaaacatcgttgaagaagccaatgctgcatcatgccatgaccggctgacggctaatacataacttgtggattcatgatggccaaacaaagcttggcccttcaatcaatgccatgacagatacctatgagtactatataggaggccaacaaacaagttaatcactcttcgctaagtaagtaagaattgtggttgccactcggcac

SEQ ID NO: 53148 - DNA, 1501 bp, Oryza sativa
caggtcccgtatagttttgagttaagtctgctaacttatcataaagacatgtagatcccctaaaagaaacatagaaaaatagacaaatagaaaaaatagaaaaaaaattccattgccgggatttgaacccgggtcgcctgggtgaaagccaggtatcctaaccggactagacgacaatggacaagtgacatatgtgtacagtgcaatttatttgttctgcactatacgacaatggattggtctaaattttccagtatttctatataaaatttactttaaaatatcaaataaatatatttctcaaatttgcaataattaaaaccaattaatcatgccctaatggtttactcgttttgcatgcccttactttacatcttcatccgtctcaaacaccaccagcaaccgttataatgtgttagttcagctgacacacaacacacttggtaaaatgcactctaaccgatgaaactggttttggaagtttaccacagattataccatattttgaaattgatgaaaaaaaaacatactatctatctataactccgccgattgaaataccatgctatgtgtgtggagccacctcttgagctaattagacagttgttcgggttctatcaatggcatctccattacaattacaaagccgaacactcaaatgtatgaaactagtgagtaacccgcgcgttaccgcgacacttttatatgataaaagaaaactttagacgcaacatatatctagccagttgtatacctacattagcactattgtaaatttatccattacttcaagcgtcgggtacacttgattgttgtgatttaaatacaccttgtaactattaaaaaaattacaaaaattcaataataaatagaaagattggagttacgcattttctgatgcttgcttcaactgagtcaggtcgttggaaaggaagattgacttaattgtgctgacatgcatcattccgatgcatacaaagatataggcctgctatgaaatagcaagtaaattttagttagtacccgagaataaacttcaagaatcattgctgtatgaatgaatatcatagaaaaatagtggtcgtatagggagcttagttgctcattgccataaagcaacatcaacaggatcaatgtccatataagcagtagaaaaagggaagaacttcagatcatcacggtgagcgaaaacagataaacaaagaacacatgagaaagaaagaaaatactaacgtgaatatttataagtaaaacaaaaataataatttaaattgtaggccgaggaaaggaacacaccacaaaccttgaaggaatgactgtagcatagcattgacagcataagacatcaagaaaaccatcagtaatttgaagagatcacagccattgcatccactggtttcacaaagaatctgttatgatcctatacgatggctaagacatgccattgtggagaggcatataaatagtgaggtgaaagggtaggtgaaaggaaaggagtcaa

SEQ ID NO: 53149 - DNA, 1501 bp, Oryza sativa
tatttgcattactttcttagggttttctcttgatttgcacctgcattttcttggggtcgtttataaattaaattttggctagggagaaaaacttcggggtgtgacagagtgccaccactcgggacggcgtgtccgtgaacttcgacacgccgcagttcgtcagcgatggcggggaggaccaccttcgtgttggagcgaggcggtgcagcgaggctactcctgtgtcggccagggtccgagctagccgagccgctgccgacggtggaggggacctgttccatgacctccctaggcggccgcagggcgtctgggcgcgccacgccaccaccccgtctccaagccggcccgccgccatccccctctacgccgggccgacgtcctaagaaatgcatgggaaaaaatgtcagattaaccctgaataaagtaatcgaaaaatggatttatcctaaagtttcaggatatgtctgccaaagattttacccacccaatagtaaaatccagcaaataaagcaaaaacggctcccatagaaagtcgctccgcttgaggccaggccgatgccgcgcatcaggacctccagccaccactccgcctcgaggccacggtgtcgcttcgccttgggggagaggaaagggaagagaaagagagagaaggatggagcaggtgataagaagtgaggagaaggactgtcgcgcacaggcacatgagcatctgtcaccggccgagttcccgcggcggggagacgggcagcgacgatgtccttgcaagtatccatgaatgacgacaatttgtggcgtcattcggaggcaggagaaaaagaggggaaaaagagaaagaaagagagaaggaaaatgtgacattgacatgtgggtcccacacgctgagtcagccaattggaccaagtcaaagcgccacataagcaaaactggcatccaaaaccgtcgagggagttaaattataccggttttaatagttagaggagtcattttacctggttttctagttaaggggtatgaattagattcagcatacttttaagggagtcaaagtggcctttttcctaccttcaaaattcccaaaagggtcgaggttggtgctggacagtttgggccaaaaggccgtgtcccttccatcaggcagggctggcccaacacctggcaagtggcaaccccaacaaaccggcctccacagtctggagtctcgagtctcgactcgaccgagggacccaagtgcaaaaagggcgcgagcaaagagagctcctccccgtcccgtccgtcccgagctcccccaccacggccaggccacccccaccaccaccaccgcacggccaggccaccgtttcgtaggatccggagcgcgacaagggggaaaagcttccctccacgcaccaccccacggccctcaaaaacctaccaccccacgctccccggttcggtggttgccgccgcctgccacagcgtcgcatgcctcgctccctcgccggcgacctcaccgatccggaga

SEQ ID NO: 53150 - DNA, 1501 bp, Oryza sativa
tcacaagctcatcataggaaacatcatcacaatcatcatcactctcactatcactaagagatgttaccttagaggggctctttgccatgagacaaagtggagcgaagagtgatggtgcctccttgatggcaacaacggccatcttcttcttcttggagcttgcatcatcaccaccttcttcctcggacccggatgaggcagagctctcctcatttgagtctcattccccgatgaaggcctcaatcttcttctttttcttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctattggagttggagccccttcctctctcctttctccttcccaagagatcattgaaccttctagcaagaaggacaatctcttcctccaagtccttattgacttcattcaccttgctcttgctcttgtcttcaacttcggcttggagagcaatgcacttcttggaaggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagagccctaagcatcttttgggcaacctcaagattggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtactctcatggatctccgccaacttgttccaaatctcatatgcggtctcaaggttgctcactctatcgaactcctcttggctcaaagagttgaacaagacattcatggcttgggcattgagtttgaggttgcggtgatcaatctccgtcaagggtgtgccggtgatagcaaagcctacatccacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagctttgataccacttgtaggattgagatgtcgactagaggggagggtgaataggcgatttaaaactaaataacacctaatcaaaactaacctaagttgctaggcttggtgagggtgaactctaactaagcaactaagttatgttttgcaaacctagggtgatagtggctcaattatatctctaggaaagtaaatcacactcctatgtcaaagttttgcaatcctagggtgaaatgatctcaagtatgtctctaga

SEQ ID NO: 53151 - DNA, 1501 bp, Oryza sativa
gccgcggcggacttctccctcggcgccgccatctctcgccgccgatctcacaaaccctcactttttgcaattaaccccctcgaactattctaaattataaactagggctcacttccactgacatgcggggcccacgcttttcccagtccccaagaaatatctgtcgttgacaagtcaacgcccagatccaacggcggagaccaccgccgccccgttccgatcggacggctgagatcgctcctcgagccctatatacggctccacgggcgcatctttttccttcccccctcgccgccgccttctccatcgtaaaccctcgtcaggtgagacgcttaaaccctagctcgcgaattccccatctaatttcgttgaaattttcttcgattgatttgattaattaatatatatcccgcgtggggtggtggtggtgcggggttcttcgcgcgtcggtgtgatccagcgatttggtgcgaatctgtcccccattcttttggggggctttttggtggctgggtgggtggatgcgtttgtttagttggttggcggtgtgcggggtgcgttagggttcgtggagatctccgtggttcgtaagatagacgatctattagtgttgcgctgttgttgctcggctcgtggggtttatggtttttttggctggagggatggagggggcttgaatggtggaggagggtgagtagatgtcaccatggggttggtgatgaatggaagtttttgggtcggtatttgagggcctgcagattctcatatgttgcgaggtttgatctttgagtaagttttgttaaaaaaaaatcacatgttttatggttgaagttgcagaaaacccttagtattctgatggcctgtagcatgtttgcttgatttatcatgttacaaagtgtccatgaaatagtattgaatatcaaaccttgtgttagttgatattctttcagatattctattattagatataagatttgaacaaggatgaattctgtgaatctttgaaaccgtaaaactgggcactatgtgccataaagtcaactatcttaaatcttccttttttttggcctccaatagtgaatatcttaggctttttcctttttaaatgtggatttcagcatgtaactgatgttattattttagtaacgttgagatagtccagcttgggatgttcctattgagatttccacttgcaagtggtgcaatttttaaaaccattccatcgttcttgagatatgagatggaatgatattgaagttaattgctatatgagatgtctgatttagttgttagatgtatggcattgctttcttctgtaaattggtgtctgcacaatcccatcgagctcggattctaatcaaccactctgtttttgtgtttcttcttgctgttattgtttcttcctgtgacactacaaggacttgctccagctgtattgtgttatttagatggctatatttatgtcttcctttgtttcaccactgcatgtagtttggaacaa

SEQ ID NO: 53152 - DNA, 1501 bp, Oryza sativa
accaccgccatagccaccaccaccactgtagccaccaccaccatagccgccaccgccgccgccatagccaccgcctccatagccaccacccccactacggaagccaccagttctctcattggcagtgttaaccctgatgttacgcccatcgagatcctgaaaccagccaggaagaaaataagctgctggataagattgaacaaaaatgactttggtttaatggaactgttgcatattttttttaactagaaaaccagaggtaaataatcaaagcatcaacaccataatgcatagtaaaataacaaataagaagctcaatcagaacctttgaaatggaacatctccaatttctgtaacaaggaatctagagtaggaatattcatttaagcgatcgtgttgcatacaagctgatcaggcagcatgaaatttgacattctacaaaccatatcttttgcaaaagtatggaaacatggcagtgttgaaaatccacttaaattggtttgcagtggtaaaatccattagagtaatagaaattaagggctccaaaactttagaagcattctaagtgaatttaaccagcataaatcattacaccttaagtttgacagaatacctattaagtctggataaacatatagatgatggggtaaaaaattaaattaaacctaatctgaccctcaccatacagggaccaactcttagaatcctggaacataaacatgatgcccgctaaaattaattccctataagattacctttccatccaaggctgtgattgcagctgaagcctcttcacttgatgcgtaagttatgaagccaaaacctctagacctcccagtttcacggtcattgatgatcttagctggacagaacaaaagtagaccccgttaacaaaacaaaggaccaacaggagtgcagttacaaaaataaggataagataccttcaataacttgaccataattggcaaaagtatctctgaggctctgctcatctgtgccgtacgaaaggcctacaccaataatttgtagccatcagaaaagaacagtacagagagaataattgttttctgaacaaatgatcaaacagataaaatatagtatttgcaaacctccaacaaaaagctttgaggatgacatgcatctgattgattgatagagagctggacttgagctcgtggctctcttgagcagattaccaatcttattagccaacgccattgttccaaactacatgcagtggtgaaacaaaggaagacataaatatagccatctaaataacacaatacagctggagcaagtccttgtagtgtcacaggaagaaacaataacagcaagaagaaacacaaaaacagagtggttgattagaatccgagctcgatgggattgtgcagacaccaatttacagaagaaagcaatgccatacatctaacaactaaatcagacatctcatatagcaattaacttcaatatcattccatctcatatctcaagaacgatggaa

SEQ ID NO: 53153 - DNA, 1501 bp, Oryza sativa
cgagaggggactgcccgttgcccgctggggacgggggtgaaacctgaggtgtggtgtgcttggctagagggggttatgcgaagggtcctgtcacggcctctttccgatatgtcgtggtggcatgtcggcgcacgaaaacgtgtcgcggggctgtgtcttgtgggtacagttgtacacctctgatcagagtaaaactattcgaatagccgtgcccgcggttatgggcggtcaaccagattcaccgtgattagtatcaccctagtgtaatcttttgaatttggttagtttaggtggatggttgggcctgtcgcaacgtgggatagcgttggatagtggatgtttaattaattattacaacggtttaatctttcaacttctgtttataaatgctcgctttatgcaaatgaaccgctctagctcttctttgataattccgtgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggctggtcctggacggggaatttaatgcacattctgcttgaaattctattcgggaatttctgggcgtgacacgctcggcgtactccaccaatggcagtggcacgggcgcagccgcacagagaagacgcccacgtgctcctctcgccgtcagtcaccgcccactcccagcgccctgaagaaaaagaggtagaaaaagagggggaaaagataaaagaaagagagttgaggaaaatgtgacattggcatgtgggtcccacatgctgagttagccaattggaccaagtcaaagcgccacatcagcaaaaccggcatccaaaaccgccgagggagttaaattatactggttttaatagttaggggagtcgttttacctggttttctggataaggggtataaattagattcgagatacttttaagggggtcaaagtagactttttccttgtgttaacagtgaaatttggtaagcccggagtaatcatcggcttagagtcagcatcgacttcgaagtcctgagattagccgatgagacttatcacgtcgtcagttgccggattcttgctatattcggttaaggaaattgatctactaaaggaagcttatccagaagagaccgagttcaaagagaatgcgacatagcaagttatctattaattaggaataatttgttagtttccttttatctttaggaaagtgtgtttaatgtcctataaggactttatcttttccttttatttgtagtttcattcttgtccgacaaggactagtatctccctatg

SEQ ID NO: 53154 - DNA, 1501 bp, Oryza sativa
aataatgggttatagctctttgcgcaaagaccggaatgatattccattatctaaattgtaaaaattaacttgttgtgcgacggaggaagcattagaatttcgcacaaacacagggacctcaccgcaaaaacgcaccttcctaaataatggcggccgccgaccgaatcgcagcagcgagcagcgatcccactcctcctcctcctccccttgttcgtcgtctccgcggaatcgatcgcgccgcgcgcccacgcccttcctccctcccggatccggcgcgtaaggtgcgtgcccttcccgaatccgcgtccccaccccgcgggccgtttcgagccccccgattcggtggagatttcgcggaaatccttgtgaatcttggggattctggtgatgcgatgatgatgatgatgatgttagaggtctaggacggtttgcgggattgagcgaatgcgcggtggattggattggattagggtgttaagaggcttttggccaaattttgtgcccgcctcactgtgatgcaaatcttagctccgtggtttgatggtttttgggtttgatccgtttgatgctttgattttactattttaatgttgtggaatgcagattaggtgcagaaattcgctgtgttcttttttttttcatttctgatgagttgtgtgcagggaagatgctagttatagcaaacggacggaatgatttggattatcggtgcaaatcattgcgcatgtttggatcacgcacggaatctttgttgtgacactatcttgcgctcgctttgttccaaacgcagcgctattattggagaattttatagtgtgatgtttcctaataccatctgtgaccgtgactataatcaaatggttgttgaggtggatacgtcggcaggctgtacctaactaagttgatctgcataattggaatgttcttgatattatcaacacaactacatcgagatacataaaaaagaggaaaatgccatacaagttctgtatagatattcattaatctgtttagataattagttcattttgtaagaaaaaagaaactgagcgtaaggaagtggttgctaaatttacggtttccatttttacacgttaggtatgccatgtattatgacctatgcaatttcccatttatgtttgagatagtgtattgatagtcaaatgctctaaagcctctaacatgtcgtggtgcttgaccacttacacgccacattgttgttatgctgtccaataagatgttcatgcattccaacctgtgagcctaggaaacggacaaattagatgacgacaactgaatttcttcttttctttagggtttgtacaggcaaacaaacttagcaccaattatattcaccttttgtcttaaatgtctgctattttctaaagttttgcagttggccttatgtatgtttgagatttaattagttctttgagaataacactcgttttgtatctgaaactaattttgcagagtaattgacctttgaagttctataaga

SEQ ID NO: 53155 - DNA, 1501 bp, Oryza sativa
aaattgacttatggttacacaatattgctgcaatcaacttatttcaagacaagtaatcaagcatataagtccttacatttttgacatttaggatcctgactccttgggagtttttgcaacaattgagatagcatgaagtcctgagttcaactcatcagtcaagaggtcatacaccatcctgtgacgcttcacaaggctctggccctcaaacttaggcgaaattaccctgatgttaaaatgtgtctcatttgcattgtccttgacagctgcatgcccagcatgttggtaagaaacatcttcaatatctagcgcactggcctccaaagcagactgtagcttttgcctcatccgagcagctcttgaaagcatagcactagtgcctcgtgagctcatcattgatacagttcgtctcacagcagctatacctgccaacaaagtttactggttatgaagataatcactatcacaaaatgaaactagatcagtgggaatgcacacatattcaagatcaatagtgcatggacctttacagaatttgcatgctgcaaaagattgatctgagaagctcaggtcatctcagaaagctgggtcctgagcatgattgcataaatgaaaacaatgacttagcctaaactatatctaaaaccgttgtggtccataaaacatgatgtgacagtgcaagtactgatttctgaactaatatgaattcaagatatgttgaaaatgcggtgcaattcaatcaggcgtcatctttcctaccccttcatatgcaggcacaacagagttcagacgtaacaaatccgatttcggctaagcatatccctccggtgggtgcaaaccatcaatctgcttttgttgtaaacattcaatatgtttttatttgtgatcatacacgatttcagggttacactgttcctctaaaatgctcctacctactctaccttgtaaagaccatactgaactccaagcgtcagtcacaaaatcgattttgatgataaaagatggtgaaattagatagttttacaggtgacagaaggcgcaagtaaagctggaaaacggctcgattcaaacatcttaaccaagaggatctgaccatgagctaggggtaaaggaagggggaagttcagcggctgccatgaactagctccgctcacgcgcaacgaaacgaatacgataataaacagggaaagcatgtagcttacgttttccggcgccggcgtactctcgcccggatcggggtagcagcaggcggagcgacggcggctagggtggaggagatacctgacagtggaagaaatcatggaacatgggccgcctttacgggccttgagtagtacatgggccgtcttgctccacgtgttgcggataacgccgagtcgccaccaacctcgctcgatcacgaacgatatgaggggagaaaagtcaaagcaactgaatccctcagtgcctcactgctgcactcgcggaggcgaccaggattgctcgtcgtcctccacggaga

SEQ ID NO: 53156 - DNA, 1501 bp, Oryza sativa
aataaatttagattctgaaattgtgcttactcctttcgtaaaaaaaaactaacctatgattagatgtagcatatccttacaacaaatttgtacatgaacttatccaaattcattgtattaggatatatcacatccaatagtagatttgtttttttttttgacagagggagtatttgagatggaggcagtacatgactaatgacatctctctgttgctttttttttttcaaacaataaaaatttctacaagtgatgttgaatcctgttgtactccctcttttccataaaatcaatctaaaatggatggaatgtaagtatgtgaatgaatctaatataattttgtaccacgttgcgtggtggctgaaaggataacaccagacatggggacagacatacatactactactagtactccctccgtaaaagaaaagaacaaatctaagattggatgtgatattttctagaacaatgaataatagaagcttgtccagatttattatactaggaaatgtctcatcaaatactagattggtttttttttacggaggaaatatttaattattatagattaccatgttcaatcttttcatcaacaacaaaaatgtcaatggagtaatcgacggcaatccccggcagctataggccttgtttagttcccaaattttttttccctaaaaacattatatcgaatctttggacacatgatagcattaaatatagataaaaaactaattgcaaaagtttatatggaaatcgcgagacaaatcttttgagcctaattagtccataattagccataagtgctatacattaaccccatatgtgctaatgatggattaattaggcttaataaattcgtctcgcggtttccaggcgagttatgaaattagttttttccttcgtgtccaaaaacccccttccgacattcggtcaaacgtccgatgtgacacccagaaattttcttttcgcgatttaaacacatatataatagtagagtcaaaatatgccaagttggaatgaaaactttgcatgtcactttattaattattccactctcttgaggatctgaaacatacatagtatttattattataggggtgttcccatgttcaataatcttttcatcaacgagtacaatgtcaatatggatcagtaatcgacggcaagaccggggcaggcagctaggccggggaagaaaggaatctgcgctgcagtagcactctctgacctgtgggccccctacccccctcatctctctccaacgtacccacacagcgtcccacctcgccgccggagccaatgagagatcgacgacgatcgacgtctaccagtccacgaacgagtacaattcgccataaataaatagggcgccacacccctcagctcgatcccctagctctcgatcggctgcaagaagctatagctagcctagctcatctcgccggagaagaagctaaggcagcaggcagagagagagagagagagagagagagagagatga

SEQ ID NO: 53157 - DNA, 1501 bp, Oryza sativa
tctcaagttattgagtttgaaaatgtaaaaattatatgaatagatttgtcttgaaaaatactttcataaaagtgtacatatatcacttttcaataaatatttttatagaaataacaagtcaaagttgtgttttgaagaccgtatcattgttcaaaacgacttcctttacgagtacagagggagtattcttttgttttaatatcaataacatctcaaaagtattttctatattttgtcacttttcatgtacaaaacatgttgatattgtggttggttgtgggcatgttacattttcggatttgaggtagaaaatggatgatgccatggatgtaagaaaatgcgcagttgtaatttagtcttaattatatttgataatcaactttatccttggtttgtcttcatttaaacagtcttctcccccatgtccggcggcgccgtggcccgtgtggcccgcttccacaacctgcggccggcgccacagttgatgggccggcccatcactcctacctcgtgtctctgacaccctgaccacacgagccccctccccactcaaccggatagacgaacgccagccagtcgccggcttcaggctaactaagccctaaacccgcgtgtctcctccctcctcgcgagttcgccggccgcctcgcctgcgtcgatctccagtgggcagcggcgccggcgtctgctgcttccgccgcatcctcgcccgctggtgagcaccccacccgttacgcgcatcctctttctcatctctcactaacccacactttttttcccctccgatttgcgttggccctagcttctcttctagatctgtaggttgcctttctctttacctttttgccttaaccttagcacgaataacaatttagtttgttcccaagaaaatttgggggttcaaccgagtttaacacgattgatgccaccgatactccacagacttcttgcgtctaactttgttttactattgcaagttgtgaatgctgcagtttacatgattcaattgtttggttctttgcacagccaagagcacccccggtgaatttgcgagatcagttgggagtaaggacatttcggctgctgtaaaattggttttcataagcagagcagcagatgaggctaactgttggccaagtgcatcgacatgtgcttgcattggcatcttcgcgatcatgcttcgtcctcggtgacaacctcccattgagaatgctttcattaccacgagcggttagatttcaccagaccgcttggcttggtactgaaacagtacaagataagagtgcttcactaactctagctagtcttgaagggcaaaacaaagttgaatatggtaagaaagaaaaagcaacacgcattggaggtccaaagccgtcttcaagggcttctgctcttaaggtgaaaccaaaagtttcttcatttaattccaaaccagcaaagagcaccttaccgaaatcagcagtagtgaagaagactctgaagatagatgaatctcttttct

SEQ ID NO: 53158 - DNA, 731 bp, Oryza sativa
ctgcagcccccaatcggcttttgatgcaaccgcttccctcatctgcacaccagcatagcagataaacaagtctgctccattaggttgccgagcctgcacacatgaaaaacatagtttaagatgtttctgaagttccatccacacagaagttcctttatgatataccaacagttaaccaatacaaaattatgaactaatctactcatggagccaatacagcgatacagcatcaccatgctaaaatcagaatatgaaggaaaaagttcattgcaaaagctcatatcaaaatatgaaggaaaaaaccatgcatctcattagtcaaagtaactgaggaagaaaaatagttcgaccccttttatgtttcctttgctaaatgaaatgaaagcataaatagtttgttaacatgagaatgtttctcctacatatacacgttaatacatactatgaacatcaacaaatttgtcacgatttatgtgaactttaaaattcaaattggccattcagtctcttattgatttggaattgggatggtcttccttaggtatcaaaatactttgtattcctaaggtagtagtgtaatacatgtgtcagtatatgtggttttgcattttcttgctaacatttatcccatttttttttgtggcagcagtgtactcctaacatataatgaaaatggtaatgctatgcctactgtagggctatcattgttctatggacacaataatagtacc

SEQ ID NO: 53159 - DNA, 1501 bp, Oryza sativa
gtgtttgttgctaagattattaagtaaatgatttgtctgtgaataaaaagcatgcccagcccagttcattatctttgtgacattttgtgcggatacatgtttctgcttcatataatctccttttggttcaaagtagcgatctatttatcatcaatattatcattctgttcaattccaagaaccatgtggatatggaggaattcaaaatatcaggcctcacttggaacatacaccctccatcccaaaaagagtttatttgggctattcagctagacaaaaatctaaagagtttatattagcgaggctcctgcgaaagctgagactattgcaaacaatgtgtcggttactgtttgctggagaatccatgagcaggagtagagatgcagctttctggccaatctgatgtgtagaagcgtgtcatgtaaaacagcaatttacctggttggacaagaattcttaaagttgtatgggtcgtcttcttctctttgtgtgtgtgtgtgtgtgtgtgtggttcaaaattatactgagcaacattttttgtttatctatgtttggtgaaactcagttacataattcaccctttgaatattctgtcgatgtccaggtttggaggtgtagagggtatgatggtgactaagccacagtattgtaacaactcctttgagagataaaaggatgtctcacaatatgtattttgtgacgtaaagttcaaagttatgagtaccttggagacttggtggagatgagttgaccttatagttagaacaggattccagtgtattcataacatcctctttgttcgagtaaaaagattttggtgaagatgagttgccctaacaattggaacaggactccagaacatcctttttattggagtaaaagaaattggattccggtgcattcaaacatcctctatgttggagtaaaaaaatgagtagaaaaaacgaacatcatctttattggagtaaaaaataattaaaaaaacgagttggaaaaaggtaaaaatgcccccatgcaggatcgaactacagaccttcagtttacaagactgacgctctaccactgagctataggggccactgctacaagtaaaaagcttcagtttactgtcataagtttaactgaaatatatacactaaagatccagtaacccagaacactggctatacccaaaccttcagttgcaaacttgcaatggaacacttgaatgacagaatgtagaatccagaaagtccaccgtccatgattccaactatggttaagggaacctgttcagtgttccattgactttttcaggtgcatctagctaaactttacaaatatgcattcacctttggtttttcaattccaaaaagtatcatgaagaacaagaaagaggtcggttctgtgaaatgctgacacagaatttcttggagtcatctcacgcattacagtgcatatccataagagggtgacaatagaaaaaaaaatggagcggagcaccaactccccgttgaagaac

SEQ ID NO: 53160 - DNA, 1501 bp, Oryza sativa
acatttggcttaaaaaggaggttccagttatgataacattttaagaccataaaacagtctattttgttgaaatgccttgagatgactctttactgcagatatacattttaaactcttagtatgcctactcatacaaattgatgatactgctaatttttgttggtagctttatctgtagaagcacctgattgcaaagttgaagaatcagcccctggaagttggcacaatgcgcatgcatcaattaagggtggaaaaggcaataagcatgaactggaagaaacctctgctgggtttcctcctgatgactctattggtatttctggaatggagtcctcttcaagagacacagctaataagaaaatcaaattgtcaaaggatattggtttggaccgtctaaccgccacaactgttcaggaagcaccgaagcgtccaagaacaacctcactaaagaagaatcaagagtgcagcagacagaagaaaagaaaaataagcaagtgggatggttcctactctgtaatcattgaatggttgaattactattctgtggatgagtcagatgaagatgaggtgcctttgataaataaaagaaccgaaagaagaaagcggcagaagttactgaaacttgttcttgctagggaatccaatagtggcagtgaaggtgctagttctacatcttttgtagaaaatggcagaaattctagcagtgctggctcttaccccctaagccagggggacaatgacaaatctgaaaatgtgcaagctaatcgagttgatgtaagttcattgccagatcatcctgtaagtagtcatgtagcagcagaggatcaagctggccaagctgcatcgtcaccattgaactcaccaactagaggtatcgttgttgacatttcagatggttgatggccagagttccattagtttctttcagctgaggcctggacgtacaattatccagactacagttgtaacacttacttttaattccttgcacctgtctactgctagacatgcaacgggacgatcctgtgaagcatgtgtcttgtacatgtcttcgtttcttcctttctcatttcaccttttcttttcttagcatagatcagttcagtatacttaactctgtcaggttgtgtgacccatcagtttctctccgtactagtctcttgaagaacagcaaagatcaggttttctctttggttgattgtgtgtggaagatcaatccaaatatgttcatttcttaagaagataaattcagttctattctattcataaacttttgtaaaccttctaaaatcctttaataaacaagaagcaaagtgagtaatacgaaaccattcacaaaatagagggaaaagaggcccaaattcccaagggttaattggattcatggcccatttatccaaccgtcttatctccctcgtgtccttccccaattatccccttctatccacccacaccagcaagccgctcaggcgcgctctccgctccaccgccatggcgtcca

SEQ ID NO: 53161 - DNA, 782 bp, Oryza sativa
ggtggtgtcaaagatattctacgagttagaaaaaaatcaatttaaatgggctgagaaatctcacgctcagtcagcacaggtgtattacttatccttgtatttttcttgtagtttaatatggtatgagataaccctgtcacccttgactctttttttttgttttaaaaataattctgaaagtaagttaactgatcattgtaaaaaaacactgcaaggcaaatatttaagctacatttgttggattagtattagcaatttgttatattaaacgtgttggaaccaaattgcgagaggctctgtcatgattttaaaaattgacttttgtttgatccattggccaatgaacactgttcagttcttttgcaggattttcatactaattcacatttagtttacttgaacatggatgctatcctactagttaagtaaaaactgcttttgcaattaatgttaccttgactctactcagagtaggtactgtgattctggtatgcttgatcacaaggattcttttagttttgcgtcatttacctgttctttggtatcaatctgtttcttgtttccttagttgaatatattcggctgtagctgttttgcatttctttatcttatttattgcttaatttttaagtctagtcttgtactcattgtaaagttttcattcattgtagttgatttctgctaactttctgaagttaacaggcactcaatttcctggggctttataacaattaattttaagtaacacatgctagatgtttgtttctgaaattctatgcagg

SEQ ID NO: 53162 - DNA, 216 bp, Oryza sativa
aatatcgtcccgccgttgcgcccgcctcgtcggttttctccgcgcccctgatctcggtctcctccgcgcgcccaccggtaagtttatgcctaatgttaacgctgtgagcctgtgactgagatctgaagggttgtggtttccattatacaagagccattaataggtcttggttttttggggataactggtgggaaacgaacaatctttctgtacaga

SEQ ID NO: 53163 - DNA, 1501 bp, Oryza sativa
atttactacatataaaagacaggagcttttgtgacttctattttttgttttgatgagtgtttagtgttgctatttttgaatctaagatgtccatatttccattatagatgaatgggaaatgaaatattatatcaatagcagatgaaaatatagttcagaagccagatagaatgtaaggcaagcggaatctactaactacagtaccaaaggctagtctagaagagatacctgaacaaaccggagagaagagatacctggacaccaaaagcacatccttttcgccacaattctctgtcttccaggcatatcgcatcctgtagctgtcccttgtaggcatatcattaggagcatgaagtacattagcagaaacatgttgactagcagtcttgtaggcatatcattgggagcatgaagtacattagcagagacatgttgactagcagtatcacatcccatcatactacatgccaacatgccttccgattattgtaggagttcttatttgctcaccctgttcagcagctctactttatggcaatacaatcatggagaattatgagattgaattgtctttccaaagcagcctctatttcctgccttccattttgcccaacacaactgcctagcccagtgacatgtctctcttaacctttgggtaagaatttctcaacccatgaggaaaaacttgtagctgatctgggaatagcatcagcatgaatgaacatagcaatttctcttcaaacaacaggtgtagcacattcaaataagaaatgttggacagtttcaggatgattacagttaaagtatttgggatcacccagccatttcttttcaatattttacctttgtttaacagcatacctttttgtaacaaccacaaaaatgtttgaactttgacaggtatttagctttccatacgtgtgtaaaagaactatcaccataatttctcatcatctatatgaatttcactaaaaaacctgccttcgttcccccaagatcctgtggtaacatgaggagcaacagacagactaacatgttgcgcttgtgacagtacatatctcatttatcttttgggaaacctgttaaccatctcctaaaactttgctgccattggtatagcactgactcactaatttatccttgtcacagatatcataaatagcagatattattgagcaaggtttatcaccaatctatttagcctctcattatctgctattatcaccattacaatttacaaatgatgactttcctgcctttcaaatgaatgttttgatgaaccttaagtaggtcagcgcaacaagatgagtcatctaccttcctctttttctagtttccaccaacatttattaaggacacttacattcattgcctcagatttttaataccaagaccccctttctttttttgagtgacaaaatattatcctgtttgacctgttgatactatctttgtccaccactttgccagacagtgttcaggaataaggacatggacatac

SEQ ID NO: 53164 - DNA, 1501 bp, Oryza sativa
acttgtacttcaaatactacctatctctctgtatttaatgtatgacgtcgttaactttttatccaacgtttaatcattcatcttattcaaaatatttatgtaattgtcatttattttaccgtgacttgtttcgttatcaaatattctttaagcatgacataaatattttcatatttacataaaaaattaaataaaacaaatggtcaaacattggtcaaaaggtcaacggcgtcatacattaaaatacggatggagtatcatttaatcccaaaagagagagtttatatgattatactttcaatggtgtgtttgagtactcttacactccaactggacggtcaattaacttaaaggaggatggcgatatggcatctcatgtgttctcgcgtcgcgatcagttaaatattactcatataataagttttctatttttttctaaatcaaacttgatcaaatctataaatttattagcaacatctagaatattaaattagttttattaaaatcaacactgaaaatattgctttattttccaataaacgtgatcaaacttaaaaaaaatttgattagaaaaaaaaaggtcaaagcgagtaacgtttctaaagccttaattcagagacatggactttggccaaacgtccaacaatcaattaattgaccaagttgctttctctcctatatggacgatgaaaacgatagagtagtgtactactcctaattactgtatcgatcacatcgaccaatgttttaacgtgaagaaactgtgagcctaattcactgcagagcgtcatcatagaccaattatgttcattaattatggtaaacatcttattacagacagttcccccggtcatatatactgatcttccagtcatgaaaaacacgtcgctttagatatatatggacgcaattgtcaaaatgcaaaattgacaattcacttccactgcaaaatttcgttagaaaaattctgattagaaaatctccgaaatactttataaaagtacctttgggacaaatataaagttatcattttcaaatatccattcaattaaataacattaatttctgaagttactcatccaaataggcatgctttcattgctggaccgagtacggttttacaaacgtgactatctctattgaaatatacattgaaagtgagaggtagcatgctatgatgtatacctctcttctgaaaagaaaggcgccctactatacgtgtcgtcaaatcttaaaatcttaaatcactcatgtatgcaactatgcctacattgaaaatgcgaaaattataccaatagatttgtcaaaaaaaaattcatataattatatttttaacaatttatataaatatatactttgaaaactaattataaagttatcgattcgatgtccacttcacccatgaacgattatcaagtgtcaggtattcacagatttcatcgccgattggaccgtccccgaggaggacaaagttgatcgtacggacaacaaacattggaca

SEQ ID NO: 53165 - DNA, 1126 bp, Oryza sativa
ccgccgccgccgcagccgcagccgcgactccctttttttacttttctagggcactactcgccgccgcaggcggccgcgggggacgggggagcgcctctccgtgtcccgggtgcccgcgccgcgcagagggggtgggtgactccgattgtttccgggaattttgggtgggttggcatttggggccgggtggggtggggggttcttgatttggtcttgcatttgggggttcttggtacgcattggtgattttcgcggcgctcgtggggggttcttggcttcttgccccgtcgtctgtgtggtagatctgcttgatctgtgcgcgtctgaggatgggggatgtgcgtagattggtccatgttggtaacgtttgcgaggatttcagctttagggctaaggttgggtggcatcctttttgaaaaaaaaagtgagtttttagttgagtatctgatggtagcttgacttggagggtttcttggcacaatctggtgcataaggttaattttgcatctgttcaacgccatgaaagaaaacaaaagtgttaggaaatctaacctgaatatgaagatggcattttgcaaggcagttttagaagggacttttgtttaaagaacgccataaaatctatagaaagcgctgccttttttgcacataacgaaatggacaaataaatctggtttcagatttgaattatagatcataactgtaaacatttgtgccaactgactgctaattccgatctgtatgccctgggattatctattatttctctcaattatgctacgaagggactgaataattttggtttaacttgtgcacttgtgagtaaatatgatcttgttagatttgcaaataagatctgatactgttttatgtctgcattgcatctacttgttcgatttctttttcacactgatacttaatgcttaatacaccgtctcattcagctccataaagttatttgccttggttgatatcttcattgctcactgtgcaatttctttctttcttttttttgcgtcaaaactgcacaatttcttatgtcattttttttccttttaacacattcaggctcacatggctggaaggaaggaaaatccggtgcttactgcttgccaagcacccagtg

SEQ ID NO: 53166 - DNA, 1501 bp, Oryza sativa
gcttactggatcaccatcagctcagtcatataaatcaaaatcaataagaaatgatcttcactcattcattgcatctacaaattaaaatatatatagtgtgttcaacatccttggatgattcaaacactgcaaatattttaatcgcgccacttactgtagcatgcaaacgaacctctagttaaaataactcgtgttagtcttagtctgatctagacaaaccagagttttagttgaaatgccatctcacctatgtagatggcccgggaccgaggcctctctactctttcgtttctcagacgcatgcttccctaattattaaacatcgtgtttttatattttttataaaaatattaattaaaaaaaatcatattcataattaattaatcatatattaatgagttatcacgttttctgtgtgcgggaaaagttttcccaacctttactatccaacacagactagatctagagtagcctgtaggtgtgccccaactctgttttcaaccatgacaagaactggtatggatggagtatggaccatgcaagggactaatcagcgattgatgtgggaccggtcacctatgtgctgatgacatcacttgccaagtcaccaccctttgtaaaatttactcaaaactttaaggagatgcctatgtgagtatatattcttatctgtcaaagaaaaacacaattatttttcaccgggagacacattttagtatttttgttggagtcattttagcactgataatcaacttaatgtcgttgcaaaattcagggggggaaaaactgttctaggaccaatatttagactgcacgtatagaaaagaaaatatgaacctgatttcaggaaaaaagccctcatgacgtcataatgccattattgattctttcattgtcaaagttgtaacatttctactttgaggattacaaaaaggttattaatctggttttactagagctagccttaatagctactccctccatttcacaatgtaagtcattctagcattttccacattcgtattgatgctaatgaatctagacatatatatctatctagaatcattagcattaatatgaatgtaatgacttacattgtgaaacggaggaagtagctcctcataacattgatcaaaatttatacatttgaaaattattttggttcccttcacagaagcttcacacaaagaagctgagacatatattacaacattacactatatactagtccaatcacatctccaaattcactcccccatcccatggttgctcattgcagaagaaattaattgatgtgtagcctcgccgatgcgcaagcaccgggaggcaatatgcatagatcctacgtcgagaaggtcaggaactacacactgatgtggtcagatcaatggagctgtacatatgcagcttcttcttcttcttctgatgtttctcggtcatgtccatgaggagaggaggaggtcgacggcagccgccggccggccgccatcagagcggcctc

SEQ ID NO: 53167 - DNA, 1501 bp, Oryza sativa
ctgcaggttcttgcgagcgctggccctgacttgatcgcgtttgaggccatcccgaacaaaatggaggcacaggtgaggctagtgaatctgaatctctgaaagaaaaacacagattgtgcaatgtgttccagacattcaatagcactgaaatgctgccacctttgatgtttcttgctgaaattggtgatcatgcatgcaggctttagttgagcttctggaggaagagaacatccaggtcccctcctggatctgcttcagctcagtggacggcaagaacctgtgctcaggagagagctttgcagagtgcctccaattcctcaacgccagcgacaaggtgaccatcgtgggtgtcaactgcacgccgcctcagttcatcgagggcatcatacgcgagctcaagaaggtttgcaccaacttccttcagcaccatcgactccatcttgcacacaccccaacattttctttctgcaccggttctgcaatcgtctgaaactctgaatgtgtttctgacagcaaaccaagaaggcgatcgcggtgtacccgaacagcggcgagatttgggacggcagagcgaagagatggctggtgagcacgacctgttacacttaatctgttctcatcactggcacgccaagaaagattagcacagatctgttctcatcactggcacgccaagaaagattagcacatttccgtgcgaattcttggtcgtcttgatcatcaaactgactggtttttttgatgcgtcgcatgcacagccggcacagtgctttgggcacaagagcttcgacgcgctcgcgaagaggtggcaggaggccggcgcgagcttagtcggcggatgctgccggacgacgccgtcgacgatccgggccgtctccaaggtcctcaagggcaagacgtcctattcagcaactcagatttgagaccgactacttggtagtgcaacttttaattaatagcgagaattataccgattcagtattagtttatgctaaattttgcagcggaaattaccgtctaacgatttgtaatgctgatgtgcaaccatcgaattttatacgagcattagcatggagagtgttgcagaggcctggggatgtgatttatcttctttatccttgtaatataaggaaagtagcagccatgtatcgaatttatgagttatctatatatccaaattgcactgataatgcaaaagaacaagttgcgtgtcctattgtttttgtgaatagttgttgtattggcaatacttaattccaaaatccagaacatctacagtctagagagaagacatgtagtatgaaactacaatatgccaacaatttcaatacctaatgcggaccatgaaccaagtcagcctagtgctagtagatgcgctctgacttgccaactttccaagtgaacagaacctgaattgatgacaccttcaaaatgactgctttatctgatgttagatctgcagtgatccggccaacaatcaagcatttggatgactcaactg

SEQ ID NO: 53168 - DNA, 1501 bp, Oryza sativa
atcatcgtcatcatccacctgtgatacagcagagatgattcctactgtatttttcttttactccctccgtaaaaaaaaaactcgttatctagctagattcgttgtcccttggttgagtgttttttttttgacggagggagtacgaatcattcagtcctatactgtgacagtattaattactggtaataggtttcctcttgatggacagtgacactgaactaaccaaaaaatgaagatttcacagatagtttctgtcagcctatatatcgagcacaactgcacaagcagtcagttagtcaatagggctgttttaaacgcaagcttactggatcaccatcagctcagtcatataaatcaaaatcaataagaaatgatcttcactcattcattgcatctacaaattaaaatatatatagtgtgttcaacatccttggatgattcaaacactgcaaatattttaatcgcgccacttactgtagcatgcaaacgaacctctagttaaaataactcgtgttagtcttagtctgatctagacaaaccagagttttagttgaaatgccatctcacctatgtagatggcccgggaccgaggcctctctactctttcgtttctcagacgcatgcttccctaattattaaacatcgtgtttttatattttttataaaaatattaattaaaaaaaatcatattcataattaattaatcatatattaatgagttatcacgttttctgtgtgcgggaaaagttttcccaacctttactatccaacacagactagatctagagtagcctgtaggtgtgccccaactctgttttcaaccatgacaagaactggtatggatggagtatggaccatgcaagggactaatcagcgattgatgtgggaccggtcacctatgtgctgatgacatcacttgccaagtcaccaccctttgtaaaatttactcaaaactttaaggagatgcctatgtgagtatatattcttatctgtcaaagaaaaacacaattatttttcaccgggagacacattttagtatttttgttggagtcattttagcactgataatcaacttaatgtcgttgcaaaattcagggggggaaaaactgttctaggaccaatatttagactgcacgtatagaaaagaaaatatgaacctgatttcaggaaaaaagccctcatgacgtcataatgccattattgattctttcattgtcaaagttgtaacatttctactttgaggattacaaaaaggttattaatctggttttactagagctagccttaatagctactccctccatttcacaatgtaagtcattctagcattttccacattcgtattgatgctaatgaatctagacatatatatctatctagaatcattagcattaatatgaatgtaatgacttacattgtgaaacggaggaagtagctcctcataacattgatcaaaatttatacatttgaaaattattttggttcccttcacagaagcttc

SEQ ID NO: 53169 - DNA, 1501 bp, Oryza sativa
taatggtaatagcctaataggagtaccatctactattgatctttcaaaaaaaaaagtactagtatagaagtagtatccagctagagctgcttaacagggtcagaatttgtccaaacagagcttgtaatgcacactgacgaagtcgatccgatcgaatcagagtcaacatttaaagagtactatttcgaagtaaaactgttcagttcttacaagattacatgtgaatttgcaagacttggacatgagtgttcatctcgtagtttaatgatgggtacccaacctgcaacaacagtgctttaaattgtacaagcagagggtaccaacagagtaatttgcacatgcagtcctgaacctgatgccattgcgaaacacacaaccctatacggtgcagatgcaagggagcccaattcagtcccagccattatctgtattgccgtacttccgcagggaaagttaccctctcatctgatctaccattgcatacatctcaaaaggaagtgagtaaaaaagaaaacaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgactaaactctgaacgtactcacctggatccagatgcgagcagtacagtacctgtgcacattgcttgtgtattactccacttaattacgaactctattattttcctccgataatgcccgcagaacaaggttgtcactgaaaaatggtcctctccagagtccaggagctataggaggagtatgatactccttagcaatcatatactcatatgacatatccaaattgacaccggggttaagccgttaaccgtcactacgagttgcacttgtataaacaaaaaacaagggagaaaaccttgtgtcccccccatgatgcagaaatctaataagagcagcccaacgcttccggttggtggcggtagaccggcctctttaaactaccccatccgccccagatttatcaattactcctcgtcatctcgtctcgtctccgccaccgtgcgcgcgtcccctatattagaccccccaaccgggcaccggacacaccatcaccaacacaccactgcaaacccatccgcctccgcaccgcatcgcacctacaaattgtgcacgctgcaccgctcaaaaaaaagaagaaactaaagtcgtacgtaggacgcggcgtgcgagcgttggtgcggtgcgcggcggcgcgcggggaagtagtgagagcatcgatca

SEQ ID NO: 53170 - DNA, 1501 bp, Oryza sativa
cgatcggtctgatgcccgtgtgaggtcgtgaccgtgatgacccagccacgcaacgcacgcagccgtcgagtacctggatcgaacggccggctttcatcctcaccggggagtcgaccgtcgccataaatgtaaaagcgattaacgtcctccacaccggagcatgattgatgttttgaggcggaacggaaactgaggaagaaagccgtcttctctattcaaggaagagcctgtcccggaaaacatgtcggcacggcgactgcatttatttacgtgttacagccgtataaacagagggatattggaaattcgacaaagggtaagaaagggataatcagacaattttggattattgtacatctaggggcaagggcatgtttggctttcagctcctccgaagtgaagcgggctagaccgcttaagcgctcccaccgagactgtattgggtttagtattgggtttaggctactccacaattttatttcaaacctaactattagagttaaatttaaaagttggagttattctcagctagtcctctaattgtcaaccatagcagatcgggcatgtaagtaaacccacgtcgttgtcagaatttataacagaaatggaattctagcttaagagaggaataaaacgtgagctaatgagcacaactcacttcaaccagtaattagatggatcatgtctgaccggttgcatgaagtgcgagtcgattttaatctagtaagatgaactcaacttcagttagtaattagatggatcatgagttcggttcgagctaaaactcccaacgacggatcatgagtagctcgtgccctctccttcagatttttttgtacaatctcctaacatattccatttcttatcaccaaaagttttaagaccggaaccactgatttttcaggaacaaagaaggactgaaatatctcagtataatactacctctgtcctaaaataagtgtagccatggatatccgtacccaatatttgaccgtccgttttatttgaaaaatttatgaaaaaattgaaaatatttagtcacacgtaaagtactattcatgttttatcatctaatagcaataaaattactaatcataaaaattttcaaataagacgaacggtcaaacgttgaacgtgaataatgcaaaactgcatttattttgagacggagggagtacgcagttgtaatcaggtagtcatctcagtaataaattacgcatgtctgtatttggaagagtaatgtagtaatactgtactagggttttcgcaaatcaaaagagattaattggtgtgcagtgtaggcctaccagtctaccagagactatgcgtgtatccctttcgccagtaacgatacggattgcaactggagcctatgagattcgatcacgcccctcaattccccaatccctctccctcttcatggatcctgacacgaacaatcgaacaaccacggccacgctaaattggaaaattaaaaaaatatataataattaatctcctg

SEQ ID NO: 53171 - DNA, 1501 bp, Oryza sativa
gagactatgcgtgtatccctttcgccagtaacgatacggattgcaactggagcctatgagattcgatcacgcccctcaattccccaatccctctccctcttcatggatcctgacacgaacaatcgaacaaccacggccacgctaaattggaaaattaaaaaaatatataataattaatctcctgtgaatgatcattccttatgtgacacatcagacaaagtatatcgatttaatccgtgtttatagcgaaaaaaataaaaataaaaggaagacaagaaaaaaaattaagaagcgagggaggggaaaggaggaaagaagaaaacaccacaaattaagaagctccaaagtttgaggacgcacgcttcgcgggtgacgtacaggtgtaggggaggtaatgcggcggcggcgcgacggccgccggcgagggcgaggctgaggctaccatggattcgatcacagcttgacgacctccgggatgtcgacggggtagcggtggatgcagtcgtcccacggcccgtcggcgggcgtcttgactgtgcggaggcacttccagacggcgctgttgcacttgaatccgctgccgaagccgatctgccagacgcggtcgccgcggcgcatgcgccccttggcctcgatgtaggcgagctcgtaccagagcgagctgctcgacgtgttgccgaaccggtgcagcgtcatgcgggacgcctccacgtgctgcgcggacaggtccaggttcttctgcagctcgtcgatcacggcgcgtcccccggcgtggatgcagaagtgctcgaacgccagcttgaagtccgggatgtacggcttccacttcttgttgatgagcttgcggccgacgaggcggaagaagaagagcagctgctccgacatgggcagcaccagcgggccgatggtggtgatgttcgacttgagcgcgtcgccggcgatggccatcagctccttggacagcgagatccccgagtgcccctgctcgtcctcctcctcgtacacgcaccggtacgcgcggtcgtcggcgcccttgtgcgtgcggaccacgtgcatcagcctgtacttggccctcctcgcctccctcctcctgttcgacagcaggatcgccgccgcgcccatccggaacaggcagttgggcagcatcatgtcccgccgggttccccagtagaagtttggtgtgatgatctccgtcgacaccaccagcgcgttcgagttgggatgcacctgcgcgtgtccgtccatgtcgctcgttaatggctcacctgattagttagttagctaaacagtagtaacatcaaagagctggctagtacttacctggagcatgtcgcgggcgaggtcgagggagatgaggccggcgctgcagcccatgccggacaggttgaagctgcggatgttgctgcggagcttgtacttgttgatgatcatggcggagagcgacggtgtcggggagaagagactgcagttgacgacgaggatgtcgatgtccttgggcttg

SEQ ID NO: 53172 - DNA, 1501 bp, Oryza sativa
gcctgagccgctccagcaccgtgccaccaccgcagccagttgcgccgccgcgagagcaggcctgtccgccactcttctccaccaaaacggctccgcaaggacgaggatgtcctcggccgccgcccctcttcaccggaaatccgccggagttccccttcccttcgcgcgccggtgagctcccctaattccttcgccttcggccggtttttcccgctgcttcacgccttctcccatcctcctaaccataccactgcattccccatgtccttgcagccgccgtccgccggttcccgctcgcggaacgccgccggaccgccgtcaccgttgtctccccgaggagcgccgccgccttcccgtcctcaccttgtcgtcctgttcgctcggtgagcatccctccctctccctctatctccccttcgccggtcgcccgcgttgcgccgccgccgccggtggccatccggctaggccgtcgtcgccgccgttcgccgccgctcggccggccggtctcggccgcgcccgcccttccctgtggccgtccgtggaccggcgtggtcctggtccacggcgcacccgaggtcgcggtggaccgtgtccaccgtgggccgcccccttgagccgctgatgcctggggcccacctgtcggcgctggttcccctttgatgacgtcagcagcaggcctttcctttgagaaattatttaataattgcgtcataaatcaataataattctagaaattcatataaatggctcaaaacttctaaaattcatatctaattcattcgaactccaaattgcgccattcaacttgcaaaattcatctaaaattgagttctacatgtaagtttactttttatgtaatgtttccttggtttttattagagtttttcctcattttgcgtgccagcgtgtagaatccgtcgttttggaagtccgcggtcgtgaggaaaagagttcggaagatcgaagtgaagaagcaaggcaagtcacacattccccttgagcattttgatcctaatttataaacgttttaccgtttgtaaataaacatgcatgtcttgctaattacatgggatccgggtattacctatctgcttgcttatgccatgtttacttgatatctgtcccttgtcaatattgggtaataaatcgactagctcatgttacttatgtgacctagctagaactatatgcttagccatgcttaattacaactagctcagttgatatgataattacagtattagacctttttagtatcagaatgagctgcgtgctcgagacatctggccatgcttcatggtcgtaattatccaactaaaatgcgactgtatggtgggctgtgggtgcatggctttgctaatcacacccatggcagttaaggaccggttcgcgggaaaccctggaagaattcagcgtacttaccccaagtcagcgtgggcaacggctgggcttgtagtgtagctttcctctagctaacgcatccaggcaagggtaggcgtga

SEQ ID NO: 53173 - DNA, 1501 bp, Oryza sativa
aatgtatataaaaaatatttcaacttttaattgttcacataccaatggaataggcagtcacagaatagaatttcaaggaaagcaagttggatataatgccattcaaatagtataaaaggcgagtttaattaaattatatgagctgagcaagctatgatgaaagaagaataatgccatccaagtagaataatgacgtgtggctgtagcttcgttgaagtgaaggtcgggatttattccattatgaaaaaaatagaataatggcatgtgtgggaggcaggtgaaatggaaggtggttaatcgtaaagaaattacttattactctgttgtgcatactactatagtagaacctactatagtgagaagattaaaaactttgatcaatgcactgcatagttacagttaggtagaagtggtaaacaaccaggactttcagctctcgtctctggcctttacctatacctattcgtttttcaaggttgcaaatttgagtgattatgcatcgtttgaagggcacacaattaaactggactaaccatttgcatagtttcaattcaagaaaattggtagcaatttgagatcttttaatcttcaattcttgatttgcaatcagtgagttcgacgatatttacaaacactgatatacaactagataatgaacacgtggaaggaggagtttaaaaggctagaacattgtttcctgcccggagatgatatgatcctgacatgcatgtgtttggaggtattgttcaaggcctgattctgtctcattgcccatgatttaatgttgataccatggaaggttcacaaaaagaagcttggtgttagagaactagcaatgcaggctgcgactgccatctctcgtctcctcctggtgcttctcattctcaacctcttgtatgatgtgttctatgttcttggtagagcatagcatggatgatagcttatagtatctgttctcaccttgtgattttgctctttgactgatgtgggtttttattggtagcgagctgaggtatgggcaggtgaggatgtaaagaagtaaactacagtgtggatgtaaagaagccacttccatgagcactcgatgacctaccataatatttgaccaaattcataaatatttgaaaaaaaaatccaaaaagttcggtggagatttgtgttggagttgttccaaattcacttcaagatattggccgggcttctgacgaagcggagcggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaagtggtatcagagctttggttgctgttagggttcatgacgacgtcgatgaagttcgatcttccgctgc

SEQ ID NO: 53174 - DNA, 1501 bp, Oryza sativa
tttacatctccaccttctgtcataagacacatatccataagtctattaaaagaaaacgaaaaaagataaaaagaaatgaaaataagacaagaggtgatgggaaaaaaaacctcaactcctcttattattggcaagcgtttaagcacatagattttttagccaacaattgtaatggaactacaccacccatagaataagacatccttggatacagattccaaaagtatagcactattgtgcatatagtatcctgctctcttgtggtagcatggtatattaaaagttgactcaataggaatacatgatgataacctgcatatggttagacaattgtttacgattaaaaactttgtcattacaacaccgtcaaattgactaacataaaacgctagctccaactagaattttctttatggacccagttatccctctaagccaattaccaaacatatttttggcattatggggtggtgggatattaaatgcaaaaaccacacatctacaaacaaaccacaaaacatgacacccaaaaacatgtttgtctccccctattttccattagtcaggttatctttgttaggattactttcatatgaagaaaccacaaaaaaaccttgatagtagaacctttaggtcccatagattcctcttatggatcataatattagatttcatggacacggtatacttagagttaactggaaattggctattttatgaagcaaccatacaaagtaattcttttcatttgataaagttatattagctagcatgaggatcaaatcattccacccgattagcttttggtaagctgtggctctcctaaaagaaacattcaacaatgttgtgctcaaaacctctgccacggtagactacttctttcgagccacattatataaagtagggtattgatctttgagagcattctcaatcacatgtctttccaaaatcttattttggtcccattagcacatttaaaggatccatacctaagaaaatggttgtttactttgttaaatcagcctagaattgacaaatacttgtattactggacatatcagagagaggcttaccctttaaattataggaacaaacacaaataaccaaacttaccagaggggagatgaatagtagattatgtcaggggaagtcaaataatcaaattttaatagatcaaagcacaccccaatctcaaaatccaatgtaacacatgtccaacacgatctatccaatctactagggtcggtctgactgaggctaggctggtctgaccgcatgacaatgcacacggaacattgatgaatacaatgctttgcccaaatctaaatatattttttttctaacgattagaataagatgtatgcatgtctccataggatagaacactattgccggaattgaaggcaccgggaaattagagttggaaagaagtttgttatactttctgttatcacgaactaaatgccattacaataagaagtccagcttattgcctaaaaca

SEQ ID NO: 53175 - DNA, 582 bp, Oryza sativa
acaccaattggtcttccattgagtagtgagtcgggggctacagatgttatatcatatttttcataatatttatcttgattgcttgcgacataatctgagtacaaaagtacctatcgagttatggagttctatcttcctatgctttccgttcggtttgccaatggatggttgcctttgggccgattcctagcacccgggggctcgttggatggaccgaataacgcaaggtgctaagtattattcggaataaatcaaaagcatagagataagataatttattttctgctcttaataattgcaaaagtacctgagtagtaaattctaatccgtgaaactttgttccattaatgacgaactcatatcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcagg

SEQ ID NO: 53176 - DNA, 1501 bp, Oryza sativa
gagataggcccctcagtggttggccaagagcatcgcatggcaacatcaagtcatgcgaagtactagtcagcaaagaactacgaggccaggatatttctagttcttcgtgacgtctaacgcaaggaaaaaaatgaaggcctcccctgctctcccccactgaaatgcatgtgtagcacagatatggtggtgaaacttaattagcaatagtttcaacaagtgattgaaattaagctcgttgtagtaatatatggtgatatggcctacactatgctcagttataggtatgataattgagaagcagtgagattaggtgccactaacaagaaccaaccctgaattgctgacctgcatgccaatagagacatactccctccgtcccatataaaatgaatctaggattggatgtaacatatcctagtactaattcgtagtccgagaatttttcacatccgatactatgttggttttttatggaatggagagagtatgactaaatttcactgacctgcagcaacaaggcaccgatcattgagttgttcctggatcagggtatgaaccatattctagatgccccagcactgggcctggtggcctaccctaccatatgaagccctctgcctctgggtgcacctatatatatgttggatatgagttgtgaataagagttgacaagggttaatccagttcctttcaaggttttcccatcactctaaaattattgatccctgtccataggtaattaattaccaacttgttgctcgctaataatccgcttgaatatagttgagcactagttattttgcttcagttcaccttctaactaggatgttcgatgctgcagagagtatatatacatgtcgtgattgggttggaacaactatgtttgcgtgagtacttttgcttatcggaattggaggcactaggaaaatggagatggaatggaggtccttctccatccaatgatcacgagccttcggtactacagtgctatcagatattgtgcactatggataacctcatagtcgcagattcacctcccgggtaacacgggcagctgcctaggcttcattgcaaagttcgctggcacataacactaattcttcgctgcgatggattaattctggggcaagatttgcatgtgagagttgaatacggaaaacatgcaggatttgtatatagtgttaagtttagcatgtgggccttggtcctcggctgcctatggcctctgcctgcctcattgtaaaaagaaaaatatattagtgtggtatatgttttcactcaaattaagcaacgtactcgatgttttatcttttctttcgtccataaatatttacatgcatttttaaccatgttttgtataaagcttttttattgacaactttgattacaatatattaaaatatgtatgaacatgttttagtatagtagttaagttaggccagcccagccttcatagagctcttggttcttccactccctcacattgggtgtttgcgtagga

SEQ ID NO: 53177 - DNA, 1501 bp, Oryza sativa
ctgggattttagctaatttctttcatgcccctgaattttgcttacttccttgtaccccaaaatttgattatgatcccttccatatacctcccatcagttgaccaacgaattgctataaaaatgatcattttacattttggatgaacatataaatttatgaattatattattgaaaatgctaaagtttgtcacacgagactactatagttatgagtttgttgtgcgatgcattatttacgacaaaatttatttttagataatgagataaaaatatgtatttattgctgtgcgatacactctggtgcccccttctcgtcctccactcatccccggcaatctgttactctgccatttttgcacgcagttgcttcaagagttgcccccgatctattcctggcggcggctgtgcgtgaccgataaatgacaattatatatatcactcggaaaatatttaatacccccatatttcaactactattaaatgtattaaatgaggtggtagaagaaataaatctggactctaaacccattcaaatgaaatctcacctgttcaaaatgctttttgtactaccagtagagagcaccaaagtaggatttccgtaaatatattgccatttgtgtgttataaaaagggaaacaaagatgcaaaatgcaatttcaatctacgtaattgctactctcctgtggtgttccatgaatttgttcagcttgaatatattggcatgcgtgtgcactagtagcttgcttgtttgggaatgtaaaacattttgtgcatgcctagatgttggaatggaaggtgtcaagatagtcgagatagcaaccatcgggagttctccagcatccagaatatgatgcactacaagcgagctatctgctgctttaaaacaaaatgcttgttgcactttgctagagacctaaatgattgttgcagatgctagatcgtgcatatgctaggctggttcttcattgggcaagttctatgtgtgtacaggaagttattctcgtgttaggtgtaaatgacagcagaagtggctctaatcttacctttcatcctttgttgcactgtggaagttctcatcactgatccaagaagtgttgtgcatgtgctttacttgttccagttggatattatagagatatttaaagggttaatgtgcaatttaggtggttagagcaacaaaggggttatatccaattggtacatcctctttgttttgtcagaaaaatgtccaccataccaatcacagtgtgtgattttctacaattaacacaataattggtaaaatgtgttagttgttataattcttgttactttgttataacacatcgcaatatcactaatcttgaatcagctcatgtattcttaaccatttgttccccaacatcctctccacccacctgttgattgtaataataccaggaaatagttacaatatatggctcgttaacaatgttgtgtatgtcaaatgcactttgatcaatagatctgcataactagcat

SEQ ID NO: 53178 - DNA, 1501 bp, Oryza sativa
gctgacatgtcggacccacctgaccccacatgtcagatgcttcccctaccttcaagctcgcacgacgccgccttctccgaccgcaactccgtggcatctccacttttccgacacctcaaaatccctgagacaggaggcacacacacaaaaaaaaaatctactttgtgtgctcactagccaatatatataggttcgttcacatttctttgatgatgaaaatttcaagcattattacccatttagattagaaatttttttaggagtaatatgatttcaatgtaaaatcgcaaaaatatggatcggccagataaaatcataagtttagcactgtgtcgaacaatggttgttcgataggggttgtgcagtagaacctgtcgaacatgggatgttggacatgcccttgtatgcatgcactttttattatttttttcatggccccatgggtgctaaacttgcgattttatctggctggcctatatttttacgattttttattaaaattgtattgtttctataaaaatctttagattacgcattaacaccaaacttactgctactctcgaccttaagtgccttctcgtatgtgatcccatctgattttgggttctttcatctgattctgctgctctttgattagcccattatgtaattttctctatagttaatgaagagagcagagagaactgaacccatcgttaattatgtactccagctaattaatctatccatccttgcaaacaagtagacctactaacaaggaacacatatcctcaactagttcattttatattgcatcatttcatgaagtggagaaaaataagggcagctctgacttgtaaaccagatctcaagaactttgtgctttctttattcagtcacaggttatatatttgcaatgagatgctctggtgctttttactgtagtataatacaactgttaatcagtaatttactaataatataatgattaggagtaactttattatttatttttttcccggctacatcgatcattcattgtactagcatcactcatatttcatcgaaaacactaaaacaagaaaaaaaaggtttagtcactgataaataactattatacccctttgtattttttttataataataccccttcatattctactcccgctaactaaggtgatagtataaataaatttaaactctttaatcaaataagatatagggttcatattgatttctactaagagtagagagcgccgtagcgggctcatcatgaccacatccttgattatctctttacctttttcaggccaaaacatgaactagatgaggacaacatgccagggaaatgggggttagagtgagactagttcacatggacatgagcaattcgtccaattgagacttgagatgaaagatctagcctgaaatcctccccggagatcacaccccaggctctccgttccgcttcccggcgtcgacatgttcgtcgtcgaggaccggggcggcgccgtcgccttga

SEQ ID NO: 53179 - DNA, 1501 bp, Oryza sativa
taaaaaggaagtggggtagaatgaaatcccaataggggaatccaccccgacagaaaaagaaaagacacggaactcatccaaaaaaggattttttttctttttagaataatctaagtttatttacaccatccattggctgttgatccaacggttgatgttcttataaccctaataaagttaaagaccacattataattaggaatccctttgaggatagggtaagatactaatgaaggtacacgcaaatagacgcacgccagagtacgtattagatgttaggtaattcttcagcgtacttttttttttttttgcagttcatggatttttgttgcttgacgaaggcacaacaaaaagcttgatgaagattcaacaacaaaattgaactgttaggccaaagatgcatgtgtttccatggttgagatatacgactagatccagtaggtactgaacgtgggtagtttctgcttctagtcatctctgttttcccgatgcatccaaatccaaatacaacagacagttttgtactgtgcatatgctatccagaaatttgcattgggcctagacagtagactgaagcaaatttgggggaaaaagagttcatggtagttttgggcttctcaagtcacgtacaagccaacatttataagctgactcacaaacacagcattggtaagaacttcagtgatgaactgatgatgtatccgatccaacataggacaatttttttaccgtggtctctagtggtaaaagaaataagccccattatatatttcatctaagtaccatatttgtgtacatcacttaaactcttcgataccacttgtaacaccccaacctccaaatccgcatttatccgatctacatattgagcgaccccatattcacatatcatcgtacttacacttttatgctcccttatgccccattcaacatagcatccaatgaagattaagtatgggcatgcaaaatgagaaagtcattagagcgtgattaattgatttttaattattacatacttgaaaatttgatttatttaatatttgaaggcaatttctatataaatagttttcgcacaaaacacaccgtttaaccgtttgaaatgtgtgctaacgaaaatcaaggtaaaatatatatcttaatcagaaattaataaacacccaccaaaatcacaccatggacacccactggtggagaaaccatctttcgtcggtaggcctaattccacaataatcccggttgcaacaaagaccgggattaaagatgatctttagtcccggttaaaaagggtaacgggcatatttgatctttagtcccgattggtaacctttagtcccggttatttcacccgggatgctatctttagtcccggattcgtagtcccggttgaacaaccgggactaaaggggttactaaccgggactacaaacggtttctccaccagtgacccctacatcaatataaatttacttccttgcttatgcacctacccataccccagctc

SEQ ID NO: 53180 - DNA, 331 bp, Oryza sativa
gcgtgggagatctggaagactggtagggtgtggccacggggatcgggggcagggagggaggcaccggggagtagggacggcctaatgttatacgggactcttgtggcaaatgaaatgggctcctcccatgttgattttggataagttaattttacaggtgtttcactcccttatctaatgttttcattttcatttaaaaatatatatgtttgctaattttacatatttggaatatcctatgtcctcttttcttcaacttcggtttcccacttccaccgcttaaagcttgatggataaagtggcggtctctcctaattatgtttgtccatca

SEQ ID NO: 53181 - DNA, 172 bp, Oryza sativa
caaaacatcatatgcccgtttttccaacaaatttggcatattgtaatgtttgggggaaattttaatgctttatgctttttttatcaatctcatttgataattattgatgtctaacctgcaaaaaattgtgttttaagtccttgcccttaacgccttccctttataactttct

SEQ ID NO: 53182 - DNA, 1501 bp, Oryza sativa
gactttgattatgcgttgatcaccaatttacttatcaccatgactcgcacgaaaaaatatgtactttaggggttaggacaactgaaattgatgaattatctaatttatgtgatagctatttgagattataaacgaatgaattgacttctaaaaagttaaaaagttgtttaagaaaagcaccatttagtaacatggaaagcgtggagcgtgcaaacgaaaattcaaaagatggaatcagggaaaaatagggccttaaactcccttataacactcttatcctatcaagagttctattgatattcgttaatattgtgctcacaattataacataataatttctttcaaccatacgaacaaataatacaaaatccaaatacaacataacacaatacattataattattatttaatcaactctcgatttcagcttaaacagagttaagtgttccacggtacttaattcttctctcgctgcatcaaatctttaattttcttttcatgctattaacaacagcggtagcgctgcagtggttgtgatcacccaagatgtctcaaacacgacactttatcatatgtgtgaaaggcaaaggtgcagacgtgcattgtgcagtgtgccaaaaagagaactttagacattattaacaatagatccgatgatttaaataatgggtccaccggttttagtgtaaatataaattagttaatatatatgttttaaattgttaatttaatgggtacacaacataatggtgatggtgtagattttattttaaaacactaaattattcgagaataatagtccaaagtaattaaaaaaatagatccgatgatttaaataatgggtctatctgtttaattacacatatatattagttaatatagatcttaaattgtttatttgatagttacacaatataatattgtgtaagctttattttaatatattgcattatatgaaaataatagtacaaagtaaattatcttacattattgattttagagctaatttacatataatatggtgtaaattttattttcaaagtctgtatagctaatttagttacctgtgtttataaagagttatacgatggtattttcctttttaaaaaattatgattatttaaacaaatatatatcaaattgtataaatggaaaaaagaagaaaaaaaaggagaaaaatggagggaggcgtacgtactacaggcccacgtgacctacacctatgcacgcgcgagaaataggagaggtgggacccatattatttggtttgttttaagatcaattttatctaacggtgtataatattggacacaccaatttaagtgaaaatcaaggggtggatgttttgtttttttcttaaaatttctaggattttctctaatttattagaacgccacgtggcagcttgaggcatgtctagattcgtagtcctaggatgggtctcatcccatcctaggttgtaacattatgggacggagggagtaatagttagatagataat

SEQ ID NO: 53183 - DNA, 1501 bp, Oryza sativa
gcgcaagaatggatgggtgctgaccttgggaggtgatgaggcggtagaccaggccaaggactagctccactggcgtcgttgggcttgtcccccgtggcagcagcagatccggcctcccctcggcgcgacagcggcggatccggcctccgcgcggcctggcggcagtggatccggcctccctgcccacgcccgagcgccgccgccctccttgttacccgcgcccgagcacgccgcggtcgtcgccaccagagctgccaccgccgtcgccggtggggaggccgggagggaggaggagagaagaggagtggataagaagatgagaggatgtgtggtgttttattgtgaagaagaggaagaggaagaggtaggtgggtgttttaatgtgacatgatatttgtggttgggtttactctagcggttttatttattggtcgctaggaaaaattcgaccgccagcgaaaattatctttttttttgctggcggcgcacttaattgaccgccagcaaaaatagacatattttcgctggcggccgcattagacgggcggccagtgaaaatttattttcgctcgcgattggtgcccctcacccccttgttacgagtttgctgacggttttcatatttttccgccagcgaaaatgataggctaacaccatgaaaaatcgtttttctagtggtaaatatcccatctggtcttaggttcttatattttaggacggagggagtatttgatattttaaagcaatgtatcgtttaataatttaaaaagtgtgctaacaaaaaccattgtaaaatctacatgttaatcatcggaaaagaacagtgtaattgacccaaattaagagcagcaggtcagggaattaaagagtagtggagtacattcctgttcgtggcgccatatattatggtctttgtttgggcagaacggttgtatgtgggccgggcctttacaaaagctgatttcccttcctcgaggaaaccttaccgggccgaaccttgggcccacacgacagatcgtgacagccgagcaacacggcccagagcccgtgtccccaccgagtcaccgacccgcacctccctgggccccacctgtcatccaccattccccatacccgtccgtgtcacggagaccgccaccgaccccaccacctcgttaccccccgccgtgctcgtcccagtctctgccacgtgggccccacacgcaccacactatttattcctacacgcgaatccgtacgcgtacacttcgactcgacgcgtattcccctcgccgccgtcgccgactcgccgtcgattcgccgccaccgttgccgccgcttcgcgcctagggtttcgtcgccggccgccgctgtatgagcagtcgccccatcgtcgccaacctggaccgtcaccaccaccaccaccgccccgatgtcgtcgtcgaggaagaccgcgggcccccgcggcggcggcggccgccgcagggacgaagaaggtgggtagtgggccgagccgggtgac

SEQ ID NO: 53184 - DNA, 715 bp, Oryza sativa
cggttttggaaattcatttagttcgcaagcaccgacccaggtgtcgggttttccaagtcttttgtaaaacccaagttttacccatgttgtttttcagattttaagtttgaaggcgtccgctgatactcgcactaggtgcgcgaatatcgagacgcaactagatggttgcaaagggacatggtatcacaattaacaaagaaaggatcaaatgcaacaaattaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagctcgatcctcgaaatcctcgcactgcgggtcttcgggctccgaaactacacgtgaaacgggacaactcaacaaacggcgaaaataaagccctattaatgacctcgaagcgtgccattagatagatctcaagatttgaggaattttggaagttgaacggagtcaaacggacttacggttgggaagatattgaatttctaagattattggatttttggtctaaaggaaaaggatttaattaaatcctttttggaaaataaaagaaaagaaaagaaaagagggagggaatatagacttttctcgggcggctagggcgcggcacgagagaaagggcggctcggccgggcttaa

SEQ ID NO: 53185 - DNA, 312 bp, Oryza sativa
gggatacataccgcatacgggttgcagaacgcagatagtactaccagcacagcgcatcgcgatagataaaggcaagcaaacaagggatggtccaaaccgagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaaga

SEQ ID NO: 53186 - DNA, 1501 bp, Oryza sativa
aggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccacacgacattactaacccggatcacccagcccgtggggatcagccacgttgggagacctccaagctttcattacaaggcatttctaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgtttggatgaaattccaaggaaacggtctttaagtgcaagagcggaaaaccgtacacccggtacgttccccggtccgcggttttggaaattcatttaattcgcaagcaccgacccaggtgtcgggttttccaagtcttttgtaaaatccaagttttacccaagttgcttttcagattttaagtttgaaggcgtccgccgatactcgcactaggtgcgcgaatatcgagacgcaactagatggttgcaaggggacatggtatcacaattaacaaaggaaggatcaaatacaacaaattaggtaggtctaccaatctgccttgcagacgggacaacagattaagtgtgatcctatcaatgcataatatttttcaagcaacataattaaatttcaaatataggctcgagatgttcaaaggtggcttgccttgctcgagatctggagcttgatcctcgaaatcctcgcactgcgggtcttcgggctccgaaactacacgcgaaacaggacaactcaacaaacggcgaaaataaagccctattaatgacctctaagcgtgccattagatagatctcgagatttgaggaattttggaagttgaacggagtcaaacggacttatggttgggaagatattgaatttctaagattattggatttttggtctaaaggaaaaggatttaattaaatcctttttggaaaaaaaaagaaaagaaaagaaaagagggagggaatatagacttttctcgggtggctagggagcggcccgagagaaagggcggctcggc

SEQ ID NO: 53187 - DNA, 1501 bp, Oryza sativa
ggctgcagaggcagcaactcttgaagcaacaagtaggagctcgaaaggaggacctgtatgatttttttctcctgtttctctcacaaagcttaattctagtattctatttcgatattctggcaagcaatactctgatagttgtgaacagttatgacatttggaaattacatcatacttccccattgtaatggatgccaaaaaaaagtgccctatagtctgaagatcaaaatgcaaaacatatgctgaatcaatcagtgaatatatatgcacttgcaaagaatacaaatattacaaaagagcatgcaaacatgaaagtcatgctacatatatcagtgacatgttgaatacaccatcacctcacctcattttataagagtaaaagatgatgtcaacaagtgcaatcataatcatataaaaacaaacttcttgaggcacaatattagagcaattttaggtgcccatagatggatatcatgtttcttcttgaagttgtaatattacattcgagtgtatggtcaggttgatggcctttgatattaatttcttttttcataaacaatattgctggagctctcctgttaattgaccgtgtgccaattctttccaatttccctattcattcattcattcattcattcattcattaatggctaaatattctagctcagacgtgttttttatttaggttgtatttttaaatttgataaatattgaagtacctatacctttgatgtaagaatatttcctgttcattgcttgccttcctaatgatttgatggaagaatttattgtttatctcaatttctttttgtcataacttaaaacaaataaatagtgttacccgggaggataattttgtgaagacaattcgaatttgatcttgctcctttgttgtcactctatctggctgctcttgcatgccaaggcagcgattctcctgtccagctgaagctagcctgttacttttagtccattgtcctgacttacttgaagttgtggttatggtgctatttgtctgccagcgggtgactacacattaatgactaattgatgacttgattatagtcgattccatgaaagcatgctgttttagtggaaaacaaaattgtggtcctggggatatttgtccatttgaagttattgttctgtctgtagctctaactgtgatgatgggaaaaaaacaactttttttttttggattatcctttgactccatgacactaagttttatcatatagtacaggtttaaagtattatagcatctgaacatgcactttgtcttaaactttgtaggtcaatagttctaaaaggttagctgtgaaagttcaagttgggttttggtgtttctggatgtccattactgtttttaatacctattatggtttctgtcatttctcttatttgtctgttcgattgtttaatatggattacacacatttttgttgcttgttttttgatagtgcttgttggatgctgcaggtaccagggagtaattcatggc

SEQ ID NO: 53188 - DNA, 365 bp, Oryza sativa
tacgtatatgtttatgccggcctctttcatgtataggtaaacttagttatgtccctaatgtcaatggcaatagtcatagaaaccatttactgcacttcctttgtttctacctacatatacaaagtcatcgtgactttgcttatcttcacacatattgcttacatatagtcatctatttgttttttgtaagttatatggatgttccatccacgtggcacggttgattcctaggtgcataaagcctagcaagtaggtttaggaggcaatggtaacttagaaatctctttgtgaagggaatgaagtactgcgatactttatggtttagcgtgacacgactccgatgagaacgctagggcaagcaacga

SEQ ID NO: 53189 - DNA, 598 bp, Oryza sativa
aattttgggacgaaattcaaatgttaatggtagctatatttggggatggagagagtactgttctctgcgcctactttcctaccaaaggcatctccatctgctagctctttcctaggattatgtaacgatctgtttatcatctataataaaccatattgaacactttaccagcaaaagttgtccagactcttcctttatatgctacagaatttttttttttgtcattgccatcaccacactgttagaaagctgtaagagagaaaagcctttacgttttggggaaaatcccctctcattcttcttcacctagactcctacaggatccccccccccccttttgccccctgttgctgcatgctatacatccatggatgatgcaccttttcctcagaatttcgtggtgagcattacgttcgtgcattacttccatagcaagatttgcacggttgatgatatcagcccaagtataaataacgcgaccttggctatcaactacagatggttgaaattgaacccatttagattgaaagccatagtcctaatacctaaagcagtgaaccaaatctctacctagttgacattgataacaacgatctaa

SEQ ID NO: 53190 - DNA, 1501 bp, Oryza sativa
aaaatacgccgcctttgaagcaattccatcgtgcaaatacctcgtcaacacctccaaaacagcctataggatccacccgctccgacttccgattgaaacgccatcaatctagtcgcgagctgaagccgacaagtcgcatgccgtcttcccagccgccgaacgacccgagcgctacgtctagccgtctccctgtcgaacgtagctcatcgaaaggcccgggccaccccgcccagagcgttcgaatccaccgatcgagaacgccgatcgcctccagcttcaatcaacccgagcgtgcggccgcacgtctccctgtcgagagtagctcaccggaaagtccgagccacccgcccgaagtgtctgacccaccgattggatcgccaatcgcttccgccgccatcaacccgagcaccacgtctagtcatctccctgttgaaagcagccatcgacggttccggccgctgccagaagtgttcgatccaccgatcaagactccgttgatctccgccatgcttcaccttgcgccaatgcccctccgtgggcattacagcaggctacgcggtgtggagcacctccatcgcgcctctaccatggacctcatgtaggctctgataccacttgttataaaaccagccccgaaatcaacatcgttagctaaacgcggaagaaaacgtcataggagatccaaaacgatgacgacaccgagacacgatatttgttaacggagttcagtcgctccctctcgctatgctaagtcgccatgcggttacaacaggcatgcctctctatttatgagagaaccttggatagagtccgactcatactctagtcctaatacctattacaactcctagtcctaaactgtaaccgactatgtacacatattcgacacaaactctaacagggatgaggagcgagtttttcgttttttttgtttttttccctttttttcgtttatgttcggttggtttttttcaccggttttttcgtttctgtttggttttttcctctggttttttttccgttcggtttgttatttttccggtttctcttctgttcggctttttttcctttttttttcgagatgtataaatatcaagtttgtattcgtatgtataccaagtttgtattcgtacatatagaatgtttgtatacgcgtatataaactttctatacgcgtatacaaacttttctatacgcgtatacaaactttctatatgtgtatataaacttgtatatacgcgtatacaaactttctattcatgatgtatttttttatttatttttatattttatgcgtatataaactttgtgtatatgtgtatatattttttatgcattgaaatatatatatatatatatatatatatatatatacacacatatacatatatatatatatatatatatatatatatatatatatatatatatatatatatatatatatatatatatatatatatatatatatatatatatatatatatatatatatatagga

SEQ ID NO: 53191 - DNA, 1501 bp, Oryza sativa
tgaaaaaaaaatctatataaaaagttggttaaaaattatattgatttattttttaagttttttacaactactccctccgtcccaaaataagtaatgttttacactgttcacgtccaacgtttaaccgtttgtcttatttgaaatttttttatgattagtatttttattattattagatgataaaacatgaatagtactttatgtgtgactatttttttaatttttttataaatttttcaaataagacgaacggtcaaatgttggacacggatacccacggctgtacttattttaggacgaagatagtaatacttaaattaatcgtgctttaataagctactccatttttatgtgcacgaactagaagatccccaaccttccttatagttcgaacacagccttaggcattctattattgttgttactatgcttttgaacaaacaattatttgagtttatgtattgcaaaagtaccaacaaggcattattgaaaccctactaataaacgtgttgaaagtgcatttagatcccccgtgggttttggcgaattgatgataaaacaaaacgtatctattgtgtttaatgtttgtacgaaagattgaaagtgtattagttccatgaagaaattaatgacgattggtgatcttgaaaattaaaaaagacaaaaaataatccaaatttaaataagtctttggttagagtctaggaataccatattatcaagacgagtgatgtgtaggatcgaatacaagaaccaagcctaccagagaagggcgaatggttgaaataccaaaaaccaaattttttataattaggatatcggagaacactgttcatttgggccgaggcccttgaagtgttttcgacccataatttcaggtgtggtctgtcacattctcctagagacttaggtgtttttttcttagacaaaaatacgcatgatcaagtacctaataccttaaaatccttttttatataccgcagatatacaatgttttaggagttgatacaatgtattttaaaaggtgcctagcaatgaagtttttcataactgtcctgctgacttttttatatgattataagtcaacacactgcttaggttatattagcaattgattggatacaatatcattgcttattgtcacgtaagtgcatatttttattaatcaaccttatggcttaggttgaatatatgtttggaatattttttaataaaaagcagtcgatatatcacttgagttatattattcaaggatttacacaatatgtgttgtataatattaagtcattttgatgactataattgttataaaccactcggttggttattttattttatccttgactatatgtttagtttattcaactaatctcatagtcgggggctacacctaattaggtgtatctagtcgatgcacctaatttttatttttcagcccttcacaacctactagggataaaagcactcgggagattgcaggaggaagaattgaagcattcgg

SEQ ID NO: 53192 - DNA, 1501 bp, Oryza sativa
ggccgcgagcccgccgcgagcttccccgggtcaccggtgaggtcgcacgacccgttgtttgcgaggagcgacggcgacacgaggccggaggagagcagcctggcggcgaaggcgccggagcacgcggcggcgggctcggcggggaggaacgcggcgccggtgcggttggcgtggtcggcggcggcgaagatgtaggcggcgaacacgtaccagcagcagccggtggcggcctggccggcggtggcgttggcgtagcactcgcgcgggatcatccgcgtcgccgtggcgaggtcgtaggggcacgccgtggggcctctcgccggcgccggcgacgccgccgccacggcgagcgggaggaggaagacggcgaggcgaagcatctggcggggtggtggtgaccggagtgagagggggagagtggcatcgataaatgcgagcgggtgggagttttttttttaaaggtggggcccacaaagtgatttgacgatttgacccttggagtgtattgcagctacagtgcaaattttgattatgttgataatctctttttttaaaaaaaattaatgatagagaattatagagcctgggactgggagatgatggatctcacaaagcatccatgtttagaaaaaaaacatcaaatatttttgaagttttgtccacctaaacatggtatgtaccaactagggagtgaactattgacgtcaggtactattgtgaagtgttatatgtttggaaatctcgaataaagtaagtagaacatatgtagcttgaccagaaaagttgtgaagggtaaaatatctttatgccatggaaggaaccaaaattatagctcacctctaagatcaactacagagtacctccgttctaaggccctctttttttaggcttattggcctaaacttttaaattagcttattggcttatatgatttataagccggtggatttaatatcctaagtttagtggttgagtcatacatctacctcacataagccaaaaaagcttctccaacctagcttttggcttaggccctctttgtttaggcttaggcttattggcctagacttttaagtcagcttattggcttatatgatttataagccagtggatttaatgtcctaagtttagtggtggagtcatacatatatctcatataagccaaaaaagcttctccaacctagcttttggcttaatagtgttagagtggcttatggcttcaaaaaaagccaaatgaaaaagctgcttgtttgttttgacttagacttttcgacttataagtaggcttataagcctaaacaaagagggccttaatagtgttagagtggcttatggcttcaaaaaagccaaacggaaaagctgtttgtttgtttaggcttatacttttcgacttaaagttggcttataagcctaaacaaagagggcctaaaataagtgcagtcatggatatccatgtccaatatttgaccgtccgtcttatttaaaaaatttatataaaatt

SEQ ID NO: 53193 - DNA, 1501 bp, Oryza sativa
caatgaatgttatcaacttctcattacaagtttggagaaaaatccagaggtatatgttgtccgatactgttgcagaacaatcaccgctttttcttgcttatcttagttttttagcattgattcaactcagaatataacgtgtagcattttggctcactcttttgctctaagtatttgagtacgggacacagtttattccaataaataatgactcggttttgctgttataattaacgcctttgttagataaagataaatggtgtaactgtgtctattgagtattgactattgcatgcaggaacggaaaatatgtagtattgttatttcccttggtaagaaacatgggaccttttgagccaatacacctaaatatctgaaaaaagaggtgtttctccaatacttgctcactcccagttcatttacatttttaatgctatctagaattatgttgccagtgccacctgtacgctgtgctctggtgtgtgcgcgcgctttgctctaactctttgctgaagtatcaataaatcaaatgcacattcctttttatcttctcataatatccagcagtcaatgtttattaagctacgacgcataattctggatttgtttttacttgtttctactttattgtgcagattttttgtgtatgaacttgtcatggtcatgggtatgacaatggagcactcagtatcaatctcaactttcacttggtagcagttcattaaccagccggtagtaagatcaaggtgtgccaacgacctcatcagttaatgagaaacaataagagcctgttcggttaatcctgatgtggccttcaaattcccccgatccacatcaagaaactcgaaccctggtaaataaacttaattttgtaacagctggcttctagaaatcatatatacacagaataatgtctacttaatttttagccatatgcaacctaatgtaagtttatacagccaagaaatatgatcaagtctaaaaggaattcgacaggcaggagtgggttttgcttgcttatgtctcgggctgtaccgctttaattttgtttgctctttagcttatcaaccgtaactaaattttaaattttaaaacttaattttagagttagtattaatggttttttcatcatgatttatttttcaacattggaatttaagtaccttaagaacatatataaaaatttatttacaaattagtttttacacgctaataagcattacgatttataatcaactatcaactaaccgataccaatgagactacatcataaattagtattaggttggacagcagtaataggtttctcaacttggttaaatagctctcatgttcaattacatataactaactttgggatttgatgatttaccactctttagaccagacattgccatcctaggcgcatatcatcgacttaataggtcacacgtgtcattatcatgggatgacagtggctgtcatcaaaaccgccatcaaagaattgtcattcacatgtata

SEQ ID NO: 53194 - DNA, 1501 bp, Oryza sativa
gggggcatatgccattactactactactactacaatctcagaaccagtcagtgtgagtaacaggtatgtttttctttaccacaagccttcaaatcatcaaaaacttcatgccacctaatgcaccatgtttttgttttagcacaaggtctgcaactggttccaatgatccagtaccactacaatctgtgttcctagaaccttgccctgatgagaccactcaacaggagacctaggagacccggccactgcagattgtactgccgtaggcttcactaagaatgaagatatgcatcagcaggaaacttaccccaaggaagcttacccaaagaaagccccaagctgcagccactacatcaagcccagacagccctgctagaaataccaggagcaagaagctccaggtgtagtaaaatgtgcttcttttggtctatggttcttttaatccatggcaaaacttttattttgttctatgatagtgaaaaacatctgccatgtgatgaaaacactctttttttggtctcttactttgccatgttggtatgtggatgcaaacaagtaatgtattttgctaagtcatgtctgttgctaacatctggtactatcatgtagtgctgttatgtgatgaaacagctaattaaaggatgaaatagctagttatgttatgttgtttcatttgatgttgttatgtgctaacatttggtgttgtttcaacctggccatttatactttcaccattcttgattgaaaattcattcatccttccatacatccatttatccatgactactcatacacacacccaactacttcttgaaaatagcatacaaagtaagaaaaatgcaaacatagaccatcttttcaagccacttaagctgctgcatcaccctaatgtccactccagtagcttgatcttgcctgataggcagtggagtagtagggaaaccaccaggtggtgccactgcttgtaggggaactgtatgaattggagcaggggcatgaggtgtttgcactccagtgtccaccatttcatcctcccactgataatactgacatcctccaatctgaatgccaaaccatcaacacattgtgagcaaacaacaaaagaaaaacccaaacataatatgtgagcagagaatgaaacacaaactgcaaaataagggcacttgtgaaaggcacggttgctgttcttttctgttgtcgagatgagccggtttgcaagcacatggtagttgagctaaaataaacaatttctttggtcgatttatttaatgatttttttaaacaaggaaagggaactccagggcgtgacacgccaacagccctgcctttgccaccaacatcacagcctttggtgccaaaaaatacatgcatgtgcctgcctccgaatggcacataaggaaacaaacttcatcaaatggcatttcaagcctaagggcaactaggtcatttcgcactgccgttacccaccgttacaacccaaaacggatgaaatggcatggag

SEQ ID NO: 53195 - DNA, 291 bp, Oryza sativa
gccgacatgtgagacccctgcaccgacgtcccccgccgaacagccttagtgcgccgaagaccgcgccacactcaccgacagcacctcctcacacctagatcgcctcctccaccgccggccgcgcctctctgcaccaagccggcctccttcaccggacgcgcctctcgcgccaatccggcctccctccatcggccgcgcctctcgtgccaagccggcctccatctctaccgcccgcgcctctcgcgccgagccggcctctgctgccatcggctgcgcttctctgcgccaagc

SEQ ID NO: 53196 - DNA, 1319 bp, Oryza sativa
tggatccccgtttttaaatggattaatttaatttttttaaacaactttcttatagaaactttttgcacaaaacacaccgtttagcagtttaaaaaacgtgcgcgtggaaaacaagaaagagggttaggaaaagggggcatccgaacacaccctaagtagactcgcataaatgactttgtatgaaagacacgcctcaaaagtgcacattaactcaactgttccaaggagtaggatctgcatacacacatagcatattgcataggtactatatatgaactccatcacctggcttcgttcgtttcagccacttcccaacccctctctatagttcttcacacgcacgcttttcaaactgctaaataatatatttttttgcaaaaagtttctaaacgaaagttgcttaaaaaaatcaaattaatctattttttttaaaaatagctaatacttaattaatcagacgctaatggattgctccgtttttaggagatgggttcccaacccccaataacgaacacagcccaatttacaccacatgggccacatgcacctccatttacaccactactagacaagctccaaacaacgtgaagtgttaggccctgtttagttggggaaaagaaaatttttgggtgtcacatcggacgtttgaccggatgtcggaaggggtttttggacacgaatgaaaaaactaatttcagaactcgccgggaaaccgcgagacgaatctattaagactaattaagccgtcattagcacatgtgggttactgtagcacttatgactaatcacggactaattaggattaaaagattcgtctcgcgatttcccccataactgtacaattagtttttctttttatctatatttaatactcatgcatgtgtctaaagattcgatgtgatgtttttgggaaaaactttttggaactaaacgggccctaaacattagttgagatgaaagaggaacgatgaaccatgattggttactctctacctctctactactagtagagcgtactgtagcgaggctttgagtgtttacctttgccattaacacaaattcctcagttcaaagcttcatgaatcaacaacttcaggatagatttcggttgcatttatcacagcatgcctagctatgatgaatttctggttatgaaagacatggttaatgaattatatttgtcccaagataatgaccaatgtagttatatacgcggaggcatgaaatacacttctcagaaattctatgccctcaatttcagaacagtacgcggaggcatgaaatacacttctcataaattctatgccctcaatttcaga

SEQ ID NO: 53197 - DNA, 1501 bp, Oryza sativa
gaacaggcaactcgatttgcaaataaagatgtaggattgaatcagcaaaaatatcacagatggggttccgtaacaagcaaacccgagttgttctaatcgatgacaggattacacggaaaaataccaaagctaaattttgatctaaacaaaacccgagttgttctatggtggccaagggaaatataaaggcgggaggatgagttggaatcgtcctctaactcctaaactcatccaagcgatttctagttgattttacacaattaatagcattgacaatgtcttgatcctttctttgtaaagttacagacaaggtgtttgcgattgccaagatattcaacataagctgcaaataaaacacaattttttgtcatccctgtcattctcttccatatactctagaactttaactattgtagggaacaattgaaccaaactctttagtgtctcatagtgagagctccaatgagtatctccagacctctgaactagttataagtaacccacattctaaagcatcatgcacatgttctgcatatatatctcgaatcatatcccttcttttgaaagatccaccaaccacatttaataaaagagaaatcatatcaaaaaaagttcccgattcctttatgcttctttacaatggtcacaactactagctgaagctggtgtgcaaagcagtgaacgtaatatgctgagctattttctctcataattagtgattgcaaaccattgaactcccctctcatgttgctagcaccatcgtatccttgccctctcacttgtttcaaacttagcttatgctccgcaaataaatcatcaatagcagacttaaggtacatagatgtcgtctccttaacatgaacaaggccaactagtctgtctttaacactgccacatttaccaacataaggcaggaccactgccatttgttccttctaagacacatcccttgactaatcaaccagcaaacagaaaacatcattcccaacttcttcaagaatagaacacagtacctcttttggaaagcaacatatgatgttattttgaatctatgaagatgtatactgactattactattaccaggagcatttttacctgcaaccttgtgtaaagcttccccaaaaaaaattgtgtaaagctggattttgctctgcggtataagcatgaaattccttgaaatttcctttattgagagacctcctcactctcatcatggccccgaaaaggcataccttgcttcagtaagagtctagtaacatcaattgagccatttaatcgagtataataagcaattttctcagcattactttggctgttcaaagaaacatcaatgtgctgctcttttttcaataaagcatcacaatccctcattgcttggttatgaacactatcaatatcaccaacgttagctaaccacttctcactggtcactgccaaccagttattctagtgcaagcagtaagcagcgatgcagcatgtggacaaccaaaaaaaaaatga

SEQ ID NO: 53198 - DNA, 1501 bp, Oryza sativa
ctcttcaatactttagtacattgtaggctgtcaggtatgccattttactatcaaatatgtatattgatgcttactttttgttttgtaaaggttagcaagatgaagagtatgatgcggacatgtataatcatatttgctgccttgagattcaaatagtagatttgactagattatcaaagagcttttgtccattgatattgaaaaagaaaggctttcaaccaattaactaacttcgtattaaaatagttttccaacatgaccatatatatttaattgtttaatagcacattgatttcgtcacctatccctactcgtgttccatcatctgttcaagtacctgggtttttacctcatcagtgaatctgcctagaatggttgattatcctctgttttaaccttgattctctctttatcgacagtgcatcagatttccatctcaaactttgtactctatgcaaactaatttaccattttaatcttcttaagagctaactataatttatttggttgtggcagtcaaactaaacaagactatcttgtgttgtggccgacaaaatactgaaatcttaatgtttcctctctgttgcagtttgcgttccagtcttacagcgttgacgatgatgactatgaaggttacaactatagtctgattgggcaactttctgctgtgcgaattgtattcctttatcgttttgttcaggaggtatgtgttacacttgcaagctgtttgttcttgttatccatgaccatgtacatctttctgaaagtgccttctattttgcagttcacctcttacttcatggagcttgccacccctcacactgaagaagcaatcaagttcatcgacaaagttggaggtttcgagtggttgattcagaaatatgaaatagatggtgcttctgctataaagctggatctttcacttgacacacccataattattgttccaaagaactcccagagcaaagagtatgcccttatttcaattttccagtacatgtgtttggttttggttttattagttgatttagttctttaggatcaggtagataagaaatttcctgtttgtagtctaaatctacaccatatattgtaggtgtgcaattctgaatcatagtggagaaaggcacatggttttgcattttgtgtgcacatttcttatacctgtgtctacatatactaatttgttcattttagtccgcacttttttattttgattgtgggcaagtttagtgaagcataatggtgatttaataatacttagaaagcttgacatcaccttcatatcatgctgcagctatatacaactggatctgggacaactgaaagttaggaatggtttttgctggcgtggaggtgaagagagtgatccttctgctgtacgccttgatattcttcaagcagaggtatgtattggaatggaaaattggtcactttactaatctcagtatgcttatctagttttcttattcttctgcttcaatgatactgaaatagatta

SEQ ID NO: 53199 - DNA, 1501 bp, Oryza sativa
aaccaaacagggccttagcttccaaatgttccacgcaaccaacaataatttctccatacttaaggatgtgtcctaagttattatttccacaatattccagcaagcaactgaaaaagggtattggaagaacaaccaaaaattagtgtctctagagcttgatgactacagaaaacacatgccaaatcacaatctggtggagcaaagttcttatgatccaacatgacatgggctggggttcagtctatccatcaaaaggagtcataaaaaaaccttcaattttaagttacacttactcttccttatccatataaggtgttgtggtggttgactgttctgaaattgagggcatagaatttatgagaagtgtatttcatgcctccgcgtactgttctgaaattgagggcatagaatttctgagaagtgtatttcatgcctccgcgtatataactacattggtcattatcttgggacaaatataattcattaaccatgtctttcataaccagaaattcatcatagctaggcatgctgtgataaatgcaaccgaaatctatcctgaagttgttgattcatgaagctttgaactgaggaatttgtgttaatggcaaaggtaaacactcaaagcctcgctacagtacgctctactagtagtagagaggtagagagtaaccaatcatggttcatcgttcctctttcatctcaactaatgtttagggcccgtttagttccaaaaagtttttcccaaaaacatcacatcgaatctttagacacatgcatgagtattaaatatagataaaaagaaaaactaattgtacagttatgggggaaatcgcgagacgaatcttttaatcctaattagtccgtgattagtcataagtgctacagtaacccacatgtgctaatgacggcttaattagtcttaatagattcgtctcgcggtttcccggcgagttctgaaattagttttttcattcgtgtccaaaaaccccttccgacatccggtcaaacgtccgatgtgacacccaaaaattttcttttccccaactaaacagggcctaacacttcacgttgtttggagcttgtctagtagtggtgtaaatggaggtgcatgtggcccatgtggtgtaaattgggctgtgttcgttattgggggttgggaacccatctcctaaaaacggagcaatccattagcgtctgattaattaagtattagctatttttaaaaaaaatagattaatttgatttttttaagcaactttcgtttagaaactttttgcaaaaaaatatattatttagcagtttgaaaagcgtgcgtgtgaagaactatagagaggggttgggaagtggctgaaacgaacgaagccaggtgatggagttcatatatagtacctatgcaatatgctatgtgtgtatgcagatcctactccttggaacagttgagttaatgtgcacttttgaggcgtgtctttcatacaaagtcatttatgcgagtctacttagg

SEQ ID NO: 53200 - DNA, 848 bp, Oryza sativa
tttgggacaaatcctgagggcaaagttgttatattttgggacagagggagtacttctccacctacttcctcatctcaactaatcacaaccatttctcatttaatttctccacttactttctcatctcacctcattttattttatctttctccttcattactttctcatctcacctcattttgttttatctttctccttaacttgcgtctaactccaaaagtccttatattttcggtcggatggagtatgtagtaatgttagtgattaagtctagcgacctgtccgttctctcctcttgtctgggtggtgggtacaatgagatccaatgaactagtaaacgagagaagatggtaaaatcaatagctacttcctactagttcttgatcaagttctaaaactgccagatttaacaacgatgtcatacagtgatgagtcacgcccatctggagatccctgtagtgccgagcagtggaatgtagaactgaagtgccaggaagaagttgataaaccatcgtgcagagaagtgcacatctgatcctggcaattatgagtcaagtaggccatgtgccaacaatggagacgaggaagcagaaacaacaaaatcagtcaaagaagacgttctcaccatggtatatcagttttagtagcaagaagaagatgatgagttggatcaggtgggccatgttatagctagcgctacacctaaggaagtttaacagtcaaaagctcgggttggggtaccattgtcttgacaaaatctactgaaggaatacttagttcttttgaagtgttgccgtataacttgttttttattccctttttgatctgagcattgttccatttgcagg

SEQ ID NO: 53201 - DNA, 515 bp, Oryza sativa
aacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgccccatatgagtgtcctatatatatatatatatatatatatatatatatatatatatatatatatatatatatatatatatatatatatatatatatatatatatatatatatatatatatatatatatgtatatgtgtgtatatatatatatatatatatatatatatatatttcaatgcataaaaaatatatacacatatacacaaagtttatatacgcataaaatataaaaataaataaaaaaatacatcatgaatagaaagtttgtatacgcgtatatacaagtttatatacacatataga

SEQ ID NO: 53202 - DNA, 1501 bp, Oryza sativa
tgggggcggttcagcccctcgggcccgaggggtatgacaaggtaccccaagccccccgcggggggggggggggggggagggcggccgcttcgtggccgaacgcgcgttcctccgaggggcgttgggcctgctgggcgcgtcgcacaggaagggcttcccttttccctagccaggtacccccaggcccatataagtgacaatgtgtgttttgtgttgcaaattttattatatttttctataaatttgctcaaatgttaaaacagaggaagtatttgttaccagcttttaggaagactttctctcggtggttatttctactcatctctctccattttttcttaacaatttcaccttcgattctgtctttgcaccatctagcaagcgaacgtagtgccctactcattttggtatattgattcaacgcaggtttagacaggagaacaatccagttttttgggggcaatacgctgcttaattagttgggccaaaaatgcgtggcgtgagcttgaagagcgaacacatcttactcgggaatgaaaatatcacagaaaaagtgaaaggcatgcatgtgggatccctatgcacatgagctccttccacaagtggtgtcggaacggtagctagctagatgcgtttgtgcgagcgatgcttcacccaaccctcgaccttgctttgctactagcccaactgcaccgccacagcccaacctcgagttgtacactgaagctctaagctattagaaggtattatctcttgttttaaggattgtgggagcttttacagtacattccactaagtagtcagggacgaagccacgtgtgaggcagcttgggcttgggccccacacgtgacaaagaatttcaatggcaaaatatataccaaaatttagatagaaactcggtgaaaattttgaaacagcatagcttggtcctactctcggtgaaatcttgcctcaacccctgcacgtagtgttagtattctagtagtatgattaaatgtacacacggttgatttacattagtatttacattggttgtgtttcgggtcttcttccatcggttgaagctggggttatgtgtgtgatcattcctccttgccagaattcacctaaggaaatcctggtcatctccaatatgtgtgcaatgattgatatcgagcgttcactgagaaggttgacctttcgttcctgatgcttactaatcatgtcatagagaaacaaatgtgatggtcgaagaaaagagaagaaaccacaaagtaaagctagtattcaaggaaggactaataaaggaagcacatctaccatattcctagtgacttttaaatctgcctctggttcttaagcaaactatgcaaatgccatatttgtccacatcttgcatcttgatgcaccatggtggaaggtaccaccaatattccaccggcaggtgtaagtcaagaatctaaacataaggtgctgatgtgtcctgtcccacagaacaaccaaactctcatgttccgacat

SEQ ID NO: 53203 - DNA, 1501 bp, Oryza sativa
gacagggagacgtgcggccgcacgctcgggttgattgaagctggaggcgatcggcgttctcgatcggtggattcgaacgctctgggcggggtggcccgggcctttcgatgagctacgttcgacagggagacggctagacgtagcgctcgggtcgttcggcggctgggaagacggcatgcgacttgtcggcttcagctcgcgactagattgatggcgtttcaatcggaagtcggagcgggtggatcctataggctgttttggaggtgttgacgaggtatttgcacgatggaattgcttcaaaggcggcgtattttgtggcatatggctgaacaaagcctagggcgaatagagcagcatctagtagcggttcaaccctggagaggttttggttcaacctgtttttccctctagcagacaagaagtaaaccacgtgggctgtagatcaatgacaacagttgttggtggagtcgtcggtggtgcttggcattggtgctagatgttgtcagagatacgaagaagcccaggaggtcagggtcgcggcggtgtgcgcgtcctgcgtcgaagccgagccggcgacggagatcagggcgatgccgagaaggagctggctagggttttagctaggtcgtgcagggttcggtcttgagggtttgtggtgtggaagacacggacatggagtcgtctccggttcggtcacggcgcggacacaattgaagacaaacagtggataccaagtttcaacacgaaggggaatcggacgaggactacgattagttcatgaatcggactcgattttttcccaaataaaagcagcagaggaccacgggattgcaacaacgcaatcgaaacaaatcacctagcagagggcgagattcgtacccgattttcgcaaaggcggaggtggtttgggcggcgaggtcacgggtggctggaggcgcatccttgcaggcggtgtgtggcggcgtggtactcggcggcgtccgtcggagctcgagcgagagcttgcggcggcggctgcggcggttcccgacgaagaaccggcgtaggtcttcggtggcggtgctcccaaggcggcgcggcagcctcttgcggggccggcggctccccaaggtccggcggcgcggcggctcctcgtgggtcggcacaggcactagacggcggcgggaggcgatggtggtgtgcggcggcgcaaggcagcggtgtgcggcagcttcggcaacgaggcggcggcgcatcgggtagggcggcagcgtgcgcaggagggaggagcgaggaagccgaagagaaaaggggatcggctcgatctgagccggtctttgaccgctgttgtctggtggttgaccgagtaaaggagaccgagtccggttttttggagaaagagaaaaaaaactgattcggtccggctggtactgttcgagttagtcggtggggtcgattgaaccagggcagatcaatttaacagggcaacagctattgagttgattatcgtcgatggcggcaa

SEQ ID NO: 53204 - DNA, 1501 bp, Oryza sativa
atagcaggcaagaaccgtaaaggactccgtgctagcactaccggagaactgatatttcatcgttgtaccccaaaacacaactatctttgataactagctttccatccttctcctactttgcttctggtcaggtgaaccatcatccactgccccatagctgtaggagagttggggggcatctgtagcaaatgctataatctgatactaacatacccctctaatctaaatttctctgatgcctcctacgcgcactaagttcatatatatgaatatatgaagcctctgcaccgtgtgatgcacacatttagattgaattaggaattaaaggacaatttatttaaaaaaatgatgtgtttgtctgctcccatcgggcaacacttgactgatatagccgatattgtccacggaggctttcttatttgcgcaaatgccaatttttcatgcctctcacacattgccaccattggcatggagagaaaatacataacagttcaatactttatcttcttcattctctgatatctaaatccccgttgcctcctaagcctaagcctaaatagaacagacattcttgtaggcttagagtagagcaatgagatgactttgtgagcaatgggagaagacgagcaaagtcttgctggctctatgtaggccaaaatagaaaaataaaataaatggtttcaatatttgccatcaatgtagctattttttgagattagagagaagacgcataagcacatacacattatcccacatctaaacttctgtgagtcattcctcttaaataggcataacacacatggacataagagaagggagatagatctatgaacatcacaaaatttcaactcaagtataacagagtcacgtatgctttgcatggtgtacagtaatatgtttcttatggaaaaacacagttttcagaaatactagtaccagataaattaattgtccactagctgctctctttttttgggttcatgaatgaactgaaaaaggaagaattgtggctcaaagcaaaatgtacacacagacaaacgaatcacatgaatataatgctcagtaaagcaacattatattccaaaagagaattgttgatgtttggattgaatggccatccaaggttttatttaacactccatttttgtccaaagtaatggcttgaaaatcaaataactagaatcagatacaaatgttatggcgttggctgccagttgaatcaaaatgattattggttccacatccgacctctctgtttttttacttcaaatgtaacaccgtcaccaatcgaggtgagttttttcaccgctatttgtcaagtccatcacctcatattccccgttgaacaatgtaacataaactagcttgatccagccaaaaacatcgccttcatcggccaatatcctgacctgcaccatcgtctcttgtgctctctaaccttccatgatctgcctctagttctaatgctaaacatacatatgacagatgccaattttatcgc

SEQ ID NO: 53205 - DNA, 1501 bp, Oryza sativa
ttaaacacaatagatacgttttgttttatcatcaattcgccaaaacccacgggggatctaaatgcactttcaacacgtttattagtagggtttcaataatgccttgttggtacttttgcaatacataaactcaaataattgtttgttcaaaagcatagtaacaacaataatagaatgcctaaggctgtgttcgaactataaggaaggttggggatcttctagttcgtgcacataaaaatggagtagcttattaaagcacgattaatttaagtattactatcttcgtcctaaaataagtacagccgtgggtatccgtgtccaacatttgaccgttcgtcttatttgaaaaatttataaaaaaattaaaaaaatagtcacacataaagtactattcatgttttatcatctaataataataaaaatactaatcataaaaaaatttcaaataagacaaacggttaaacgttggacgtgaacagtgtaaaacattacttattttgggacggagggagtagttgtaaaaaacttaaaaaataaatcaatataatttttaaccaactttttatatagatttttttttcaaaaagattcgggaagcatgcatgcaaaagagagagagaaagcagaagtcgggttttatctttgatttgactgtgcttgcattttatttttctctcttaggatggctaggccttctctccattctatcataactatcctcccaatctcgacattacatcatctaaaaggagcactattttttccttaaactataatctgtgttaaataacctagaaagcaactactatactctatattataagatgtaagcatttttataatttttcacggaaattaaagaaataggtgaaattgaacggtggaatgttgtaattactccctcagtcttaatatgtagcaacctcggataggtcctatccgagcttgctacgtattgaaaatgagagggtaggggtgtaggtaagaagaattaggaggagaaactaaatgagatatggttgtgcttgtttgggatgagaaaaatgtagagaaatagttatatcttgggataaattcaaaactaaaaaaggatatattttggaacgatggagtagtactttaggagggaaggagtagtgtatttagcaaactaactacccctggtaattggcaggtgtacgttcgtgttcatatagaatagagatgagtgtgtgagctttgtgagcgcatatatttgtagtgctgtgttttaacaaaatatccacatccttctacttcaatataaccaatctatagaggaccattttgtaattaccacaacacccagaagtctaaacagatagagtactggaggagtagtactactgcaaatccccaccccaaaaaaataaaaaaaaaatctgctcttaacaactccctataaagctaccactacgcccccctaccgcggagaagcaaccaatccaattccgaacaagcaaggcaccaaatccccccacca

SEQ ID NO: 53206 - DNA, 1501 bp, Oryza sativa
ttgtcacttttacgagtagtgataaaggatttgccactaaacctatatgttacagatagatgagattctacatatcatagataatgagtggtaaataattaattgccacatattaaaagtggcaaaaagttaaattttcctttttcttgaggttcacatctgagccgtccatctgtcaccccagctaagcgaacacaaccttgttttgttgtgttgtgcaactcagttcaaaacaatccaaaaaagctttattggaggtgtttgggggaagagaccactataatgccacgtcactaaatcccatccaacatcaacggcatttgtgtaagtacgtttagcaaattaagatcatctcatctctatccatgtattcattaacactgatgctacatctcaactcctttgatatccctattgttagataaccaattaatcaattttaatgcaataacaaaaccttccgactaacgtttcgcgtatggataataacgatgacaatattatatccaacgtcaacaccagactatatcaatgacttactattatattaataaacacaccatcgtacaccatattttactggctatcatttaccactgcggctaccggtcaccctaaatatatattcgtatgccatatgctagtctctctcggttatttattatttcggagagagttggtaccaatttttatgtagagatctatttatttttccgagagagtttgacaccccccaatttctctctggagatagataatcccacccttctatatccatctatatctatctattactatctatatcttctttatatttgacggtaacacatatggctgtgcgtggctccaccattggaaagaataaatacagcaagctaaccttgggggtttataattataacgcttccttggcccccttcgtctccatcttcttttttttttttctctctcccttctctctctctacaaatctggggctcccagtatagcttaggttgatttaattatggttaacctctcacagtaatccgggtgagaggtgggaagccaaagtgggagaagcaaaaatattctcagggcaggtaaggtaagcgaaggcgagaagagaagagacgagaagagaagagagagaaggtaaactagtctctcttgtacatggtggcttcccttcccttcccttctcttcccatctctctctcctctggttttctcctaccttttcttttgggggaaaaaataatattaattaaggcgcgcgtgcgcggcggcgcggcggcggcggcggcggcggtggaggaggattcagggtggtggtggtggtgatgatgggtttcttctcgtcgtggggtgtgcgcaggggggatgagcgcggcggcggaggaggcggctgcggcggcggcggcggaggaggtggagggggtggaggcggggaagaagggcgtggcggatgcgaaggggaaggggaaggagaaggtggtggtggcggaggaggattctgcgg

SEQ ID NO: 53207 - DNA, 1501 bp, Oryza sativa
ctgaaccagtaacaaaacctttctggagattgatgctacacagtaaagctattctccacttttaatagagcttttaaatcatggcctttgaagtgaatcattccacagataactaagtccaatctaaagtatgaaacaatggtgataaaaaagtgagataatcagcaatataaaagtactgtcacgtcacaagaaaacacttttaagtataaaaacaaattaatcacctgaaatttcatgcagagcatcgggacccttttgaaaacatcccgcaagctacgtcgcacttctatattgatgccatgaccttctctaatcatactctttcctagaataccattgactccaaccgccatgttgattccattaatctatttcagtatcattgaagcagaagaataagaaaactagataagcatactgagattagtaaagtgaccaattttccattccaatacatacctctgcttgaagaatatcaaggcgtacagcagaaggatcactctcttcacctccacgccagcaaaaaccattcctaactttcagttgtcccagatccagttgtatatagctgcagcatgatatgaaggtgatgtcaagctttctaagtattattaaatcaccattatgcttcactaaacttgcccacaatcaaaataaaaaagtgcggactaaaatgaacaaattagtatatgtagacacaggtataagaaatgtgcacacaaaatgcaaaaccatgtgcctttctccactatgattcagaattgcacacctacaatatatggtgtagatttagactacaaacaggaaatttcttatctacctgatcctaaagaactaaatcaactaataaaaccaaaaccaaacacatgtactggaaaattgaaataagggcatactctttgctctgggagttctttggaacaataattatgggtgtgtcaagtgaaagatccagctttatagcagaagcaccatctatttcatatttctgaatcaaccactcgaaacctccaactttgtcgatgaacttgattgcttcttcagtgtgaggggtggcaagctccatgaagtaagaggtgaactgcaaaatagaaggcactttcagaaagatgtacatggtcatggataacaagaacaaacagcttgcaagtgtaacacatacctcctgaacaaaacgataaaggaatacaattcgcacagcagaaagttgcccaatcagactatagttgtaaccttcatagtcatcatcgtcaacgctgtaagactggaacgcaaactgcaacagagaggaaacattaagatttcagtattttgtcggccacaacacaagatagtcttgtttagtttgactgccacaaccaaataaattatagttagctcttaagaagattaaaatggtaaattagtttgcatagagtacaaagtttgagatggaaatctgatgcactgtcgataaagagagaatcaaggttaaaacagaggataatcaaccattcta

SEQ ID NO: 53208 - DNA, 1501 bp, Oryza sativa
aacataattccttgctagtttgcccaccttctccgaacgagttagtattatgtataaattgtctgattaactgacatgccatttaatctctaagttaattaatagttggacaacgtacattaattagtatctttttatgggtaccttatgttgacataattagaggcatgtacaaacgtacagtctgatatggtctcttagttaatacatatcacttagagatcatacttatacaatagttgagacaacaaaacatttgagccattaatgcactaacataattttttattacccttattttcttatattatcaccatacaacaaattttttctttaataaatgctaagagccgactctgagccgttgtcatgcctaacaaaaatgtttcccttttcaccctcttctcttttccatgttatcaagtttatacttgaatgccaacggaaatagcacgttaattaacaccgttgtacatgccctaagcaatcaaccgatggtgtgcctgatcccaaggaccctagaaagcttcgttgcaatgagattcttgtccagctgttgggtggtggggatggtagtggtacatatgtcactgtgtaaagctgtagagatgagaatgctaaggtttttgacctgaaggatgggaggaaggaagaaagtcgttattgtttttgccaagagacccatgttttaatagacgattttgtaaaatcaaaggtgtttttgattattattttctgatgaacaattgggcattgtagattattggttttgttatttggaatttattcacgaagtggtttcggagatgattgggtttcacaggtgaatctacaggttatcattttatgtggtccggtcagactgggctctggtagccggtcagaccggcgcagtccgcggtctgactggccgacactgtgtcggtttcggtttcgggttgtttatttggatatccgagtttatttcatgattatggtttctagatggatactatacgtatgtaatactattgtttgctgctaatgagtcaagttggagatagcttggtctcggaatatggtttctttgtttgttccatgtgtaggtaactcgatgtctcgggagagtatttgcggtgatggaccgggagtcggcttggggataagacgacgtccggggtggtcagagatcatgcgggatacttatgctagagttgatgcacatggttaatggagattccatatggcatacgatggagctattgtgtgcacatgggatgcggagtcaaatttggaaggagtccaaatttggtatgtttggttatgtaaagtttctttcttgtactagagggtttcctaaggtgtttaggactcctagtatgagtttggttcatggctttagactgcctacctcatgtataaatagagggggagcgtgaggcttcccggtatcgcttttcagagcaatagagttgagttttgagttagggttttgagtttagtcgaaatttttgtaaggagt

SEQ ID NO: 53209 - DNA, 1501 bp, Oryza sativa
ctgcatgtttgtaactacccattgctgagaccaaaagtgaacttctattttaattagaagggaggcatatgacatacacaatacatgcatggtgtcatgggctttgggtcgggcgtcctaggcccattggataggatcatggtttgttaggattagattaaggagtcctctatctatataaggagggatactatcccaggtcagttaggcattagatcaagatttatcttagtgtccatcggcgtgccttctcagtgcaacggagagcgtcgcgccgtttaggtttaggaccgttccttgttattttatctactataatccaatctatccccattcatcccgattcttctccacataatccttgcctgtgacaacttggtatcagagcttcggttccgtgcccatgggtgctgagatcgctgcggttcccaacatcagtgaaggccttgccgagatctcaaagaagatgatggacttggcggcgcaactccgggccttggcggctcagttagccgatccaacggctttccttgaggaggccgaaccattataccggcatgcggtgaccttgcgtccgcgagggcgtgtcttcaagcagcacggatgggggcaacattcagtggtgacgctgcaaccacgcggggacggcgtgactcgtggcgaggcgctcatgtttcctcttccggcggtgccaagtccgggagtggcagtgcatcttcgacctcgccgctgggactggcgatggcgccgttgccattggcgccctcaacggtggcggagaagacgatggcgatttccacttcgacagcgatacaactcggtacaggcatctgattttcaggcgctattttccagcgatgcggctttgtttccacaggtggaggcgcacataccggtgatggttggatcagagcttggcggcgtgcgtgtggtgtaattcgtaggtgcgacaggtgggcgtggcattcacgcgtcgctatggcgcagatcgcaccggccccacacactggtttgcgaagttggcggatcaaccacggctgcgtcgctcctagcggcgtggtctcctgaaaggaaaggagatagggtttctaccctctctcagttgggctgggtggtttccacgttggcctatgacgcaaaggtggatcattctcatattttgagccaagcaattttggtctgggcctttcgatttggatcatggaatgggcttttcctctccttcagtgccttaggctaaggtcctcctatgcataaattgttttttatttctgttttttcataaaagccgagatgcaaaaggcttaagagttttagtttaggttatggtgtttcgtttgaagtctagcagggtgtggtgcagctcgaggacgaccttctcaaaaaggggggggggagtaatgccatgggctttgggtcggacgtcctaggcccattggataggattagggtttgttacgattagataaggtttgttaggattagattaaggagtcatcca

SEQ ID NO: 53210 - DNA, 263 bp, Oryza sativa
attcctgcagccctgtggattaacgttttcagtggagtctgcagatggattttttttttgacagcaggtaattttactcacccagtctgaaacacaggcccagaacagaaacatagtctgatacagaaaaaacagaaaaaaaaaacacataacagcagaaactaaacatccatgtttgcgctagggacactagcttccattacatatcacaggcacaaaacgatttcccctaggacattaacgtcgctactgcccaactcaga

SEQ ID NO: 53211 - DNA, 1501 bp, Oryza sativa
cgacaaggacgtattcgatgtgagcaaaataatgggtgccaaatccctagaaacaatcttgacgacagggacgtacccggaataaaagagaaaaatatgagcacaaaggctcaagaaaagaaaaggttataaaaaaaattctcttggttattttgtgctaaagtttatttgagaaagagtgataaatgcaataggtatatgtgtttagtgtttattcttcaacctatgtgcttgttaagatgttgcattctaaatcgtatgaaatcatgaattttgattgttgattcaaacttaattgtaaaatctttggttcatggttatactttaatgcatgcttcttttgttatagatgggttcatcttctttttattgcaacacatgacttgatatgctatatgtatgctaagctcttgaacattaatgaacataattcctatgcttgatgaaatcattgtcaaaatggggagaagtaatgtgaaaatttttggatttttggagaagcaaggtgaatttttggaaagttgttgagtagagcatgtttttggttcaattgggaatttctttcttttaaaaagggggggaagttttcttttggatttttcgaacacttgtacgaagtgtgctttttaccacttttgtttttatttttccaaacaccaaaacattttttatgagtttgccaatgtgttcatcaagggggagattgtaaaatcaaaggtgtttttgattattatttgtgatgaacaattaggcattggagattattggttttgttatttagaatttattcacgaagtggttttggagatgattgggtttcacaggtgaatctacaggttatcattttatgtggtccggtcagactgggctctggtagccagtcagaccggcgcagcccgcggtccgaccggccgacactgtgtcggtttcggtttcgggttgtttatttggatatccgagtttatttcatgattttggtttctacatggatactacacgtatgaaatactattgtttgcctgctatgaatccagttggagatagcttggtctcggaaatggtttctttgtttgttccatgtgtaggtaactcgatgtctcgggagagtatttgcggtgatggaccgggagtcggcttggggataagacgacgtccgtggtggtcagagatcatgcgggatacttaggctagagttgatgcacgtagttgatggagattccatatggcatacaatgaagttattgtgtgcgtatgggattaggagtcaaatttggaaggagtccaaatttggtacgtttggttatgtaaagtttctttcttgtactaaagggtttcctaaggtgtttagaactcctagtatgagtttggttcatggctttatgctgcctacctcatgtataaatagagagggagcgtgaggcttcccggtatcgcttttcagagcaatagagttgagttttgagttagggtttcaagtttagtcgaaatttttgtaaggagc

SEQ ID NO: 53212 - DNA, 510 bp, Oryza sativa
catcgcccgagagcgaacggccgtctgccatgtcactttcgccgccctctgggatggcgatttttaaaaatcgccctcccagagggcggtaggcgaccacttctgtcaattttcaaaatgaaaaattatttttataaaacttttaataaaaaaattaaaaataaaaaaaattcgagaatatacggtattgggctgcgaggctttccggctgttttggtgtccttggcccatgtactaacactggcaggctaccagcccacgtggtagctgcacctgcacgtcagcttcgctttttatttaggagtatttgtttatttttggaatggctaagatttcagttacctgaaattcttaaaatttcagctgaacttacttgctgtcttgtccacattaagattcatgctccggcgatggcaatagagtctttctctaggtttagaatttaggtttcaaggtgagggttgagatgggagggggagagaaggggggatggttttggtgttagagcga

SEQ ID NO: 53213 - DNA, 1501 bp, Oryza sativa
ccattgcacaagtctctttctcccaaaaataccattaccgtcaactccacaccattacaaccgttaatttttttatagtgaccattttgcccacagtgcaaaatatacccaattttcactgtcaaagaaaaagatagatgaaacaaaatttataaccctaaccctaccaatcctgatcctagcgaggaggtccatggcggcggcgcggtagggtgtggcggtggagcggcaacacgcgacgaggaggtccgcggtaaaggtggcacggggcgcggcgaggaggccgcaagcgacggcacggcggttgcaggctgcggtgcgggggctgtaggcgccggcgaggagaggcccgcaggcgtcggtgatgagggggaggagaggcccacagccgcagtcgcgaggtcgccgtgcaggaggaggctgcagtcctaacacgtggcgcaattttttcccttttgtttgttttcattcggcgtcgccgaaggggtggaacaagccatggcgatggccgccgaggtaggcgtcccagaggtggtcggcgacgttcttggccgacctgggcatggggagggagtactggtcaccttcaccaccaatggagaggagcacggtgacattcttggcgtgctggtagtgcttgatgtcggcgccgacgctggcgacggggtggccggagaggtcggcccagtagcggccatggccgaagacgctgaggaaggagatgatgacaatgttgtggaagctgttccacgcaccatttgttcaagaggatgaggagcactataacaacaaatgagagcagcagacatttttaatttagttatgtgtcgatcgttatctgcaccgcagacattttttgttgactaaagacaaatgttgtgtacgcgtaagtatacagaagttgcttgcaatgacaaaaccgaaagatgtctcctgatgaacaaatggttgtctagggataagattgtcttttcatataacttaacggagagatgttttttttttaggtttaacagagagatgttaatagcagtttgatggtgatagtatttttgagagaaagaggcttgtacaatggtatttctaaaaagttatctttatcgatgatatttctcggattagtatgcttatcgatggaattttatggattttcttttttataatggtattctatcgaagcgatgcttataccatgctagaaatgccattttctaattcacgaggctccaaccgcgagaaaggcgagacagaatgaatcctcgccggcgacgaggcgccgacacctccctccggcgactgggtctccgacctcgtcgccggtggccggacggggcagcctcgccgcacggggagccccatcgcctccgactccgtctcggagtcggattcccgccctccttatgggaaaaagaaaatatctcaccccgattcgatcgcgacgaaccctcgcactccgactccgattccaattccaactccaatgtcggtggattttatccct

SEQ ID NO: 53214 - DNA, 171 bp, Oryza sativa
ttacaaataggaagttgtcttggatgtttctgccttttatgaaggcactttgatttgttcaactatatttaggaattgcaagtctatgtatttatttgttttgcctcctttcttgcataatggaacaacctttatataatcaaggaagtatactgtacttaccagttacca

SEQ ID NO: 53215 - DNA, 752 bp, Oryza sativa
cttcaaagttgggcttgttatggcgaagaccccatcttccggcatacacccttcgcccaatgatgcatttggtcttgccggataccagcgcgattcttcggccttcgcgatttctacttcatagtcttcgccatgggacttcgcccaaatgatcttagcgtcctgggcctgaatcctcgctggttgcatggtttcggtaggtctggtcgaagggactcatgacataccgcgaacactccccatgggtataaatatgtacacccaggtcattgtaaattatctccacgatcaataatactactctaagcgcatcgccaccctctttaccgaggtttttacttatcctccagtggaatttggcacctgacacggggctgcattagttcagttcgatctctagcgaagggataagtccaacgttccaccggcctaggcaattgtctcgtctacgtcggcatcgttcaaggctgcatcagtacattcgacctcttgaattgctctagtttggatgatatatttgcctacctatttatcagatgtctctgttaatctagtcttagcatatcaatttagctctattggctgcttctcgttttagggtttctgccggcatcggctaaattgtgttgctagattagattaacttagacatctaccacccttaaaatcagccataggcttgattgtccagatattatgtttcttttcatatttagtgttgcatcaactaaatttgatctattaagtcatgc

SEQ ID NO: 53216 - DNA, 1501 bp, Oryza sativa
ttttttcaacattggattttaaaccgctaataccatagatataaaaggtttatccacaaacgttcaattaataagaatatatcgtgattagtgggtttacgtgctagtctgctagatagatcatttaacttcaagaaattgcggaagacaatattacgggaaaatggcatctaaaaagttagtgctgtttccattatatagatagtttcagatgtgcagaatagaatctgtgtaatcaggtggaaatacatatcctaaaacaaatatgtcttcgattgccaatttctatctatcattttccagtgaaattacaagttactacttagggcatccacaatgttaggaaaaagcaggtattaagcaatataatatttctatgatctagtaataagcattgtggaagtgggtagtaactaatgctagatagtaagcttatgacccactcataagaataaaaaaacattaaaatctctctcactctctccttccaacacaagatgtgctactactgcatgctgagttggacaaaaagcaactaaaaagcaatatttttttcctcatgggacccactttacaaagacctactacttagccctgctacttattacctagttaaacaagatacattggtgttgcccttacttctgctcatctagttccctgttttttgttttattcatagataaatttagatgctttctcaattttctatttgacttgtacgtaatatagtgttttaatccaaagatttttcaatggtgaaacaacccggaattttaagctatttaaaaaaattaaaaattatgtgacatatatcattaattaatcagttaactagcaaaatttttggaaacaagaataagccactcaaaatttataacattcacatctgttgaagtaaaacaaataaataatgtccaatataccaccacaatatactaataataataacatggaaatattatacgaacaaacatcactataaacagtcagcatgtatacataaacgtacactggctgtgttcttttggaggggttgggaacccctcctctccacacgcaaaacggagagatagattaacgaattattaattaagtattaactataaaaaatttaaaaaatggattaatatgattttttaaagcaactttcctatagaaactttttgcaaaacacacaccgtttagcagtttgaaaagcgtgcacacggaaaacgagggagatgtgttgaggactcacggcaaagaacacagccgcatatatttaaatatacggttgcacaggacatacatagcttgaccccttttatacacaaaaggtaatatgtaaataaatgttgccgtcagacccatacacaaagtggtgtatattcaaccgttcaccgagatacctagatcggctaataccgtctggcacccctcacttaagtcgggttcgtcatccggctaattaacacaaagaagccacacatctcaaataaagaattaatctcaccaaagg

SEQ ID NO: 53217 - DNA, 436 bp, Oryza sativa
ccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaatagg

SEQ ID NO: 53218 - DNA, 1501 bp, Oryza sativa
gtgtataaaaggggtcaagctatgtatgtcctgtgcaaccgtatatttaaatatatgcggctgtgttctttgccgtgagtcctcaacacatctccctcgttttccgtgtgcacgcttttcaaactgctaaacggtgtgtgttttgcaaaaagtttctataggaaagttgctttaaaaaatcatattaatccattttttaaattttttatagttaatacttaattaataattcgttaatctatctctccgttttgcgtgtggagaggaggggttcccaacccctccaaaagaacacagccagtgtacgtttatgtatacatgctgactgtttatagtgatgtttgttcgtataatatttccatgttattattattagtatattgtggtggtatattggacattatttatttgttttacttcaacagatgtgaatgttataaattttgagtggcttattcttgtttccaaaaattttgctagttaactgattaattaatgatatatgtcacataatttttaatttttttaaatagcttaaaattccgggttgtttcaccattgaaaaatctttggattaaaacactatattacgtacaagtcaaatagaaaattgagaaagcatctaaatttatctatgaataaaacaaaaaacagggaactagatgagcagaagtaagggcaacaccaatgtatcttgtttaactaggtaataagtagcagggctaagtagtaggtctttgtaaagtgggtcccatgaggaaaaaaatattgctttttagttgctttttgtccaactcagcatgcagtagtagcacatcttgtgttggaaggagagagtgagagagattttaatgtttttttattcttatgagtgggtcataagcttactatctagcattagttactacccacttccacaatgcttattactagatcatagaaatattatattgcttaatacctgctttttcctaacattgtggatgccctaagtagtaacttgtaatttcactggaaaatgatagatagaaattggcaatcgaagacatatttgttttaggatatgtatttccacctgattacacagattctattctgcacatctgaaactatctatataatggaaacagcactaactttttagatgccattttcccgtaatattgtcttccgcaatttcttgaagttaaatgatctatctagcagactagcacgtaaacccactaatcacgatatattcttattaattgaacgtttgtggataaaccttttatatctatggtattagcggtttaaaatccaatgttgaaaaaaatctatgaaaaaaaaactaaaatcaacttaaaattaagttttaaaattcaatttgctaaataataagcacaggctataaagtggttggcgcgccaacatgcgtgctcattttctactaatagactaaatccatcttatctgtagcgctcattgtctactaatagactaaatccatcttatctgtagc

SEQ ID NO: 53219 - DNA, 155 bp, Oryza sativa
tagaaaatctccaaagcttctggatagaataaggtatgtggtatagtacttctgttcataacagagagaagagttaaaagcagtcttttgctgataattgagacatctcaacacctatctgattcccttgttcctcaattgctgttattggcaga

SEQ ID NO: 53220 - DNA, 270 bp, Oryza sativa
agcatgcaaatctccacatggcataatacgctggcagaggatggaaggcatgaaccacatatccacttggtcatgcgtgattgcaatagctgcctaacgttcacccgtttgcataatgtcgttatggaaatcctgttagcatatatgctcgcactgagtttaataactgacaatggaattgttggaaagtatttctcgcatctcatgcaaatattctcttaggtatcaatgtctgaagaacattgtgcaatgatcgtaatatatcaaaca

SEQ ID NO: 53221 - DNA, 416 bp, Oryza sativa
gtagctaaatcaggtaagatcggctgaaccccgatactatctctattaattattataaaacaggctagatatcacaattatagatagaacttaatagatcgaactcaaacttaaccgatgcagcattaagcataaagataactgtaggatctaaacaagatgatgaaaacttctaagagatggtagatacccgatacaatccaagttaacaacaaaacatagccctatcggttacttcttaacagcaagaactagccgatgacaagttatatagcacaactaacaaagattgtaaagtatatatgataactcgacgaattacataaacaagattagagtgtcataaagatggaagcactaatcccgagaacgcaaaccgccttgacaagtttacctctagttgaagatcgaatcaa

SEQ ID NO: 53222 - DNA, 247 bp, Oryza sativa
gacctctaagcatgccattagatggatctcgagatttgaggaattttggaagttgaacggagtcaaacgatttacggttgggaagatattgaatttctaagattattggatttttggtctaacggaaaaaggatttaattaaatcctttttggaaaagaaaaagaaaagaaaggagggagggaatatagacttttctcgggtggctagggcgcggcccgagagaaagggcgggtcggccgagcttaa

SEQ ID NO: 53223 - DNA, 1501 bp, Oryza sativa
tattttaagtgttgcaacattatttgattttttatcaaaatagaaacaagtaacatctggttataaagatttagttgtgacgaacacaacggtgtaatcaaatcgtagaatggataattagtttagaagaaaaaatatttgaagaagtgggaggaaatttccaatcggacatccgatcctctctcaaaaaaccggacggtcaaatgtttcagttaaccgcttgtgaaacattaagttatacatggtgaaaaaaaaatcagtcattaaaacatttaaaaagtgtgtgaaacacagtgaaaacacaccttgaaacatattgttatcgtgtatgaaacatcaaatattaacatattgaaactaaatatcaaatatgaacagattgaaacatatgtttttctttcatcaaaacataatcatgtgatatcttattttaaatatttaattacaataaatagaatggtgtgatcagatcgtagatcgaataagtagttcaggagaaaaatcattttaaagatagctaaatacatgcatgcatgcatgcaaggagtggagagagatagagtatgtgcaagtagttaaatgaattttgtgaaacatagcaaaagcacatgatgaaacatgtcactatcacgtatgaaacattgagttataacggtttgaaacatatattcttcttttatcagaatataattatgcaatatcttattgtaaagatttaattataataaatataacagtgtgatcggatcgtaaatcggacaaatggtttaagagaaaaaaaacatttaaagtgaggagaagaaagaagagaaactacctagcacttatctgcgtgcacattatagtaagaggagagcgcccgatttttctctccaaatcggcatgccgatcgtaagcattttccgattagtttcctagtatgactcttaagtctttccccactagtactcctagatctttgctatatatatcccttgtaagccggatggggagggtgcgacagtccaatgtatccactacgcttgtaatcaactccttaatagtgatcgctaccggtcggtaccgtggttttttctcgaaagggttttccccataaaaattatatctctgttgtgcatttatttttataacaaagctagtggctgttggtattgcggctgctttatgggcaatttggaaaatggcctgctttgagaatattcttcctaatgatctcgtagatgtaatctttcaggtagctcattgtatctttgattgggcaattttacaaaacaaggaggaagaaacaagaagactgcaggaggggggcagactgctaaaacgagtggtaaatgaggtttatagcaccaggcatggttggggctccaagacaggaagataaccatggtggtaaatgagtcgagcaatttcttagcgcagctttgattaaccctggggattttccttgtgggagaaattaaaactttgtagccaacctgaacactgccacagtgccaccgag

SEQ ID NO: 53224 - DNA, 1501 bp, Oryza sativa
tacagaaaactaagggagtacatggcatgaatagatgtaaaaagaaacgtacaaaactgtattttgcatcgaactagacatggtcattgtgaggcacaatcaggtaaaaacgatcattgcggttgaaatccttagtgctaagagcctaagactaggaaaatattaaagggccaaccaaagatacagtgagcataattgagaattaagcttcgctctgaatgtcagacaaatcacagaaggatgataacaacataattgccataataacagactatccggttagtacatcaagcaatactgaccacccaaatctacgaccaatagaagtgcgcaagagttcaaattccttagccaaatcatcagctggttaaaaaaatatttctctaaaatccaaacatatttaccacaagcaaatccttaactgtccattttatcaaacgaggctttgcccttatcgaaggcaagttgatttccgcccctccatggacgattcctgctgaaaatataaccgcgtatgcaaacacgcggaatacagatatcatttggaaacatcggcaaaaccttgcacacacctaagcctccaatttgatcagatccagaggtactaaagagaaacacaaggtttcaagcactactccaattccgctaaggcacgcatatgcgtatgagcgaggaataggcaggagagagcgagagctaaccggattggacttccctcggcctctcgccggcgggagcccggagtctctgaacgtgtcgtcgtcgcagcgccggagtcccggacgcaggtcgcggctgccccctgaacctgcactgcagcttcatctaagggggaagacggaggagaggtaactggcccaataagcaacaatgagatttgatgggccgtgtgggatacggaatttcacctgtgggctttgaaccttttttggtagagaatctatgggcttgaagccttgaactgtacaatagtgtttgtctctctctctctctttttttcaaaaatatgtgtatttcttcttcttctactactactttttcagttttctctttttttgaaagagggaggtagagtgtttgcctagttgttcactttcagccttgtatggtgttgctacttgacatgattttgcctagtgtttccccccaacaattcataggttacggatgcattgtgcggagaaataaagataagagagcccaagttgcaaaaataaaaaagactaataacaagacaagggaccaatcaagcaagcaaacaaagatgggtagaactctcaccgagccctcgatctcaatcctcaccaccaccagaaaatcacttctggcgcagaggacaaacgcatcccagccaagtacccgccacggccgctttatcccaaaccaaaccacacacgccgcgtccgcttctcacttcccaagccagagggcgccctctctccctcccatgcacgcgcgctctcccactgagccttccaagccaccgcagccgcagccatga

SEQ ID NO: 53225 - DNA, 1501 bp, Oryza sativa
gttgggcttgcattgttactaaggaaatgcagagaactgtcaattttttgcacacagataacaggacgaggaaaatatcccaacgttttgcatgaaggagatgagaattgagcataaccgatgacatcgctggtggaccgtggcggcacaatgccactgttcggcctgacgcagtacttctttgggctagttgtcttgacctaaggagcacaacatttcaccaaatttagcgttagcgcgtcaaatctcattaactttttttctttttttttttttgcagaattcccaagctctatgctccgtgaaaccaaattgctgaatttcttcgtgggggaaaaagattccagttaccttaaaggcgatgtagtcatctgttctgttcgtcagctgcatggagcatgagatctgcttcttcgtctcgactgctcaatccaaacagcaaaagaatcagcaaaaacaaacaaaaccccagcggcatgtggctccggaatttcacaagcagggaatttccggcgaggaaaccgtacaggagaaccggagctcgagcggctcgatcccgagcaacttcttggagtcggagcccatctgccgccagccaacccactcgaaccgaagaggggaatgctcgctcgaactcgagatgcgcttgatccggagcggggagctagtagtagctagggtttgggtttgggggagtgagtgagtgatgagtgggtttccgtgcttgcttgcctggaggagcggacgggaattttggagtcgcggatgggaagagcacgagggaatgtcgggttggtgtgtgatggtgtcgcccccggtcgggtgggtcttttggtgggggagacgagcacgagcacggctgcgcgaggtggatcggaaattcggaagacgagcaaaagcctagtgtagtaattaactacactacacattcctttttctggaaaaggccacatgtttgtttggttaaggcaatggtagatttgagaaaaacaaagaaagaaaagtagtgctcacgtggctccttttttctttctgacagttggggtgttcttcaatcttcatttcagattcagatttgatgattgcaggcagagcgtcacatttcgggacgaggatttcaactccccatcaagtgggtgaacagacacggtaacttacatccgtgtgtttgggtgatttggtgttatatccgtgtcggattggcttgaaaacataagcagtgtttaatttcccccaaattcctaactttccatcacatcacatcacatcgaaaactttcctacacacataaattaccaattttttctccaaactatcaattttctctcaacttcccaacttttccaccatctaaacacaaccacagtgacacacatcgcttgtcaaacgtttgcttggtttgtagtactaggagtatcaagtagtacatgaataccaccaggcgctttgtgaaaaaaagtttgaaacagaaaatagcatatgtgcaatgcaattcagcctt

SEQ ID NO: 53226 - DNA, 1501 bp, Oryza sativa
aacccactaaatctcaaaagctggaatcattcttgcaagttagaaggaaaagagttcagccagctgtttgggacaggagaagggaagaaagaaggcggtttcgtgagatttcgtccagcgtgcaatgtgttactctcgagattccatgagatttcttccatagttcaatgttttaggttagaagcacaagaaaagctaacatacaagccttttcaccaacagccatcacatatggacatttcactcccgaaatctcaaaatgtgttactaatatacctagcaacccaagtaaccttgtgagagaatgggaatacccacaagcaagccaaaggtttctaaagagtctacagaaatgaaagaaatatgctctaccaagccaaagcatgttgacacaggttgtatcatttgtccaaatcttactattaagataagtccattctcatcctatccctttcctctattggcccagctaatcccttctctccttgcaactcttggttctttttctagactcgataaaccatagccatcattgacaacaaaatatatgatgcagccccataatcaaaagccttgtcctgttgtccatctataatgctacaatttgatgcataatcaggtctaccacattcacacacatacatggacagagataagtaccaaaagccatcaaatttgtataaagtgaattatccttctttcctcatcgaacttagacttttggattgaactggtcggtgcatgtaactcaatatggtatcaaagaagaggccttgagttcaaatcctgactggcatgcaattaaataaaaaaatacagcccacttctaaatattccacgctagagacttgaggttgtctcgtgtgaaggggagtattggaatacaaagtgaattatccatcttttctcatcatttagtttttgagttgaactggtcggtgcatgcaactcattacatcaaatctaaatgagttcatccatgaacaacataatctgagattaggagtatacctcagttttgggaggcgttggggaggggaaatcgatgtcgatgcaaacttgtgcgccgaatctagctgtcctatcctcgccgccacctactcgctgcgtgagccaacctgtgctcgtttgtcgaccggccgccgcctccctgctcgccgcacccgtcaatcgcttgccgcctacctgctcgccccttgtgctagcctgtgctcgctcttctgccggccgtcgaccccctgctcgcccttgcgtcggcctgagttcgctctggcttccgccccctgctcgctgcaaccgtcaaccgaacggcgtgattttttaatattttctaaaccttttgaatatataatattttaataatagatcctattagattttattgtcacatctgaatttggaccacgtcgagaatacttgcgttaccaaataaccgtaccacatcacatgcataggcatggcagaacacgccacagccacgtggaagagtgtgataccaaaa

SEQ ID NO: 53227 - DNA, 1501 bp, Oryza sativa
aatgtttcatacgtgatagtgacatgtttcatcatgtgcttttgctatgtttcacaaaattcatttaactacttgcacatactctatctctctccactccttgcatgcatgcatgcatgtatttagctatctttaaaatgatttttctcctgaactacttattcgatctacgatctgatcacaccattctatttattgtaattaaatatttaaaataagatatcacatgattatgttttgatgaaagaaaaacatatgtttcaatctgttcatatttgatatttagtttcaatatgttaatatttgatgtttcatacacgataacaatatgtttcaaggtgtgttttcactgtgtttcacacactttttaaatgttttaatgactgatttttttttcaccatgtataacttaatgtttcacaagcggttaactgaaacatttgaccgtccggttttttgagagaggatcggatgtccgattggaaatttcctcccacttcttcaaatattttttcttctaaactaattatccattctacgatttgattacaccgttgtgttcgtcacaactaaatctttataaccagatgttacttgtttctattttgataaaaaatcaaataatgttgcaacacttaaaataaattgtttcattacttggtcaaatgttctatttctatgtataaaatgttttaaaatgtttcaaggagatacagcattcataatttgttattgcaaccctgacaaccgctccactaaaaatttttctatcatgtaatgaaacatcgatataaatcatatgaaacacaatttttttttacaaatacttgaaaatgttgaaacattattatatcatgtaaggaaacattaacttgtgactactaaaacatcataaaatatttgatgaagcattcgaagaacaccacctgcagcattttaagatcaactagtgaatcatcctaaaatactacctgaaacactcaaatataaccaagtgcaacatataggcctgtttggtacagctccaactcctaaatttagctccaggagttgggtctggagtggagttgtggagctgccctctagttcattttgtaagagagctccacccagctccactcctagttttggtggagttgaaactgtttggctgagctccaactctaggaggtaggggtgaaaacggtacggaaacgtacggaaacaacctttatcgttttcgttttcatatttttttttggaatcggaatcgaaatcggaaaccccaaaaacgaaaacggaaacgaatattattgaaaccgaaaacggaaacgaatattattgaaaccgaaaacggagcgaaaacgaaccgccgcggatacggtaacgaaaattcatcagaatacataaacccctcaaactgagcctcacagcaaaaacatattcttctataacttcatataatttgcataacaaatattctaaaaaaaattatagcaagatactatggtataataatgta

SEQ ID NO: 53228 - DNA, 1501 bp, Oryza sativa
tttcagcaggaatcgtccatggaggggcggaaatcaacttgccttcgataagggcaaagcctcgtttgataaaatggacagttaaggatttgcttgtggtaaatatgtttggattttagagaaatatttttttaaccagctgatgatttggctaaggaatttgaactcttgcgcacttctattggtcgtagatttgggtggtcagtattgcttgatgtactaaccggatagtctgttattatggcaattatgttgttatcatccttctgtgatttgtctgacattcagagcgaagcttaattctcaattatgctcactgtatctttggttggccctttaatattttcctagtcttaggctcttagcactaaggatttcaaccgcaatgatcgtttttacctgattgtgcctcacaatgaccatgtctagttcgatgcaaaatacagttttgtacgtttctttttacatctattcatgccatgtactcccttagttttctgtatgttttgaccagctatagtttgggacagaggaagtagttccgtaatatataatatgcaaacttttgctaggtgtagcttgaagttaggatgagtgtgaccacagaaatacataattgcaaagcatttggaaagctgtgttccattatattttttcgggaatacgcaaggagcacatttttgtattaagagaaataaaagttatttacatggaaatacaaaaacagcaggggactgaaaccggaatgaaacacaacattcattagcctaaatcttgcactagttttggcgaccttgatccctccggagaaccagggaggggatagccgagtttgcttgacgccaaagtgtcttctcctccgccattccccttgccacttcaacccaggtcctgcgttgctggttgaacacccggccatttcgttctttccagattctccggaggaaaaaaaacatttagaagattcaaacacacaaacctcagctgattcctgtttcagccaagccagctgtgttccattataaacaagtggcaaagagcagaaaacacacaaatagatgtacatggagttgtgatcttgattcttgaaactcagttgaatgagtatcataaaacacttagtgaagttaactgatccttgagttcctattgtattgtcttctttgttgcgcaactagtctctgtgatgtaactctttcatacatatggtattcatcacttggattgattgatatctttggttcagagctatccgtcaaatggctgtgttatatgggaaaaacaaaactaagccaattgtagatctatatgccgtcttttgtttcgttgttgttaacctgatatcatactggataacattccattgtttctgtctttttcgtgatactgttgagtttttgtttaccaatatgctatgtatagtaccatagttgaggcacttgataactagtttgttttgttccctttgcagtgttgaaggcacagatgtcatcctgtacca

SEQ ID NO: 53229 - DNA, 1501 bp, Oryza sativa
ccctcttcgccggaaatccgccggagctcctccttcctcggtcgccgatcgaggccgagcccgtccgccccatcccgagcgacgcccgtcgccggagctccgtcgcgtcgtcttcctgaggagccccgtcgccaccgttccttgccgtcggccgccccttcgccgtcgtgcatctcggtgagcactcccctccctctcccttttcctccccttcgtcggccgcctcccgggcgtcctcgcgacgtgctgccgccgccggtggtcgtccgaccgggtcgctgccgccgcgctccgcactccgtgcccgcgccgttgccggtggtgccgggcagccggttgccgcctcccccttgccggccgcgccgctgctctctcgcgtgcgccgctttcgcccgcgtgagctgtcgccggccgtcgccgcgggtggccgcgccgccgcgcgccgtcgtttggccagccagctttgagccgtgccttgccccagccgcgccgcccgtggccgttggatcggctttgggccgatccaggccgtcggtcccgtggaccacttccgaggtccgggtccacggtgccgcctcggccgcggtggatcgagtccaccgtgtgcttgccccttgtgccgctgacgagtagggcccgcctgtcggcgccggccctttgctgacgtcagcacagccttttcctttgagaaaataaataataattgcgcaataattcgtgaataattatagaaattcatttaaatggctcaaaacttctaaaattcatatctaattcattcgaactccgaattgagccgttcaacttgcaaaattcatctaaaattgagctctacatgtttgtttactttttatgtactatttccttggtttttattagagtttttccttgttttgcgtgctagcgtgtagaatccgtcgtttcggaagtccgcagtcgcgaggaaaagagtccgtaagattgtttcgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgtgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 53230 - DNA, 798 bp, Oryza sativa
ctacctgaacctgaacctgtttcctggccccggcaaattttcagaatggaaaggccaactgctggcgaatgatgccatctgtcatgtcgaattgttgatgcttgtatgcagcagagacatgatgtgtgcggttaaaaggtgccgagcccacgtccacactggaatactgggcaggccccagggggtttcgattttgataagaccagcaggaattcatccatgatggaagtctgcaaacagtgtctcacatgcacatctctcgcttcatcgggatggtcatggtctatatagaaaagtgacggtgcaactggtttcgagtgtacagttcaagcaagaattagcaggtgaattgcagaggctttattccatttgcctcacgcttgcctgtccccttttcgtcgcactgtatgttaccagtcagatgccattgtttcactgtaaaaagtatagctagttgataggtgttatggcacctatcaattgcatgcgactcaaatagttatagaaaaaattaaaaaaaaatagtaacatcaatactaactctcaagacgctcttcagtcgtaagaagagagagaccaatggctggttcacttgactgaggtgttaagccggtcggacttgactgaggttaacgcgcaaccagtcctatatattacagttatcacccattttacccatgataaattcatcacataactgttaagctaaaactgattaaagaccagtgacgtcggcatctagcaaagatgatgcaccagatggcgtatagtccttttgcttcacttctcccccaaaga

SEQ ID NO: 53231 - DNA, 1501 bp, Oryza sativa
gcaacttgttgatatgagtattctattaattctattaagccctataggccgggatgttacaggatccaactaacattttttctacagagggagtacgcgtgatttcctgcccgacctcttgtttctctgaagcattacatatgccacgtttttgtttgatgtcacgtcaacagcatataattcttagaccggcacgcgtcttaccggtcgaatggtaagcagcggtcggtgggacaagtggccagaggcagccgccatctcacctcaaactgctgagatgggctgaggatcgatggaacgctacccggcctgccaatcgatcgagatgatgcgagcttttttgcactgtggaacccaagtgagaaacatcaatcattgacccgtgagaaaaataaaaagaaaactgtccgtaggcgctgctatgtctgatggatcgatcccgttcgatgcaatgtttgcaaaccatttgacgccggtggtgcgtccgtgcgagtggacagatgagatgaaaagctcacgtggacagagagaaagagaagagagagtagtagtagtaggtagtataagcagtgcagcttagcagtagacatttggaaatggttgcaccgttatatccctgtagatgctactagtgcactgcatagatcaatcacatcagctcccctccccggcccggccctccataattgcgaggcagcagcagccggccatgcatgacgctgctgctgcctcggcccagtactacgtgccatccatccgtccatacatccatcagctagctgctgccctgccttctctgcttgcccctgcctgccagtgccaccagtacgtagtacgtcaagcagagcagcagtgtgacgagtgtgacgaaaccgcccctagctcagctcgatccagcttacgccgcggtctctcccccggcctcccctcgcttgactggccggttcgatccatccctgcgctgcgcggccgccgcaggctttcgacgacagcccgcgcgcgcgcctgcgtggccgcagttctgatcgtcgctagcgctggatctaaggcgccgcggcacgctggaaacggcacagctgcgtgctactgctaagtagctgtgccgtgccgtgcagtgcagtaccgtgcccccggcagctcgcctcgcctgccattgcacgccgaacgatgcgtgtggtgtgcgtggcgctagctagctgcatgcacggagttgtatccatgcgccgagcgctgtctgtttgtcgtcgtggggggcatatgcgcgcacgtactttcctaccgatagagacccgtcaaacgccggttccgacccgcaggtgaatgaatggatcaacatgcatcttccatacttcttccatttcgccaaaaaaacgacctctagggacgtgactaacaccgaaaaaaagttgatccaactccaagtatacatttcaattttcccaagcaaaatttactttggtaattaaattaactgtagcaccaatatggaggcacggatcta

SEQ ID NO: 53232 - DNA, 853 bp, Oryza sativa
tatttttttaaatagtgaattatatatcattggaaagcttatgaatttagatgaatttaggttcaagtttcacttaaatcggagtaaaagtcgaatgcgaaagtcgattcctttttattacctttactatcagcgaactacggcaaacccaatttcgatttaaactattttgcgggtataaatattttgttgtcataagtttttaatttactcatcccgagcattatatccatataacaggttagaaatttctattacgagctaaatatcggacgaaatcttagaaatattatacaatttaatttagtctatgactaaacgattaaatataatacacggctaagattcctagtaattgaatccgaatttctaccatgaaccgatgacttatagagattatcaaaaataatctataataatctataagaattcatctaattgtttggttattaattatatctaaattactaccaattttaatctaatctgatcaagaaacatatatttataattaactcggaatttcgatcgaaataccattacgctcgaggaatttccaaaaataatctattattaaccccgaccatttttatttcctaaatcctcctaatttctcccccaatttcccttctattttctcctttccttctttttctctcttttctctccctctctttcttttcttttcttttctcttttcccttttcctttctttttctttctctccctttttcctttcttctctctttctctctctgtcggcctctcttttcctcttcctttctttctctcctctctcccggctctatctccctctctcggctctatctccctctctcggctctctcccacc

SEQ ID NO: 53233 - DNA, 477 bp, Oryza sativa
tgctcaggataatccctattctcgatataatcttgatcaaccttcacctcctggaagttgcagacgttgcctcacgactaaccgatacacaaagtctataatacgcgagaaaaaccaatattcaagcaacaatcaaatatgcacaacaaaatatatttgctgaggtcgaacctaaggttgctcatattattcgcgcttgctaatggactctaatcaagctaagagctagggtttcttagtctttctgttgtcatggtggtgcagtctagctaatggctaaggaaggattatggttacacatgcatctatctaaataggacggttatttactagaggttctgttgttagatggatttaggatcaatcaaatagttatagtgaatcatttgtattattattttattgatggaagctttactttaattatgaacatattttacttgtcacaataaattataaaaggttaataattatcca

SEQ ID NO: 53234 - DNA, 229 bp, Oryza sativa
ttcaattctaaagattgatgcattgcacatactccgaccggacgagacgcactgtctcatccgagtcatttgagaagcactcacctagtcgttttagaaaagagttcaaataaaataaattgcaaaaataacagtctttccttgaagcctgcaataaacacttatttcccctggcttgctgagtactcccgtactcacccttgctctatataaataatccccccccagt

SEQ ID NO: 53235 - DNA, 991 bp, Oryza sativa
aaatgttactcttatactccctccattccaaatttatagttagtttttttaggttattcctaaatgatctacatatttgtattcattcattaagtctattcgttatttgtgcattgaagtactaaatagacattgatacatgcatccatgcacagaagtatttattacccacatgcaatagtggggatgttgcatgcattgagtttgttgctagagtaaatatagtatgagagagttattagcttttcttggtcttagtgtacctataaaatatgtagatcaatttggaatggagggaatattttgctataaacttgatcaaactaagaaaaaaaaatcaaatgacttataatatgaaaaggagggagtacatgcaagcctctattaaagaactaaaaaaaggagtatatactactccatccgtcccaaaataaacgcagtcatgagtttccatatccaactttaatcatccgtcttatttatttttttaaaaaaaactaaaaaacataagttcacatataaagtaatattcataagtaatattcatgtttcataatataataataatagaaatactaataaaaaatattttaaataagacggacgttcaaagttagacatggaatttcatggccgagcttattttggaacggaaggagtaaaactgtacttctgcccttcacgtccactcgtgcatgcctagtacacatcagttttactcgactacaagcggtgtacagtgaagtagtactccgttggttttaaaaaaacctagacaacggtgggacataatctatagcaatgaacttgaatagaaatataacgtatgataatgaatctggacatgaacatgtccagatttatcgtcataggttatatctcatcgttgcctgggttggttttttggtggaacaggagtagtactggatagccgatatgatggactaatcatgtccgattgaaagggaagactcattaacacgcacctgca

SEQ ID NO: 53236 - DNA, 202 bp, Oryza sativa
gatttcaccgtgcaaatccatctcccccggtgacgcgacgacgcgcgccaaagcagggttgaaggtggagaggtcggtacaaagggacaaagtggcgacgcccgcgaggcaacaaccgagggaggcgcagccgtgagggccgcgtggtatggtgggatgcacggctttctcctacgaatgctcctactgtctactccctagc

SEQ ID NO: 53237 - DNA, 387 bp, Oryza sativa
ttaggttataagattttctatcattggccacatttatatagatgttaataaatctagattcattatgtgtctagattcattaatatttatatgaatgtggacaatgctagaaagttttataacctgaaacggaggaagtaccatataaaaatcttaattttggtgggaatcgtcaatttccataacactttatccctattaatatacccattaatacatggatcgaacataaaagataccattttgatgaatgtgggaacaatggattttctgttgtctcccttccatagttccatggtatactcccctgtcacagaatataaacatttctagctattcctactagaagttattatatttttggacggaggtagtagtttttaggca

SEQ ID NO: 53238 - DNA, 194 bp, Oryza sativa
atcaggaagcggactagttagggggcacaggcccagcataaagggggagctttaaacctcgggtgggccgtgagcccgtcactgcctgggatggggaggctgagcaggctgcttttgcacggtttggttgcagaataagttcatttaaggtcccttaacttgtaaatgaatccgattttcgtcctccatccaga

SEQ ID NO: 53239 - DNA, 1173 bp, Oryza sativa
  unsure (1)..(1173): unsure at all n locations
caaaatcagaactcaaaaaaagcaggaattcattcagatcgtaacctggtcaaattcttgtgagcaaaaatttaccttgggcacagaggagatcggcaaaggtggccaccggtgacgatgcggacgggagagatcaacgctagcggagcagatcggtgagcgaccgtcggtggcgatgcggacgggagagatcggctcgggcggaggcgcggaggaaatcgacgacgttggtgacgctggccgacgggagagggatgggcgttgttggcgtggcggcgtctcgatggcggatggcgctggatagggcgatggagcgatgcgagagagaagaggcgacgtcccgatggctgatggcgctggatagagcgatggcggcggcgtgagggtgcaccgtctgtggcgtgcgagagaaaggaggatgcgtgtgaagagcgtgatggggggatgcgcgtgaggaaaagggaaaggaggacncncgtgangaacgcgtgcggaagggagggtccgcaacgattttgaggcgttggatcagatgattcttgaccgtcggatttgatgaatggggtttgtaggagtgtagttggtgagttatagggtanatgtgtgtcgtgcatgctgcatattactctgtgctacagtacatatagagagcccttttacaacacacaagtttgattgagtcaatggttttatgggctcgtggcctgtgtgtgggcccaatttcatttttggtccccttatcatccacatccagttgaccagtccctcctagcccatacggcctatattgtgaaggccccagaccaaagtactgatgggccatgttcccaactctgtagactgtagtctggacttccacgtcacgtccacaattcccatttcacacatttcatttgggcctctaaagtagaaaggtctcaacttttgacgttccaccggtaaacagcagcagcagcagcaaggcacctactcctaatcgtctcatgtaacacgcgagttgatcgtgatcattcctccatcacgaaatatcatctcacgcaaaagcacgaagtccacctgccacggttctggagctccgctcctttttcccaaacacagcagagtttcagacttttcagcttcggtttcccttgtttctgatctttctttctccttcatcaaggcacggaacaa

SEQ ID NO: 53240 - DNA, 214 bp, Oryza sativa
ggggaagatgggccgagggaaaatcggcccatcgaacccgggggaggcaaaatagacttttgcggaggaatttgatttggagggaattggattcggaattgaactcgacgatagatcggggattgagatcttgagatggcacggacactagacaacaatcagagaaacaaatttcgcaattagggtttttaagagataattttttcccgctagg

SEQ ID NO: 53241 - DNA, 485 bp, Oryza sativa
cccgttcaagaagagcagacggaatcggtgtaaaagtgaaagggaaaacgccaaaggtgcaaaacgaagtactagtatcgacatgttgcagagttagcagtgcattagattatcagtttagcacccaccacttcttgcaggtttaatcagtgtcggatggtccacttgggacagggccagtcggcagagccttatcgaaatggttgtgtgctttgggcctcacaaactgaccgaattaatgaaagcaatgcgacaacagcaaaaaacaccatgatcactgatcgagggggtgttgcgagaatcgaactcgcgacctctcgcacccgaagcgagaatcataccactagaccaaacacccagtttgattacttctttatcttgtattttcaaatcctaatacaatgtagcatgagtctgcagtgctcgcaggccgcagcttggtgtattcagagcccgggaatattttgagctccaatatatacaga

SEQ ID NO: 53242 - DNA, 458 bp, Oryza sativa
caaatcgcgcgcatcggcaagggaaaaaccgaccgacaataatgagcggctttcttcaagaccgctacattacttgagtagcgcgcgaattgggacgagccggttcgtttcgcctggagatgtgatgatgtgcatcggtcggcgagcgtagttaacgcgcgcatgatatgtcccatctcgactgccacggccgcacatccgcctcgtgcgccgcaaacgggcgagcaggattaatggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgtta

SEQ ID NO: 53243 - DNA, 1501 bp, Oryza sativa
aggatgaagagaggagaagggggaggaaggggaaaggagaatggatggaggaggctaaggctgagagggataaggtagctagcgaagggatggaggacggtgggatcgaagggataagggataattaatgagagaggagaggacggtggactggtgcgcggttcggttgatttttgatcccggttggtataaataaccggttgtttataccaaccaagactaaaaatgagttggggcctaactcgacccgacaactttttaaaccgggactaaaaatgatctttagtcccggttaaggtcaaaaagtttttaaccaggactaaaaatcatcttttagtcccggtttttattcgaaccaggactattgtggattttgggctaccgagcaaagatggtttctccaccagtggataagagagaagagcagcgggctacagatttatagccagctgcagtacggactccaagacggaatgtgtgtatgacaggtgggaccatatatcaatagtatagtaagcaactattgtatgaattggctattagattggctatagataaattagagctagtagtgggctatactattgaacttgctctaaagaactaaccgaggaaaaaaacgatgcctcgatcaaaaactaaccaagcgagaaaacaaaataaaccatgtccccccaaaatcccgatgaagggtagaaaaaattgaaccggttttaatgttccgtttcaacgcaggcatccatgcatatgactagtcgggtaaagtgaaactcgttgatcattttagtaataatcaatcaaggagaatatgaggtgcagtttagaaatgtcttcggccatttttatccatttcatccgcatatgcacaaggggaatagtgacagtgtgatagggcgtatataagtgtgtgaaagcgccttaacaaaaatctaaggttagtcaagcttaatggctaatgctaatgactgtataggctaatggactactccatatctcaacacatatgcagcagatagctgagtgtgaatacaatagagcttggaaacacattggaaacgtgcgttagctgttagttacaggaggaggggcaaagactaattaattaaccacggatattatttcaagatgagacaagatatgacaatgatcttatgcatttttttaaaaattattatcatgattaatatttgtgatgaacaattggctttacaaatgatttattcgatgaaattgttttgagaatgtactgtgcatggatgttggtgagtgtgggtaatgtgcgtcgatcatgttgtgatatctgagcacagaaatggttattttgtctgattgtgtgcatgtgacttatcaatagtgaggaccgggattatgcgcggggaggagcaaagttctagtacggttgggataccatgtgagaaggtaactagagttaaggttcttggaggtcaacttcgatcaacggtgagatcgggactagactcaaggaggagttgagtccaga

SEQ ID NO: 53244 - DNA, 1501 bp, Oryza sativa
aaatctaaaaaaaaaaaaaacataggagaacaataggtttgtctggcataacttttttgtaatgcaaatggcagtagcacaccgcccttcaattaaatagactagggcattccccaagttaatcccaggtcaaggcatgttttcagagttcgtctgataattgcctatcttacagttttaactgtagcctagcacttgtatcatccaagagactacgatatggattttacttagttcatagatttttttttaaagggaaacaagtttccaaaatcatccaacagcttgtatcaaattgatggccttcatgcaaaacaatgtttccattgatatttgacgaaggttctgcagatggtttttgctcaaaaaaatagagctaaactacattctgctcaggcaataactatgatggatgaatttctgttcaacagatcgataaaaatgacagtaagtcaatagcttaatatcaagtgaggaaaatgacaaacaacgctagattaagaagcaagttccagggaggattatttgatcaaaaaagtttcaggagggacatgctcagttcacaagtaaccatgtcatgaagaaaataatctgaagctgttaattgaaactctaaaactgaacattgtacattgcaaaaatgaggttcaatattgtaaagatgtcgtaagagcgatgtaccttttccccttgctgctttctcctggagtccttgatcctacatcttttgcctcatttttctgtttgctcaactggagagatctgattaaaatgtttgtggtgtctgtgtctataacttgtccctctaaaatgacaaaaacggtgatcagtcaatgaacagaacaaaacagccttaaaatgatctgtttgtgtcatcagtaatcagctttatcataagaacataagtaatgaaaatatgtaaaagatcatggtctgacaatagatcatatactaacaactgccactataaaatgtaaatcatatacgtccaaaaatgatattcaaaagataagactcccaagaaacacatggcaaaagttttgtgacagcagcacaatgtctcactcgatccgaagaaaaaaaaagcaacatcagaaattcttctctgtagcttcattttttccttagggacagctcactttaggtaatcactagaaaactcaaaggcagtaaaattcactcccaaacactactaaatctaaatttcattgaatggaaagcaaaccatttatccccattgccaagctactaaactcctacactttacatccagaagatttaaatctatttaaccaccaaagaatggttcagtacaatatttcacaaacacctgcaattctcactccgaaaacctgtaaactactccaggaaaccataaaataagcatgacaacaatcaacagtgccaccacaaatccaaagaacaaatatagactttagctttcctgcaagagacattctgagtaaacccatagaaattccaactcttaacatcagcaaaa

SEQ ID NO: 53245 - DNA, 1020 bp, Oryza sativa
cccgtttttattttaatacttagaattggtgaggataggaaagaaggacgactgtgcttgtgctttaaaagtagtagatactacctccgttccattttaataatagttgtggtacccgtgcctaacgtttactgtttatcttatttaaaaaaatatgaaaaaaattaaaaaataagtcacgcataaagtactatttatgttttatcacctaataacaataaaaatacaaatcataaaaaaatttaaataagatggacggtcagacgttggatacaataaacccacaactgcatttaaaatgagatgatgttttttctttctggcatatagtattcggtatttcatgacagcagaaaaaaaatccatcttaacacagacagaaaaactgcatacatattgatgaattgtgcttagttttagaccacatatttccgttggaaacaaaaggatcatctacagattctgctgctccttcggaacacagaaatccacatattctttcttttttttaaaaaaaaatacaagtgtaattaatagtttttcccccaaaagattatcgcattaccaaaagaaaaatgctacgcataggatcattttcttatggttttgatacgatcaaatgaaacggcacagactgtaagggaacctaacgcgagttcacgcgcacggggcagtccaagagcattcatgggccctaaagctcaattcacctcttttcatctaactttacatctttctttgttgaaccctaaacctaatgttccctattccatggtttcatctaatatgcaagtctgcaactaattcagatagcatacgccatcctaagacgaaggtatgtcatcttatttgcttgatttccagcttgacaatcatcttctttggtgcactagtctctctcttttatgttcctaggcaatctccatggccataaaatgattgtatttttttattatagatttaatctgaaaatttgctttgcaagacatgccattattttcaatttaccagtttcagcaa

SEQ ID NO: 53246 - DNA, 1501 bp, Oryza sativa
taaacttaaaagatggatttgttcgatttttttttaaaaaattatatatacaatttattttcataaaacacgctcttcgaaaaaagatgctaacgaataacaagagagttgctgaagccaatggaccaaacaaatggggcctaactcctacctcatgtttttgttatgaaaaccaaccccaacatctaatattgcctatatcagggtttacgattccgacgaaatctggttggatttcgcgaaatttcgacgtttcgatgaggctcaaaagtagaaaccatataagatttcgaagagtttcatccaaattcaaatttgaattgataaaaaagaaaaaaaagaaaaaaaatcttataaatactatgatattcatataacctattaggatataaattttttaaaaaatgatgtattatgtgtttactaaaacttagctcagaaaataaaagaataaagaatttaaaaaaaaaggaaaacacttacatgggccagaatacatgtactaggcccagttactgatcgaaatttcgatgatttcgatctgaatttcgccaaaaccgactggttttgagaacttatcggcaaactcagggaatttgtattcaaattttggtttatgaaatttgttcgaaatttaccggtttttcaccggatttcgcgaaatcccgaattccgccggtgcccgaaacggaagggcctgtcggaatcgtaaaccctggcctagatagcattttagaaaaacttgctataacttttatacactaaatgcaaaaagtcttgattcctagaattatgagaagcagctagttagtactttctctgttttatattatatatatctagattcattaacatatatatgaatatgagcaatgctagaaagtattctaatatgaaacggagggagtagctagttttgaaaaaccaggagagttcgtttattagattttattattatatcccacaaccatttcttttaaataaaaaacaagacaaaaccttaggttttggaaagtcttcacttaatattattacttactgtatactcccttcatctacttttgatagtcatatttcatcttggcacacagaccaacgataagtgattctacttatcatctatttaaacatgctactagtcattcctcgtgaacaagcgattcattaatattttcatttctcgatgcctatgtagccaatcttgtgtggaggaatagagaatcacgcattaaattcgagaaagacattaagatgataggttgttggattgaaatatacttatcaaaaatagattttttagatttggaaatatgactatcaaaagtagatggagggagtatataatagcaataacaacaacaacaataataataattaaacacaggtaaacaaagaaacaaaatcaaactccttccccccaaaatccttccaaaattcttgagaaaagctccaacctttcctcttcttcctcttcccctccctctcgctgcctgccgcctct

SEQ ID NO: 53247 - DNA, 1501 bp, Oryza sativa
tacatgtgtggaacacgctgcttaaataaaaaatcatatgtttggaattgttgataatcatatacctgaatttcaagaaatattcacatctttttgattgatcgactttagcaattggaatttcgatctctggtgactggtagcctagcggtgggtcatcaggtagagcagtttgttatatgcttgggtgagggtgtttggcttcatcagaagcatgcacaatgtactgttggcgactgttgctgtggtgctgaccattatggtgttggaattaaagggaaggaaccctcagattgtggtgggtaagagatggtggtagtggaatcatatcaaagtgtggtgctattgactagagaaaagttgatgcaggaaggaaaaaactggagattgtggcggagggttgggtttggtttggctttggccggggataataaatgatggagctgtagcctgtagaattaggccttgtttagttcccaaaacaaaaacttttcacccatcacatcaaatatttggacacatgcgtggagtattaattatggacaaaaagaaaaaccaattacacagtttacgtgtaaattgtgagatgaatcttttaagcctaattgcgccatgatttgacaatgtggtgctacagtaaacatttgctaatgacagattaattaggcttaataaatttgtctcgcagtttcctagcggaatctgtaatttgttttgttattagattacgtttaatacttcaaatgtatatccgtatatccgatgtgacaaccaaacccgaaaatattccccaactaaacaaggccttagatggacttgagaggggtggattttgcttagagggtatacagaagggtaatgattacttgaatagacatggtggagaggatgttggtttgggtgcgctgacgattgaggatatatactgaaggttttagatatgatgtgtgcaaaccatgcagaaggagacatgaccatattggacagctttggtgggcattcaaatttttaatgcaatatgatatctaattggcaaatggtaatttgtatggtgatgaaatcacaaacacacaagttacagaaatggaaatacaattgttttgatgtttttagggccacagttgtgttttcttgactaactatgattagtgaaccttgtaaacaaataaacaatagcatgagaaacagaaccctcaccccaaccatgatcagcactgtttgcacctacggacactggatttcacagggaaactggaatttgaaatggagtactttctttgatgagtagaaaggcatgtattgaaaggctaaacaccggctgatagaagttgtcaatatatggagacaatagtcttatattcgctgcccattaaacaaaataatactccctccatcccaaaatgtttgatgccgttgacttttttgaaaatgtttaaccgttcatcttattcaaaagatttaagtaattattaatttttttcctatcatttgatttattgtt

SEQ ID NO: 53248 - DNA, 1501 bp, Oryza sativa
gtagctgtgaactaagcagcatgcttggaatggaccaagggtgtgcccttgttaactctcttgaggccagtggtggattgagttggaaacttaagttactagaggcatacccgctgacattctttcctttttctctgttaaacatctgtgatagggattgaggtgagagaggaaacaagccaggaaagaatagaccagaactagggacaggaccttaaaggaactaactcttcttgctgatgtgttgtttgtttcacttattctgcaagttgattaagcaaacaacctagcatggttacatcacaacccactgatgcaaaccacgcgctacacacacaagcaaggaaacacacgactaacgactctaccctagagggtggcttaggttctgtgacgggttctccaagatcttcactcctgcttcaccgctggcttcactgcttccctcacttcactagcggatcctgcagccttctggagcttcggcagacaattgacgacatcttcttctttgcaaaactaaccatcaagtactagtggaaatccgaaaaaggaagaagggagtaaaccttttgcaaatagcattaggggaaggagaaaaaaggaactttcgcaaatagttttatttataaaatatgtccttaggttttatccacttggcttatcctacagtcgagatggctctgataccagcttgtcacgaccgagaaaattgccttttcccgaacgctagtgtattaatccccgtcccaggaaaagccggggtacaccacacaaacatgatataaaagacacatctttattatatcgataatatttacattattacaaaggcacctaggcctgacaaacaacataaacagcagcggacttgcgggcctacggctccatcttcacaggcgctcaactggggtataagccaggactccacctaagacttcttctcctaagcttctcttactgaaggggggggaaaagattgagcaagaatgagtacaaccacagcactcagcaagccacaccggcagatgcatgattaatgcaagggggtacaaggggtaaaaatataggggttaagctttgcagaaaacagcatttaaaagtcacttagttgcccaaagccattttataagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagc

SEQ ID NO: 53249 - DNA, 1501 bp, Oryza sativa
ttgtttatggctaggatgggttgggaactatgacacgtcttccgtccgtataccgtggtggtatgtggcacatggttacatgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgctagttcggtctgaatcatcgtaggccttgggctaaggcaggctcgtgtgggttcacgaccttgattaataatactgtgtagctctaggatcgtctttataaaatggctttgggcaactaagtgacttttaaatgctattttctgcaaaacttaacccctatatcattaccccttgtacccccttgcattaatcatgcatccgccggtgtggcttgctgagtactgtggttgtactcactcttgctcaatcttttccccccttcagtaagagaagctttggagaagaagtcttaggtggagtcctggcttataccccagttgagcgcctgtgaagatggagccgtaggcccgctagtccgctgttgtttatttttgattgtcaggccttaagtgcctttgtaataatgtaaatattatcgatataataaagatgtgccttttgtatcatgtttgtgtggtgtaccctggcttttcctgggacggggattaatacactagcgttcgggaaaatgcaaaattttctcggtcgcgataggtattcaggtagcagatccaagcagctattgaaggaggcaaaatcaagtttgacgactctaagaggccgatgaatgttgatggcaatccttttcctgttaatatggtgcatacaactggccgaacagccgatgggggccgtgcaatgggttttcaggtcaattcgactaagattatcaattaatatcagaggaagtatgacaagcaacaggagaagcattacgaagaagatgacgatggctttgatcctcattggggttgtgagttctttagattctgttggaatgaaggtatgaggctgccatctattgaagactgtcctgggtgcagtgatattgccgagagttcaagccaatcatatataaggggcaatcggctaaggctgatgagagttcctgttcatcaaagattgggtccagtgagtcaagatcgtggccagaaggacagcgaaaatagaaaaaatcaatggtgtccatctggtatctctacgaagaatcaaaagagaagggttcaaagattgaggaacagggagcgctttcaggaggtcgagcaggaaattaaccatcggctaaagaaaacaaagccgacgcaggagtggcgtgttaagaatcaagttcctgtagccgatgaagccacggccgatgagccaaaaaggttggctaaaggaaaaatcgttgtagctg

SEQ ID NO: 53250 - DNA, 1501 bp, Oryza sativa
cttctttataaagttatgacacactaaatgcaattaagaccctaaatctcaaacctcaatgttccacgtcatcatcaattctcagccgttggatcactagattagattacattttaggcgttggatgaacaaaacgcaatagccaccacatgaggcccatgtaccacgtgaagtacttagggtttcttctttgattagtagggtctccttgtggagttgtggtgctagaggcagctggttttctccattgatggcaagtggtgccctggcgtgcctcgcacgtggtgtggcactggcctgatgaaaaaacaacatgcattaccttattgctaacagacagtagccatatatgttgacgctaagcttcggataccaccacctccaatgaccttttcctccttaatttgcagtgctcatgtgtgcttcttttgtttacactgttcgatttgaccatttgattgtttaaagttagttgtttcttctttgctttgtagatccaaccatatgttgtcggatgattcaattttctgttacatttgttccatggaaatattttcagatgtgcatgtcatatgttcagcacactgcctgaatgaggatcatattagtgaacccctatgatcttagcttcattagtatcttttcacaacaagtttatgatttttattattgtggtttcttaacctaattgcgtagtatagttaatttttacctacatgtgcacactatcatctcactatatcgatcaatttgtatcatctgacatgattctattgtaaaatcaatgtgtgttttgattatattttgatgatgaacaattggcatggtaggttattggttttgatatttggagattattggcgaagtggtttggtgctaattatgtgctctggtcaggccggatagactaggccggtcagaccggcgtgtgttgtgcggtcaaaccgaccagcctgacgatctaactggctggtttctgactggaatcggttttgggttgtttaattggatatctgtgattattgttgatggtcattaagtgcgaactttcactatcaactcctacataaaagaataccaaatataatatcaaacttattggtaggggtttattactaactatttcctctagtcttggtaaatagtggtatgtagttgatttctgaaggaaaacacactcgtcatgcgattaaatgtacctctgaccaatcatacgtaagcacaaggatcggagagcccacatgtcagtcaaaatcgactaaatttgagctaatccattgccaaccgccataatcactcacctggcatacactagagaatgtgggtggctagatgcggtgtgcctggttcgatcgaacgaggggttcgaccaaaccaaggttggcaccaccctcctcccctctccccgccacctccttgcacttggcgacccactattggttgttgatggtggttgtgggtgcaccaacctccacaactgtcattccaaccgttatatgga

SEQ ID NO: 53251 - DNA, 1501 bp, Oryza sativa
gcatcggatagagggtattagctagtatgtcagataactagaatgtatgtatactatgtatactagaagtataggaatagattctctttctattttatttccacttagcttagatattttagtatgagaatgagtagtcccctatttgtgtgtcactctacccttagattatcttaacccctgcttttattagtctatgattattacaagtaacatataaattattagtcaggttctctctactatgatcttctcacaggattaaataaatacgataccctttgaatactctggggtgaaatgctacaatggtatatccgtgcacttgcggatgaactctataaccataatataccacgaatttttatgcgcctttgctgggatttatatttctagtaatgtcgttaagaaataccaacagacatcgcgacgcaagaggcccttttggcgggatgctttgtcaagactcgtcaacgagttattggtaagctcgactattggtatttcttaaggtcacatataaaatccgcaagcgcacggatataccgatgtagcgcttcacccgggagtattccaaggtatcgatttccacaaggaacatgtgtgttcaactcttctctaggttcaaccaaggacacgaagcaaagataggaaaatggtagagaggatttcctagcgagaaactgtgtctatagaaagcttggtttaatcctataagaaaatatcaggcactggcttgctcgctgctaccagaacacgctttactccgtacccagatagggaggactacggtgctcttaagggttgtcactacctctacaccaacctctaacgatatgtgggatacgcagcaatcactgaaaattaactacctaaacaccacgtttaagcaattagttactactctcgtgtttataattcactaaagtaaacactatatattcaatgtagcgaacaatgatcccgaatgctaataggaactaaacaagagataattctcacaaagcaaaatcttaattactcagaagaatatttttattaaatcagagtaattaacaaggtataaaaagtaagaaaagattaccgacaacaccggaatttctccgatttcttctaccttattctctccctaatctagtatagaataaagtacaatagagcctcttataattcagctcaagctcggagtatgtgtgtaaagtaagggagtgaggcccttttataggcttccaatgatggctctacagttggaaatgtctgaattgccacgcaactgtcattttggagtcatctagagcatccatgtgaaaggaggaggccaatagccaagatttgggttcggccgaacctagggttcggctgaaccctggctagctcctcagcctgtgggcttttttcctggacctccatatctgctccctcggtccatttctatattagttgggctcaatttctaatgtttcgatgaagttgtgagcccaattcttatattgatgtagtt

SEQ ID NO: 53252 - DNA, 1501 bp, Oryza sativa
tggagccaccattggtctctttgattcttttctcctcttgcacacaattagagatgagctctttaaaaattccatttatttggacttatttcatagttgacaataaagttgtcaaagtgctttggcaatgaggtcataaccagatggaccagaaagtcatctgagatgcccaaatccattggcttcaacttggaagctatgttgctcatcctaaggatgtcgtctcttacaccacctccatggtacctctctatcacaagctgctttatcagctatgtcgcataagtctttgaagaactagtaagctagctctttatacttttgaggtactcagagacggtgtcacactctgggattgagcccaatatggttggctcaatcgtgttctttacctcagccaagcagttcttgttggctaaggaccatttcgcatgctcaatgtcatacgacaagatgaggggaacatggtccctctctctcttttgccattcagcatctgactctttttcacctctgtcaagttcagcaggttctatatgacatggggtagtcaacacccagtccacctctcccaagataaaagcaaggtcgagttctcttttccattcttcgtagttatctcctttcaggtcggaatatctttaatgcaaccaatcaaggagtagctgtgagaacaaaattaacattaaaatattatgcattagacctacatcaccgttgggtaaaaatagatataacacagagccataactataacattgcaattatcaacgttggtcagaaaattacaacatcatagcacaaaattaatgttcctaaaattaaattctcccgttggttcaaaatttattttaaaaacacaacttttaacaattttatctatttgcagcggaagatctatataaaattcatatgaacagtaacaaaattctgttattcactctctgtaaaaaaactaccactttggatcaaattttaaacagatataaaacatgcaaaatcgatacaaaattccattgaaatttgcatgaaaatacacaaaatacatgttcagaagcatttctcacatttatctattctctaaacaattttcacgtgggttcaacttgcttagaaataaacacattttaataactataattgcaaatgcttctgaaacaaggacaaaaaatggacttcttttcttttgcttcggccccgagggacctaaaatagactctttcagcctttgccggtcggcccactgccgccttgcatgcgcgcgggcgctccctcacccctcccttggccgcaacctgggcctgagccgggaaagccgcccgccatgcgctccccacatgggccgattttggtccagccgccgccggccgtccaatcactagggtttcgatcagacagccgggcgccgagatcggagggacaaaaacccgaccccagccgccagctagccgaaaccctagcttctccactctctctctctatctttcgcgcgcgtggctgc

SEQ ID NO: 53253 - DNA, 1480 bp, Oryza sativa
acaaaactcatcttttatctaatgccccaaaccataaatacaccggatgtattaagaaccggtactaaaaactctttagtaccggttctaaaagcccaagtccccaaaaatatctttagtcccggtgttaccaaaaactctttagtacgggtgttaccaaccggtgttaaagatgtgttcagggttagttaaaaaatgtgtgtagtaaataggatgataatgcgcgtgagggttgagatgataaatcttgagtttgaattctacatcccacatattttttttttttgacttagtgcatatctttagtactggttctttcaaccggtactaaaaatcaagatctttagtctcggttgctacaactggaattaataggggttgagaactagtactaaagatcatgtctctcctagtgcatgcatcgcaaaagctgttttttcttgtgtcatatgatcgtgccacacacgatttgctatcttttcttttcaccggttttatagcaatatacaggtttgaaagaaattggttgaagtataccactgtcgcgaatggggtgcgaattcacagtgaggtcatacggtgagtgtgtggttttgtaacgtgttcatgatgtgtcatcgcgagttcgcgcggggagcgcgcgacttcaatagatacatgtagcaggttcgcatccctttggagcaaactcgcacaattaattaacttgcgctattagcaattggtcgttatttctttaattagtttcattagcaattaatttggcagccagttcactgtcgatccaagcgaactttggcgcggcagcgagtttactgaccgaccgatcaagcgactgtgagcggctgagcgccacagtgagtttgcaggtttgcactacgactatgatatgtttacatcaattctttttaaatgtatatacctctacaaatcgggcaccctaccatgggtaggggaaaatcgggcgctgacgtctcagcgtccgatttacgtgcaaaactaatttaaactgatttttctcttaaattatttatccaaatcatgattcgattgcaccattaaattcgttgtaattaaatcttcaaaacaataccacacatggatatattccgacgaaaaaaatatttagcttattattgaattatttttaaatgttgtacgatgttccaccagatatatcgtaattgttttactaagtagattgaaaatgtttccctcgtttaaatcgggtgttgtttcaccttatataaaaacaatgtttcataaatagcgaaagaatgtttcagttcactgcaacatttttggtggaacaaaaaataaaacgaatttccttaatgggggtgtcagggttacgggtaaggtataccctccacccttcgatatacgtcacatatcgatatggtatgtttgcgcgtatacggacgttctcagcataagtaaggtataccttccacccttcgatatacgtcacatatcgata

SEQ ID NO: 53254 - DNA, 155 bp, Oryza sativa
agcttcatcttaacctttcctgtagctggagctcagctaaacagtttcagcttcacctaaaatgagagcagagctgggtggaacgctatcataaaataaacaactccactttagacttaagctaaatttagaagttggagttctaccaaacaggt

SEQ ID NO: 53255 - DNA, 1501 bp, Oryza sativa
ggaatcccggccgtctcggaagcgcgggcgagcgggagagagggggaagtgggcgcgggaggcgtgggtgcgagggcgacgtggacggcgtggcctgggaggcacggacgcgaggcgcggcggcggttgcgggcgcggcggcgagcggctggaggttgggggaggacccgacaggtgggccccacctgtcggtgaccccgggagaggagggggcgcgggctgagctagggcgtggcctccggccggcccagcaaggcgcggggagagaggaggggaaatgggccggcggcccactaagggaaaaggagaaagaaaaggaaaaagaaagaaaggaatttccagggatttaaatattgcctgtgctcaattttaattgattaaaattatttctagggctctgaaaattccactaaaaatcctgttagtgaatttcgacatgtagaactcaagaaaaattccacatgtcagattcgattattatttgtattactttcttagggttttctcttgatttgcaccggcattttcttagggtcatttataaattaaattttaggcttgggaggagaacttcagggtgtgacacgctctccgtgccgtccgcccatggcgtgccgatctgccggatgtcttgccagtggatggcgacgttctccgtcggcaacgagttcttgacgttgacgacgatggtgtccccctggacggcgtggatggtggggcccaacgtgtggccgttgatggtgacggccagcttgcggacgtagtccaggacgtgaactggtagctgatgtcccagtcgtcgccgcggccgacgcgacactacacagcgctgcgatggcgaggaagaggctgcaaaggaggcggcggctacaccgcatcatgtcccctcttgctcgcagtcgcagctccattgtttgctttgcttttggttgctagctgctctgcctgtgcgtcgttttgagcagggcgaccctagggggggtcaggctgtgcggccgctcgagtccctcaaaatctaggggcctttatacgtacacatatagtatatatattatgtattgtataattttagttcttgggacatgggcctatattaagttagacagctaaatagcccaacacagaaaatgaattttagtccatcgccaagtttgtttcagcgaagccgaagcgatcttcatcttactcccgtcgcttcgcctcgatcacatcatgcatgctactcacgtcgctcgctgctcctgcgctctcggcgacttcttagcgtctcgcaaacgaaaacggcaagtcggcaaatcgcggctcaccagtagccatgctcgtttgtgtcgatcgtccaccgatcgccttctttgctcgctactgctcattgctcgctgcccctgccacctgctgcctggactacactcctccaattcatcagatttcaaggtcctacactcctccaagtccaattcatcttatctgatgaatttctctatctttttttctcttaataaga

SEQ ID NO: 53256 - DNA, 177 bp, Oryza sativa
ttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagat

SEQ ID NO: 53257 - DNA, 416 bp, Oryza sativa
aatagccgtgctcacggttaatgagcaccgggacatgtattacacttggctagactctaaattcttaacttgtgggggatgggatattgcatgatgaattttatgctgatggagccatttcccgagaggagggaaggtggacatcctcagaaaaccatgacgattcaatggcgggaagctatccttgggatcacaatggatggtggacagaaccgtcgttgtttgaagtgaacactggtactaaaatttgatcagtctatgctaggtttcaggcttgtgaaaagaattgtaaaattagctttatgcaaaagaacctgaagccattccttgaaataccctctatcatatgcattgttgttgtggtggcttgctgagtatggttggtactcacccttgctattcatatatcttttagg

SEQ ID NO: 53258 - DNA, 825 bp, Oryza sativa
aaatgtgattattgtaaatagtataactatcactttgtcggatgaagaagtgaccaaaataaaagttgtagatcttgatgagaggatcaactttgttattgaccatatttccatttgaaatcatgtagtatttacaaatgttgtatagatttgtcatattgtcaaaatcaatttcaagctgttggaaacaaagttatatagacaaatgaccaaaataaaagatgtagatcctgatgagaggatcaactttgtttttgaccatatttccatttgaaatcatttagtatttacaaatactgtttagatttatcatattgtcaaagtcaatttcaagctgttggaaacaaagttatatagacaagtgaccaaaataaaagttgtagatcttgataaccactacaattttgttattgaccatatttcgatttgaaatcatttactatctgaaaatgtattatgactaataaaataaattattatatagcagctatatattttgtactcacaaatataaagacttatctggaaaaatagaaaaatagtcatcggtgacgggccttagttcaagcccgatagagattaatctatctctatcgggcattatcttagggcccgtcacagataagtcatccgtgatgggcctgaatgtcatctcaatcgggcattagtatggaacccgtcaccgatgagtcatctgtgacgggccctacggcaaagcccgattgagatgactcatcactctactataactagggtttctcagatcggatcgaacatttttcaatgtcccgctacagtttcccgcctccttagaaccctagtgcc

SEQ ID NO: 53259 - DNA, 368 bp, Oryza sativa
ctagatcccgtgctgaatgcggactcagatgcaactgacgaagtaggccatgctagcacatcatgtgctatgctagcgatagttggatactttgagtgattggtcttccaccaatttaggatgtcaaatttgttcccaaattgctggatatgattctatttgaggtacatatccaattcagtatcaacttgctcagttaattgtttagtgatgtgttgaacccaatcagcaataggatcattttctgagatagccatcacatgttcagcttggcgcagagagttagcattgctatccttgagtttatataagtactccttaaacaacatgttcaatctcttcgtaattttgtcaatcctttctttagc

SEQ ID NO: 53260 - DNA, 1501 bp, Oryza sativa
ttgcgttcaaacgggcggatttgcccccgcaaatctcgccggcgccattgatggcggctggacctcccgcgccgatttccttcccctccggccgctctctcccccttccaaccctatttaaaccctccccgcacctcctccgtccgtttccgcctctcgccgcccttcctcctcgccggattcaagctcgcgacgtcgctctctttctccgccgtcgccgccgagctccggtccgccgccgccgtcgccccgagccgcctcccacctcggcgccgcctccttcggcttcgccgcatcctcgccgacctcgtccacccctccgtttcggtcgccgaccgccggagcgccgccgtccccatcgacccgagccgcgccaccgcctccctccgctccggccgcctcctccgtcgccgtcgtcgccccgggggtgtgtaccgtcgcctcctttcccccttccctcccctctcttggccgccgctccgccgtgccggtggtcgccggcggcgaccatcggggcgcggacgcgctgcctcccgccgaccgcaccggcatggctgccctcgggcgcgccgagtggctcccgcgtggggcccggccgtcagccgcccgcgccctcgggtgcggctgatgcgtggggccaacgacgccggccggtgtgagcccgggtgcgcccggtccaccgtggaccgtgaggctgccgcgtaggccccactcccgtggacccggtccgcgcgccccctcccctcggctgacgcaataaacactttttaaattaaaatttaaatgaagaaattcgcaaatattcatttaaagagcatataaatttcaaatggccataacttggccatttgaactcggaattggaccgttcaagtctctaatttttccttaagaagtcaagaacccatttttgtgctttgttcctacttgttatatggagtttattagagtaaaagccctattattttccgttggtcgtgtagacgctgcagcttcggaatatccgctcttcgtggaggttgaagccgacgtttgggaaagcgagcaaggcaagtcacatcgtccttgtacatattgaatccttgtttataaaattattttgatttaaattattgcattatcgctttatttaaactcccgcgttatcactgttttatttagccatgcctattaacctttgttataaccttattattattgttattgatattattaccttattcaccctagattaaaaaaaaccccaactagtggacactctactcatggtaccactggtatgattttaggtagatgcttcgctcgttaattaggcaacattaggtggttttacaactctagactttgggaatactcttatcaccttgacactatggaatggttggattattgtggaattggattcacacctccccctctattcaaaaccctcaaaatggttttaggcaaggctcagggtgcatggttttgatagtagcacctcggccatataaggatcggt

SEQ ID NO: 53261 - DNA, 1501 bp, Oryza sativa
ggtcttgacttccaaccaatggtagctgtgaactaagcagcatgcttggaatggaccaagggtgtgcccttgttaactctcttgaggccagtggtggattgagttggaaacttaagttactggaggcatacccgctgacattctttcctttttctctgttaaacatctgtgatagggattgaggtgagagaggaaacaagccaggaaagaatagaccagaactagggacaggaccttaaaggaactaactcttcttgttgatgtgttgtttgtttcacttattctgcaagttgattaagcaaacaacctagcatggttacatcacacaccactgatgcaaaccacgcgctacacacacaagcaaaggagcacacgactaacgaaacactagagggtggcttaggttctgcgacgggttctccaagatcttcactcctgcttcacagctggcttcattgcttccttcgcttcgctagcggaccctgcggtcttccggaccttcggcgaacaattgacgacatcttcttcttcgtaaaactaaccatctagtactagctgaaatttgaagaaggaagaaagagtaaacattttgcaaatagcacaggggaaaggaggaaaaagggactttcgcaaatagtttcgtttataaaatatgtccttaggttttatccacttggcttatcctacagtcgagatggctctgataccagcttgtcgcgaccgggaaaattgccttttcccgaacgctagtgtattaattcccgtcccaggaaaagccggggtacaccacacaaacatgatataaaagacacatctttattatatcgataatatttacattattacaaaggcgcttcaggcctggcaatcaaaaataaacagcagcggactagcgggcctacggctccatcttcacaggcgctcaactggggtataagccaggactccacctaagacatcttctccaaagcttctcttactgaagaggggaaagattgagcaagaataagtacaaccacagtactcagcaagccacaccggagatgcataattattgcaagggagtacaaggggataataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccatgtgccacataccaccacggtatacggacggaagacatgacatagt

SEQ ID NO: 53262 - DNA, 1501 bp, Oryza sativa
atgaaattttatctgaccccattttatattggaatttattaattaaaattagatcttctcttctagacttttaaaaataaattctaataattccatttaaacaacaatttatatatttaggatttttagggtgtgacagctatgcccccgccaccaacgtcggcccaccgcctgctaccgacctcgtggcgtcgtcgccgcctcgccctccacccttgttcaccacccattgtcagtccgctgcccctagccaatccctctaagtctgatcccccactttcccctccctagttccactcactccaccaccaaagttctaacgctaatcttaagttggggcttgtcgttatgtggatgggacgcgtttgtgagatggacatctcgcgagtgtttgcgaactagtgtttccacatgccaacaattcagtagaaggcagaagtaagaggcaaagtgagagtatttgctgctacccagtggtcactagctaatcgatcaatcggttgtgcctaatttctaaataatgaatatgaattcaaatgatgatggaggcttcaaataagaaaagcagtgatgcgctacccgatacgttccttcatgcttcaagcttggccagtgtttttttttcttggcaagttgtctgtgactctgtgtgctacgccgacggctatgatgattggtcatctaggtcattgttgacccccactagtagaggataactttttccatggagctattgatgggatgaaaacagatatagcaaagatagtgatgtttgattatatctagaccgtagataaaagacaatggttgatattggctcaaatccacattgtgaagttaccaactctaggagatccgcacctatagtattactctcggctgatggaaacacgtggtctgtggccccgattgcatcaattatgagtggattgtctatctagccatttgattttgtttaaaaaaattactttttgaaatttgaatggttagaaattctttaaaattttgggaaactcttataaactaagggtgcacccatactataaacctaacctaatccctcctttatcagttggccactccctttgcctgatccgtcaccgccgccgccggcctatctcccatctttgtacctctttgcctaattcatcgctacccctttctaacctcctcacttccctatgcccgatctgcttccctcctctcttcccaccatgctaatgcacaccgttgccatatgtttcgtctcctccttcccgcctcccctatctcttgtcctgccctcattttccactctagcacgattctccctatcccgcatctcccccatctctagcggctcctatcatcaggcttgctacgatcaccagtccaacaccctcctccctcatggttgaggtgatctctgcctcactgcggtgtgtagtcggagagacgccagaactatggagggcgacaagagcatgaatcttgtgcatggttcgatggtgagtatattcga

SEQ ID NO: 53263 - DNA, 1501 bp, Oryza sativa
atttggttctagcttctcatacactatttccttttgttagagaaaataggatgcagacagactcagatcgccatcttctcgagcacatgatctacacaagtagccaattctgcacaaagttaagtaaactctaaactatatacattgaattttgcttcccaatagcagtgtagaagataatagattttctaattgcttttctttgtatatgctcattactgtccttggtttgtgcttattcataacaagattgtttgcctatcctttttctctacaagatgggcacatttaaatgaactatttatcattaatccatgatggagataatgcgttgaaagctcagttagtccgttgcttattaatttaagttaaccatttttcttaggtcaattattatcttacattaacataatagagaaaaattttcacttttgagaggattcaacacaatgtttcattcaaacaagcgccttcagcaactgttcatagaagtgcattcttcttctagagcaatgtacaatgatttaggatttgacaaagtaattttcaatttatcagaactgatttctcataattacatcttcatttcatattggccagagcattgccagtgagcgcgctataactgtggtatcccaatcagtggcactaagttttaggttgactgcaatgctttttctctgcagttgctcctaactgcaatttctttttgtcaaacctcattgatgtattcaacaagtatcagtcgctgaagcaagttctgctgcagcacaaatctaacagtgttaggttctcatgttcttctggttatacttagcattctttaatgtcaatttatcacatttctggttatagtttcttactctttttttacagcatctgtatgaaacaacaacagtcatttcagcattctttcctgctggtaggaaaaatgtggactcataacaaatgtccaaaattggcgtgtttcatttgacctaaatagtaaaaagataggcattagtacagttagacatggcttgtgggtaattaggcttacctacatggtcattaacttagctataaagttgttgttacttgacaagatcagttaacagttaattgccagaactaaggcttacaactagtacatcacttcagagaacatacttacttaaacccgcaatttgcatgtaccgtattcttcagatacgttggttgcccatataaaatggggtcttaattcctttacatgcaataattcataaagtctgaattcatcttcaacagtgctttggtcacaaccaattgaagcagtagttgtagatatttcttaccacacacattttttattgtagtgttcaaataaaataaattcactctaaatatttgcttgactaaaactcagttacctttattgcatttcaggattctgttataacctgaaacatatttattcaaccctttataaagttacatgtccatattatatattcatattaatattagtttattccaaact

SEQ ID NO: 53264 - DNA, 1501 bp, Oryza sativa
gtagattttgatttaaccaaattttggcttgatctatgaatatatagtaaaataaaaggatcattttttttcttcaggaaagtaaggatgtaaaatcaaggaggccagctgttccattttgcttttgaacagctcacccaacttgcacttgatgcaacgattcgattttgctgctaaaagacatgttcaattgaatatattttcattctagagctgcaagtacatattcaattaaatgtcattttcttttcattttgctgctagaaagccaggttcaattgaataccctatctaatcaaattttctatttgttcagatgtctgtacctattaactccgaaatgaacatggtaggatggtttaggtttggagactattttttgttcaagacttcatgtacctattaacgtttgcagcaacaaccgtattttctgatttaggccaaaacaaccgtattttctgatttaaacagaaaagcttattttctttgatttaaacagagaacccagtaagaaatcatgcacatgcaaaattacaggccaaaatacccatattctcctatatatttaaatacaactagaaatattggcgcgctacgctgcgcccggttgacgttcccattgactttgaaggaatacccattataagtaatgggtccgacaaatgtctgaatgtcattcacccgaatcacatcgatcgcacaagaacataaacatgtttgcttcggcatgtaatggttgaagtaggatagaagaacttctacgaaatatctttacacaaagtggtgtctgaaatcaatgtcaacttgcaattacgttggtattagaattaggcagaattaactaatgtatggagagctcccatgtttggccatggccaggacaccataaaaacaaaaggtaaatatttgctctattatccttccaatcgtgccaatatcattcagcaaggcatcacctatcatacaattcgatagaacatataccggtgttaccacactaatagattgaggatagtatcaatggagaaaagggaaagatgcaatgcagtgactgattccgtaaagatgggtaaggtaaggtacatataaacagagaagatgttgacctagtgaataaagcaccaattattagtgcagtcaacaggagagaaataactcaacaaataaatgaattaatcagtgactaaatatagcagtttctttgtgtaagtcaaaactaaaacctatggatatgctatataacttatctatacaaagattaaatcatatgtaatcatgtaaggacttcacttgtcaaatgtcaatgcttagctaagttaatgtggcataaagatgtaaccaccatttgagagcatgaatacaacacaatagaacttgattacacatgctatttgggagctttgctcaacaactgattactaccaaatggttaaattctttatttgtagtgcagtttggaataaactaatattaatatgaatatataatatggacatgtaac

SEQ ID NO: 53265 - DNA, 159 bp, Oryza sativa
attcctgcagcccttaaacgttatgaaacatctgctcggggaaatcaaaattgacaagaggagaaatacatatttataaatattttaaaatacttgatttttttctcgagtattatatttatatcagatactactcatcctatatgtttgttctacagg

SEQ ID NO: 53266 - DNA, 302 bp, Oryza sativa
gtcagtaagccgcccgcctcctccccttgttcggtcgccgtcgccagagagccgagggagagaggagggagaagaagccgggagggagagaaagagagaaaagaagaaagagagaggaaggagaggagagattagtgggccccacgtaattggtgaatagtaaccctcttcttaatctttattagtagtgtctattacatgtgggtccgggtggttaaaaatctaattatagaagttttatggtctcgagtctatgacatgtgggccccacttgtcattagctcttcctatttccctttaga

SEQ ID NO: 53267 - DNA, 717 bp, Oryza sativa
tgaagtcgggggtcgatggacattctccagggcaaatgaaggctacacgagctgcggcccggtagtcgagatgtcatatggcagagggttggtgccctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagt

SEQ ID NO: 53268 - DNA, 1501 bp, Oryza sativa
cgttatcactgttttatttagccatgcctatttacctttgttatgaccatattattattgttattgttattattattaccttgttcaccctagagtaaacaaaacctcaactagtggacactctactcgtggtatccctagtttaaatttaggtagatgcttcgcaatttaattaggtaacattaggtggttttataactttagacttgggaaatattcatatcacctggacactatggaattgttggattattgtggaattggcttcacaccgccccctctattcaaaatcccctaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatatggcagagggttggtgccctgctgctaggggctcagtcctgcctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttgacttgggacgagctgggacccagggtcgggttgccagttcggtctgaatcatcataggccttgggttaaggcaggttcgtgtgggttcacggccttgattaataatattgtatagttctaagatcgtgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgatttgtatcaacttttggtgtaccttgcctcctgggacaaggattcatgcacgcacgtaaggaatgcccgttgggttatttccggtcgtgacagccaccaagacctctggcgctgctaccaccggctccgtgtcgtcaagg

SEQ ID NO: 53269 - DNA, 1501 bp, Oryza sativa
ctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggtgccgtcctgggggtcgggggctcctggcatcgtcggacaagcgggcaaagggccaactccggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcaga

SEQ ID NO: 53270 - DNA, 1501 bp, Oryza sativa
ctgggtgttgcagcgagagatcttgctatgaatgatagctcaacttggtaaattatctttgagaaaatagtttacaaaatattaaaatccagaagaacaaaataagagtcaggttcaactcaaagccaatttttcgagtacagtatatatatgaaaatgggtactcctagggagtacatactcccgctcctattgaccgtccatcgaagcaagccccgatgaagcccgttaccggatccacacgcggtggacaaatttccgtccgcggtaatcggaaaatcgaaacaatgttgagctcgcatataaatccctctcgacagccctgatcgataaatcaggttgtcaacgggcgattcagagcgaacaacggcgattttgtgacatcaatccatggcacaggtgatatgagattctctttccgtcttctttgcttttctcgtggagcttcctcttgttatatcagtttttattgctcatgcacgagaaacgatctttaatacctgttcgagactagtaatcgagactaaactttttgatgtttaattagtaccaattgaaacaacatgtagtaaagatgcatactaagtaaaaaaaaataatagtatgtgagatttgaattcaacatctcgtagcataactgtacaatactagcagatatattcatagttttattttatttcttcttaacccttgtttagttctaaactttttcttcaaactttcaactttttcatcacatcaaaacgttcctacacacacaaacttacaacttttccgtcatatcgtttcaatttcaaccaaacttccaattttgacgtgaactaaacacacccttaacttaactatacctggtaggcattcttttcatttccctgtcctctgctcagaaattgtactcgagcagtacgtgttgagttccgcacacagaatgtaatacgtgcagaatagaacaatactagtactaccattatgtagatgtggatgtttctgttgtaaccatgataaattcatcatggtttcttcgggaagcatgatgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcaga

SEQ ID NO: 53271 - DNA, 794 bp, Oryza sativa
tctggcagctcatacatggtgccggctacgagatcggcttggaggatcaatctaggtagacacagcgtgaggtgttgtccactggagcagcagatcctagccgcaattttgggcaccttgaggagcgtgtcggcgatctcgaaacacctgtggtagtaggggctgtagtacctgacgttcgtgacgccgatgtcggcggcgctcaggaggagaggcgtgatccacgccgggtagaagggcgacacggcggagcgccagtgccggcacgtcaatgcgaagctcgggtgggtcgaccacccgagccgatccaggacgagcacgagcatgtccaacgggagagacgaccagtcccgtagtccctgcgccgccgtcgcagtggcctccatctatctgcttggcgaatctcgagggttcgtgcaccgcaatggcctgcttggcgcgctgcgttttgtgctgctacggagctctgctttcttgacgtgtttcctccggactcatatataggtcggcttccgcttctgcttgtagtttgtatacccggcacggttggtttttgttggttgctatccaatctccatagatgcatatgtggtgatccctctttatccccggcccagattactgtttccttttactgatttaccggcccaaagtactagtactataatttgtttgaattttgatgtcgtgtaggaattcatgtcctaattggtactagtaatcgtaggtcgtaggcgtgcagatttcttcgcttctctttcctatatgccagtaattgcactgctcaaagcctc

SEQ ID NO: 53272 - DNA, 650 bp, Oryza sativa
acgaaggaataaggggtaaacaataatcaaggcatggcataatcacaagtaggatgtttatcattgcatgcaattttatttgtaaacaaaacaatttcgcaattgggatcaacatgttcaaagaatagtgatgacttgccttgctcaggataatccttattattgatataatcttgatcaaccttcacctcctggaagttgcagacgttgcctcacgactaaccgatgcacaaggtctataatacgcaagaaaaaccaatattcaaataacaaccaaatatgcacaacaaaatatactattcatgtctactaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttatttatggaagctttactttaattatgaacatattttacttgtcacaataaattataaaaggttaataattatcca

SEQ ID NO: 53273 - DNA, 1309 bp, Oryza sativa
cggcagcggcagagctcgcgacaacgacggcgggagctgcagtcgggtgggatgtgcggccgacaaaggcgaggaggcgcggcccggcagcaaaggtcggcgcggtgcgaggtgcggtcagtagcgaaggtcggcacgacgcgacgagggtggcggcacgcggaggatagccggcgtggggcgtcggtgcagcggtgcccacatgtccgcggaggttagacaacagtggagcattgatgtgtcagcgatggattggcaagcggcagacggtgggtgaaaacctagtccggccttggtcgagctggcaacgattgcgttcagagcgtcacttcctcttgagggtgttgtcgtgctatcccatcctctcttgtggggctaccgggtgaaaacctagtcactgttctctttgaagaccttgacggacggcggcagcggtgcttttgtcgttatctccctagagacatcgtctaagcagctcccttgtcgaaacctcccaaacaatcgttgcaagcttgctctagattcctgttctcttatatcggcgccttagcttatgcaagttggccatgttggagggcctaggggggagagcggttccattcttctctctcaccctctcccactcaatcccaaagacatggatagagtaggcttctgtgttagttgttagggttgagttttggacaatctcggttgtacatcctttgttggcttagtggcggccggttcggtgctagccttctccagggtctgtgtgttggtgctgttggtgcgtgggtggtggtataattttctttgttttcctaattacgacctcccagtgttgtaatcttataatttttttcctacttatcaatatgaatttcgcactgtctggtgcgagtcgttaaaaaaatctatttcttaggtttatttcttgggggacggaagagtatactccccccgtcccataatataaggaattttggagggatgtgacatattctaagacgacgaatctggttaggagtttatctagattcgttgtcataggatgtgtcgtatactcatatcccttcaaaatcccttatattatgaaacggagggagtacctcaataacgacacaacatttattgttcaaatcatttacttctagtctacacaaattataatttgctaagggagtatgcttggtaacaacacgacagttattgtccaaaccatttactcgtatcctacgtaaactgaaatttacaaagggactatactccagtaatagcacgattgtcattgtccaaacaatttctacccccaaaccgcaactgtagc

SEQ ID NO: 53274 - DNA, 1501 bp, Oryza sativa
aatactcgttgttgtttatgctacatatttgtcatcgatgactattctatccattactttcgtagatcagtaatagtataaacaacgatatatgagcctcacttatttgaaaaaaaagagtaaacagacaggagaaggttcagatgaaaagagaccctccgacgtgaaattagagagatgtagtcatggatatatgagccccatcgtttcccgggcctaaatgtactccttccgtcccataaaaaaacaacctgctaccggatgtgacacatactaagagtaggtacaatagcaaactataagccagctaatatacatattttaacgagataaaagaggagagataaaagcagcgggctacagatttgttgctagctgtagcacggactccaagacgcatgtgtgtatgacagatgggaccagatattgattgtgtagtatatgtttataggtaactattgtatgaatcggttattaagttaactatagatgatttggagtcaatagttggctacactattaaatttgctctaatactacaaatacatacatacatacatacatacatacatacatatatatatatatatacatatatatatatatatataaattcatagtacttagatgtagatttgttttttatgagacggaggaagtaagtggttactacctctatcttaaaatatagtaaggctgtgtttagatcaaggggtgaaaaattttgtcgtgtcacatcggatatacaaatacacatttgaagtattaaacgtatagtctaataacaaaacaaattatagaatccgcatgtaaattgcgaaatgaatttattaagcctaattaatatgtcattagcgtcaaatcattgatcaattaggcttaaaagattcgtctcgtaatttacctataatctgtgtaattagtgttttatattatctatatttaatattttatatatgtatccaaacaatgtgagaggttaaaagaagttatggaggatctaaacaggcccaaacaacccatcctacattttgggacggatggagtagtcggaggatttccggtccagaccaccacgtcagcggcgtgccgggtccacctacccgaacgcgcgcgagacgagaagaacatcggaagagtgggagaaggagaagagaacgatagaaaagaggagtactatcatcgaaacgaaagcgaagcggaaaaaaggccccgacgcagaaacagcatccgcaaacgtgcccccgtctatccactcccctcctccccttcccttccctttgtggaggccaggccaagcctcccctcccctccccgctcctcctacgcagcgccgcggcggcggcggtagaaggcggcggagctctccaccctcccctccgccgcggcggcggccgtgttcctctgcggtggagaggccccccctggtcgtttctccgcgccggctcggcatctctccggaggaggaggaggaggaggagggaggagtaaggtgtgggga

SEQ ID NO: 53275 - DNA, 586 bp, Oryza sativa
atttccttgtgcctgccattgatatgacttatgaggctgtcagggtcactgttcatatgtaagcagggtatgccacaatgttcatatgcaagcatccattcctaattacaaagaggaaaaggaggaaaaagaaaaaggtgtaccatattattgacttcaagtaacagggtttcctgtacttcatcaggatatatctcataagtcatatcagctgaaaatgttgaaaataatagttttttcctgtaaatatggatagtctgggaaaatgccacaatcatgcagtataatttttgtccctatactgcatataggtgtgacacaaacaacaaacgaaatgaatatggtctatcattttgtagaacccaatattgaaggtttacccctttcaaggatctaaattaaaagatagccctttaatctcaaaaaaagggaaagaagatcctgcaatcattaacttgtgaattgcttgtgttgtccctgaactttaggataatacaggtttaattcgcttttatatatccgtgcacatttataaactttgcatttattgaattaaactattatttattgtttatgtgcatccagc

SEQ ID NO: 53276 - DNA, 1501 bp, Oryza sativa
ttaattaggcttaataattcgtctctcaattcacaagcggaatctgtaatttgttttgttattagtctacgtttaatacttaaaatgtgtgtccgtatacttcaaaaactttatacccaaagaactaaacggaatctttttaatagctcaccaaatgtaaatagcagagagtaagactgttagagatgttttaatgttactatctccgtcccaaaatataatatattttagctatgaatctgggcacacagatgtctatattcatagtttaaaatacttacattttaggacggagagagtacatgttcaactcagatattctcatacctcttggtcttgttttgaactgatgcactcaacaacacctcaacttataaatactcatcttataaaatgacaatagctcaacatattaatccagaaaagcaaaaagggtaattaagtactacatacggttcgagaccactgtactaaaaccggaagccggaactgctgttggccctctgcacaaatggatgttttatggagaagtggagaagagttgcccaaactgaattgagtttgtgactgagttcttgttgtttcgttgctgactttcagtgatgctggccatatttccgttcctgacctgagcactgctttccacttatttagctgaaagctgtctgaaagctgtggtatgttcgaagtaggtttcaggcgagttttaatccaaactttttcttcaaattttttacttttcacttttctacacacacaaacttctaatttttccgtcacatcgttttaatttcaactaaactttcaattttagcgtgaaacacaccagtttctttcaaatcaaatttagtccaatatgatacaatttctttcaaatcaaatttagtccaatatgatacaagctcttgtagttcatatttttttatttaaactttcaacttttccattacatcaaaactttctacacacaaacttttaacttttttcaataaacttttaattttagtaacttctaattttaacgtggaactaaacacaccccaatataaggaatttggacaaattattctctttgacgtcatgtttttcaatgtttcactggtttttgtgaaggatcagagtttttcaatatttcactggtttttgtcaaggatcagaccacaacgaaagccacatggttaaaatcttcgcgtcgtcactacgtcatactaatatttactctccagtttgttccctgagagcctgagtgacatcatacttgcctcttttttttggttgcatctggataattttccggacaactgtcaaaactcattaaattccatgagccctgtttgtcaacagcaaaataataataataataataataataataataataataataataaattttaaagaaaaactgccgctgaatcgactacgccaggaggatctcgaaacgaaataaacaaagaaggcaaaaagaaaaaacggaggtgaaataaaaaaaattcgaaaa

SEQ ID NO: 53277 - DNA, 595 bp, Oryza sativa
ggtatggtcgagaacaacatgaagatcctggagctgcggcaggagaacctgcagctcaagaaggacctcgacgcggtggaggcgcagctgcatcagctcaagatcgcccagggagaggtctgccgccccaagcgtcgccgcgtctgccgcagccagaagatcaccgcccgcaagagcacctccaggcctgagcttgttcgtcagtccctggcgtggacctgcttcgtcgagacccctcgtgccgagcccgcgcccgtggttccccaggagggggaagcctccggcgttggtagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactgtgtcggagcctgtcttattttatttgcctaagcaacttgaactttaatgaaccaatttaatagcagtaataaatttaagaattatggtagtcgtgggtggttagttttaattgttagcttctctctctctgtttgctggttctgtgtggggttttc

SEQ ID NO: 53278 - DNA, 1501 bp, Oryza sativa
aagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgcttccggatcaggagggagacgacgcggagccccacgctgggtgggaggtcaccgcagtgatcctcgccggctcttctgagcgggcttcgttggcagtcaccgcgggtggagactccttccccgccgcttgccagagcgccgctctcctcgccatcggcacccttcaccagcgctacccggacgagttgcagcactcgccctaccgctaccaccctcgtcgcggaggagcccgcgactacgccaccttccgggatgctagctcggaggatgacgctaccatcgtgcacctggcacgcatggtggaggcgtacgacgcggctcgtatcgacttccatcagatggtacgccgcgggatggtcgagaacaacatgaagatcctggagctgcgccaggagaacctgcagctcaagaaggacctcgacgcagtggaggcgcagctgcatcagctcaagatcgcccagggagagatctgccgccccaagcgtcgccgtgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgttctttctcgtttgtcttttttggagtcgtgtggggcatggttatgccggtgtgtggtgtaactatgtcggagcctgtcttattttatttgcctaagcaacttgaacattaatgaaccaatttaatagcagtgataaatttaagaataatggtagtcgtgggtggatagttttaattgttagctccttctctgtttgctggttctgtgtggggttttcaga

SEQ ID NO: 53279 - DNA, 1110 bp, Oryza sativa
ctgcagccctaaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctaaaaatattggaaaagtagaactgttctcctccctttctcttttaattaaccaaactaatggcacatgcacttcataatttttttttggttctcattaaaaatttattccagtgttattagtactgtacatctattactgtactaatggctcatttatcagcaaaagttttacaatattgttttatttaatcttgctgcaataaaataaatttaccatgttgattttataattttctttcatttcttttgaaaccagttattcaaaattacaaaatttatgatctcgtttccaactgttttaatttatttcgcaaagcttggtttactttaattacttacctttttactttgattttcaaactttattcaaattaatccaaaaacttgtgctattaattggatagatgtcttaactctctcctttcacttgtctttaga

SEQ ID NO: 53280 - DNA, 1501 bp, Oryza sativa
tcaatgaaccagcattgacttcatcttcatacaaaaatgagaggcaagcttgaccatagaaatggaagcagttccattgataggattaacattgtttgggattagtaatgagaagtctaggtgcccactttgggaaaaactaatcaataaggtcaaagtgtgattgcatgagcaaatacaggttgcatccaatccgactgtacagaaagctgaaaaaccttcaaaagacataatcgatcaggtgcaacatagttcatcgaatatatcttacccgaggaactctccaaactgctcaattttccatcacggtgcaacttaagagtaagttcttgaccatgaaaatcagacgcatctaactgcatgcaacacagaaaaacgttaaattcgagatcccttgtgcagcatgccacctggcacataatgaaaataatatccgcataacctgatttagaggccactgtattagccaaagttccgttgactctgtttgtgatatgtcaagcatagcctcttcgctgttctcctcaaatgctggtccaggctcatagctacaatggttggttgcagcaaagttaaaaataaattacagacaatgcaaaaacttaccaacaagtgtataattgaaacaaaatgagctactgaattcaatccaaaaatccacaactataattttccaacctctcttatctcatatttgaggcataactgttaatctgttattcagagaggaatcagaactaccaaatccacaaattcgatataccattaaaagttgcaaatccacctaataagtttcgttctgaacaaatattgcatagctttactgtagataaatgcaatgctcaaacaaaagcattcctgcttttaaaattgttattcagatgtggctttgactatcaaacacgttctcctattgtgccccttcgcaactgctgtgtgggacgaagtgagatcaactttcccgattagtttatgcagggacgaactaacaagtatgagacagtggatttcagatttcatgaagaggagttagtgcctccaaaacacagtgttagcagtcaccctttgggacatttgggaggcgaggaatgattcaaggaacaagtcctcctccttgcatctgcgtaaagtgggacagaagacagtggcatatgtcaacatgattgtgcagcactgctacaaggtgacgatctgtccgagaagactaaccgctaaatgtcttagcctgctatttaaaacgctgctgcccaggcaattttcctcatcaacgtcattcgagatgtaattcttggagtgtatccgggatgtcctctgtacagatgctacttacttaatcaatgaagtgccatggttcatctcaaaataagcacgatactgctacacgcctacactgcgtcagaaaatgagaaaaaaaaaacgaacaaacctcctcatcgtggtcggcgaggcgacgtttttttttttttttgaggagcggtgtcgccggagagccggagtagga

SEQ ID NO: 53281 - DNA, 1501 bp, Oryza sativa
agagacccacaggagtatgcaaaacagcctaaccaacaagtaataactgcttcatgaatgtagcacgacccacatttttagaactttgatgagaatatatagaggccaacaagatgagaacaaataggttcaaacaaacagccagccacggaagctgcaaggactgatcaatccgcattgaaatgtatttactccctttatccaggagttttgtcagtatagttctatcacttaatattattgtccgagaccaataaaaaattccttttttttctaaaaagaaatttactccctttatcccaaccgcaaaaatgggctagacccttatgaatatatcccagtcccagcctctagattctagaaggcctaaagagtatatctctgttttctcaccgacaaggtgattagcgattagaaagtttcatctatatatgctagctagctgacaagctttcatctttctgtcaaccaccttaattagttaacttcattaatcaccagtgtatctgcaggatctatatctcatcttaataggaatatttaagccaacgacgacgggccaaaggtaggtgcacgcatatatgttgagagttacaggcaccggcactagaataaacaaacatatgctgttgagagccttcatgtcagcaataattgattattgattcataaagtttaagattattctgtcttgatccattaattgattattgacacttttgggtaaagttaatgacggaatgaattaagcgatgcagtttaggtgacgaagataatgaagttttagcacgttcattgctcaagaagaaatggttatgcatctggactgccaggtgaaaaatattcatctggactcttagccataaaaggagtaattatgcactttaacctcgttaaatgttggtactaatagaggaacagggtcgtctaataaaaaatggcagggcaagttaatcttggacttttagcttgtcagctatatcaatgactgcatattagtgcaaaccgcaaacatatatgagctagttaacttggacacataagccctcacgggtaggggtggccagaaagctcgtggctcgttagctcgcttggctcggctcggctcgtttgaattttctaacgagccgagctggttagagataatgagccagcttgagctggctcgcgagccttaatgagctaggactccatcatagcccaaaagcccaatacaacaaaaaggcccaagcccaagacactgcaaaccctagtcctcactcttcactcaattccccactctcctcagccgccgccgccactctgcctctcccccagccgccgccactccgcctttatccaagtagcagcgcgcgatccgcctctcccctaaccgccagccgccggtccacctctcccccagccgccgccgctgccgccgcgggaagatcgaatgcccgccgccggcggtctctgcctctcccccgccagcgcccgccggctccggtctcctcctctcccc

SEQ ID NO: 53282 - DNA, 1501 bp, Oryza sativa
aacaggagagggaggaggtggcaggcggccaactaactagaggagaaagagggcggtggtggacctcgggcgtgaaaggcgtagtacgacctccgaacagatgtggcggaggcaccgcggccatctcctggccttcagctctaagctcttcgatcgggcaaccacctctcagacggcggcacgaccaacaagcgagggcgagtaagggaacaacgacgacgatggggagctagatgccaagaggcattctgcgagcccattcttcgtcgatgtggcattggtatgttttccttgtggtcaatggtcgatcttgctgagaagatgtccattggctcaacatatgttggaatgatcttaaacatgtccgtcatggtcaggaacgcgaccacagcttggttgctgccaccattgacgttgagtgcagccatcaaacacttggcgtgcgtctctttggaacagtccgtggtatcgatgcagggtgtgtgggccttgtcctcaccatatcccagctccaaggtgaccgtaggaataggtaccttattggtgtggcttgagctcgctgccatgcgtgcacaaccatcattgaagcttgccgtcgagcacttggttggcatcataggcagcgatgtcttgggtgttggaggatgccgccttaaggtcagtggtggctgccttggtggcatccgctgtctcctaggaaagccttcccccttagagcttcgatatcttcaaacttctctaatgcccgatcaagcttatcctccatcttgcacctggcatctatccattcctcaagaaacagccttagtgcttcatccctgaatattttctcctctttcatcacaggcataacatcttccttgtacacttcgaacgggcatgacattcaatcaaacatgtggtgagcgctgctctgaagaacagtactactccccatgcctaatcctttctccctcgcgctgttgagtgatacaggtgttcctcctctcttccatgctaagacaccacgaatccaacagccagattattagcaaccttcttcactcaaaacaagcagtagcaactagcaagacatacaagcttctgattgtagaaagtataaaccctcttcactcaacaagtagcagcaaagagacacaagctcctgtttggtaccgagaaaattaaggaagacgaaggagtggctcaaagtgtactaaacttggtaggaagaaggggaaggagagagagagatcgacaagggtccattgccggttcggtcgacctgttcgattacctggaagtgcaacatttttttttcttttgtctctctcccttcagcttgcttgggctgatatttaggtgagctattgaattggccccatagtgcagcttacttgggccctaacatgtatatgatgtcacaactcgaattgagatcatacacacctgtgaacgacgggtggatgattttttttccaaagaagggtttttttttttatcatgcctctacatccaacta

SEQ ID NO: 53283 - DNA, 1065 bp, Oryza sativa
cttttcttgcatcgttggtacaaccagagagacaaaatgcctaaatactctttgttttctagtttccaaggagtggaagcattttataataacactagattaattgtgctactactgtaataaaagatcatgatgaaactgagataaataataatcatgtgtctatcttggtatgaccaatacttaaactcaatacttttttttcctaaaaaaccactaccttcttttgaacagataaagaacacaatctcggtattcaccggactaattaaccattttatcctcacatcatggttaatcttcatgtgttttacattatccctaatttacccatggcatgttgacccacataccatcgagagaatgagggacaaataagggacatggtaaacttttaaaggcaaacaaagatatatccttagctgcttactcaacataaatcgaccctctaaacaatgcctctagagagacaaaaatgtatcgagaaaatgtctgtacacatatagaaaaaaattagaaattgtctaaaaaatgtctaccacataattttgcacatgtctataaaaccatctctacaatgtgttctatactacaaatatttaggtgatttcatagtgtttctagggagtgcctctacactaggggctttttttttcttgagacaattagatcttctttacataaacttaaacttgcgaaggattgtgtcagtggtagctaggactatgtggttagctctaatgctctatctcgttacatctttccttattccatcttatgtgtgttaaagagtagggtttcaactttttcacactgcctaaaataataatagaggacattgcatgaccattgagtctccccaacacaatgtacaacaaggtgtcataagtgattttgtgcaatgactttacaaataagaccatggattactacacataaaaagaacagatactagaaagaaagaagacaaacaaattgatgagtccttatcaatactccacggggatggtggattctatctgaacccaagtcacacaagtactaaccatacaccatgtatggcta

SEQ ID NO: 53284 - DNA, 667 bp, Oryza sativa
gtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatgg

SEQ ID NO: 53285 - DNA, 319 bp, Oryza sativa
aagaagaagcctcacagtgccaggcaaacccagcatcatgtacgtttttgttgccttaaatgttaactgctatcccatgcttagcacattgttgttctaaatgtagaattgccatgttacttcagcatgttgctagaaatatgcattcctttgattgtaggattttagtggcaaatctactgtgttcaaagccacttctattgtcacggtctttttgatgttacctgtaaacactcatattgctataaccatgtaatatattcatctagttgatttgatctagcaaaatgccttcatcattttttttctctgttctaga

SEQ ID NO: 53286 - DNA, 1501 bp, Oryza sativa
ggtatcaacacatttccagaaataagtcttactaatggtattttcatgaaatacggagtaagtttttcttagaaggctagattgtaagagtaaattttacaaaacctcacctataatggtcaaagttgcacaaaaccacataaaatttggcacgtgacatataacttaagatattaatggtccaagttccataaaaccacgtcactaatcagtttgacatattcacatatcaaaattttaaaaggctatagttacatggatgtagatcatttatatgatgaataaagaacacataaatttgagatgttattgtagaattcaaaactgtgataaataaaagtcgaaatgatcaatagtgtggtcttgtgtaacttaaagtataataatacatgagtctaggtaaaatttactctttgtaaaacatttttttaatatttatatttatttcattttgaagttttatagaaatatactcctcccaccctattgtaaaaaaaatcatttcaaagtttcacaattttgcaggtggcccctcccgacgataaatcgcccaacgggaggcctgcaaaattgtcgcgatgtgccccttctacggggtgccacgtcacatagatggtcttattgtagggtgatttatatgccgaaggagagtatttttgcaaaactttggaacgataatttatattagagtaatttttataaatctttagaaaaacaataataaaaaaatcctgtaaaacttgcagctcaactgaacactccgtagtccaagacgcgggccgtcttggtccgttcggaccacagcccacaggccgacttcagtagactgcagtcgcctcctcgcacctactaccctaataggtcatgccattccactcgagccaactccaccattcaaaccaaacgccgccgcctcctagggtttagggttcatgcgagttcctctcgaaaaaaaagaaaaagaaaaaaaaaaacattcgcgagatccgccgccaagatcggtcgcggcgaggtcctccgctcggtcggacgggggagcgtcggcgcgcgcttgcgtcgaggttgacggcgagggtggagcctcagttcccaccgctcccctagaagaccttctctacgatgggatccaactatccgcggcgagatcctccgcccgatcggcaggggcaggttccaccgcggggagatcctccgcccggtcggcagcggcaggttccaccgcggggagatcctccgcccggtcggcagcgggtaccgccgcggcttctgatcactcccttccgcgacataggtcagaggctgagcaccggtcaggccttcaagccgatcggtcaggtgtccgtcagccggatgttggccggcccgcagttgttcggccggctagcttcgcagctcttcgaggttgaccgctcgctgtccttctctaccgctggtgactccgcagaggagggtgatgaggaggacgaggagggcgaggaggaggagaccgctggtgactccg

SEQ ID NO: 53287 - DNA, 1304 bp, Oryza sativa
aaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgattcccccgagcagatgactcattacgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttgcgttattcggtccatccaacaagcccctaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctgtagcccccgactcactagtcaacggcgaaccagttgatgtagtgaggcaaaggaaaaggcaaaatatcatataaagaataaaataaatgatgacttagctttgtcatattccccttgattatggcagaggtggccaatgtgggaacaaagtcgtccatcaataataatgaagacacccgtcggcggcgacgaaggcgatcgacggtgaaagtgtggacgcccatgaacggtggtgtggccgaccagccgtataggcgaggacaccagtcggcagcgacggaggcaggccggcggtgaagtcgtaaaagcccaacaacagcggcataataggccagccgtgcaggcagaaacgctagtcggcggcggcgaaggccagccggtcggtgaagatgtggacgcccatgaacggtggtgtgaccaaccaaccgtataggcgaggacaccaatcggcggcgacggaggcaagccgccggtgaagtcgtagacgcccaacaacgacggcataataggccagccgtgcaggcggaaacaccagttggcggtggcaaaggccagccggtcagtgatgaagtacaggcgatgatacatgcaaagacaagaaattgcacatcaacctgtggttagatatttgtaaaaaaaaataactgatataataatcaatagatccaaacacatggcttgattggcacttgatagagaggcctgcataac

SEQ ID NO: 53288 - DNA, 1501 bp, Oryza sativa
cggcccgcgtcttggactacggagtgttcagttgagctgcaagttttacaggatttttttattattgtttttctaaagatttataaaaattactctaatataaattatcgttccaaagttttgcaaaaatactctccttcggcatataaatcaccctacaataagaccatctatgtgacgtggcaccccgtagaaggggcacatcgcgacaattttgcaggcctcccgttgggcgatttatcgtcgggaggggccacctgcaaaattgtgaaactttgaaatgattttttttacaatagggtgggaggagtatatttctataaaacttcaaaatgaaataaatataaatattaaaaaaatgttttacaaagagtaaattttacctagactcatgtattattatactttaagttacacaagaccacactattgatcatttcgacttttatttatcacagttttgaattctacaataacatctcaaatttatgtgttctttattcatcatataaatgatctacatccatgtaactatagccttttaaaattttgatatgtgaatatgtcaaactgattagtgacgtggttttatggaacttggaccattaatatcttaagttatatgtcacgtgccaaattttatgtggttttgtgcaactttgaccattataggtgaggttttgtaaaatttactcttacaatctagccttctaagaaaaacttactccgtatttcatgaaaataccattagtaagacttatttctggaaatgtgttgatacctcggtgccaacgttggtatcttttacattagatgataccccacacgctgctacaggtttattattataatttaaaatacacatattagtatgatctattaaaatactaagctgcataaatgttataatttgaacacaaaagcggtaggaacacgctgctacgggtttattataacaactagttgggtgcccgcgcaattgcgcggctagcacccatacaaaagtaaatatttttatatgattttacttaaaatttattaaatatttgtctcgttgtcttaagactttgaaagaccaaaccttatcatccatgtgtttctaattttataatttttaaaagtcacaccagttgctaccccttacttctgtcatatcattttttatttgcttgcttgatctaccattgtttatatttctttctccttgaaacctttacaaattggatcttatagcttttagagtttattgtccagttgggtcctctatggtccgcccgctaccccttatttttattgccaataggattttaacaatcgaacaaaattatcattggggttctttttctttactttctagaagttcggtcaaacagtcatcagctccaccactgtgatcctctatggcccacccgctaactcccctcgattttaaaaatcgaacgtaattatcattggggtttacttttttactttttaaaagtccagccaactgtagtgaccg

SEQ ID NO: 53289 - DNA, 1501 bp, Oryza sativa
tccttttatattatgaagcggcctaaagtcctgatttgataatattgtaaaatagatttaggaaaccgataccgtattggttaaggtttctatcttgtaatcctgccccccatcctatataaggtggacaggaggccctctagggggcatgacacaaactgatcgtcagatcaatatacacccggcgaattcaaatccccaaacaggagtagggtattacctctcatcgagagggcctgaacctgtctaaatcctttgtctccgcatccatccacttttaggtctcgtatgctacccccttttcatattgccgaaaatttgtttcgacagttggcgcgccaggtaggggtgacgccgagtttcctatcaacgagtgcgatggaaatcaacttcagaaagaaaaaagatcaatgtcgatccaattagcaacgtcgccgggcgtttgcacgttcagcgctgatgatcatcttggcatgcatggatgcactggtccctggattctcgctcacaagatgtgtgtgcgtgctgcacgccgtgaagccgccgactgcttgccagggcaaccaatcatgagtgtgcatgcagaccggtggaacgataaagaagcttgagatcaagatcaaccggctagctcgtggccataatatttggcatcatcacatatatcgatctatacaactattacctggtttggctttccactttaattttatttagattgatccctaatcacatgttactctacgttgttttctctccttgatttcatgcatgtactgctgagtgcgtggtgatgtcatactgccatcatgctatcacggtgatgatcatatcgaggctgaagcggagtacaggacacaagtcgctgcgcaactcgccggctgcatgtcttgatccatgcattttggacgtcacgttactctatacggccgtcgcacgttcgcatggtgtcatgatctccaccaattgcggcctcacgcgctcatcaatggatctaacaccgatgactggattggattgtcgaccatacccactgacggccatatccgtcattgtcgaccgggcagatcacacccctattaaattgttcagatatcgggttagctgttccaattcatagattattaaaattaatctttgatttatttatttttttacagatcaatctattatctgtatatatttcctgtcgtcgattcggccgagtcctttgaccatgcagttgtacgtcgaactactcgctgaacaagtcgatggttatacaagtcctgtacagggacggcagctgccggacagaacgaggagccaatgaaccacatgcaatcgtgcatgcgcttttgtgcttatggttatgcaggcctctctatcaagtgccaatcaagccatgtgtttggatctattgattattatatcagttatttttttttacaaatatctaaccacaggttgatgtgcaatttcttgtctttgcatgtatcatcgcctgtacttcatcactgac

SEQ ID NO: 53290 - DNA, 1501 bp, Oryza sativa; identical to SEQ ID NO: 46629

SEQ ID NO: 53291 - DNA, 1501 bp, Oryza sativa
aatctgctatgagctactgctaatctgctatgagctatcactccatcatcagtacatagttcatcaattgtttcggtcatcacacaacagcagcacacatcaatccatcagtacagtacttggatcaatcacaaaacagctacttgcatttgatgattccatcataaatctacagcacaaaagaaatcaaatcaatggtttaggctcgtcggctcgtagctgggctgctggctgctgccgctgggctgttggctactgccgctgggctgctggctgctgcgactgcgaggcgaggcgtcgtcggctccttggtgtggctgtggcgtcgtcgtcagtggtggtagcggcggtgaaacggcgggacggcgccgcggccgcgagacggcgctgcgaaacggcgggacagcgtcgcgagatggcggcggtacgagacggcgaagacggtgggggtgaggttgcgaggagccgaggatggcggaccagcggtggcgcgggcgccgggcggtgggcgctagcggtgggcggagcgcgatgctccgccgccggctcgcggtctcgcaaagttgcgatgccgtgtggctgtctctctcctctagggttagccactatttgggtagatgccgcgatttgggttgggcttaaaacttggggacgagttatagactattgattctatgggcctttttaacttcggaaattccgatattttttccggaatttttccgaccgattccgagttccgacagaaactgctattatcatattcgattccgtttccgagaaaatgtttccgttttcgattctgtttccgagaaattccgaccggctgattccgtttccgaaaacaggcccggaatccggaaagtttccgtaccgttttcacccctacttaatagagcctcctcctttcgcatttgtaaactttttagttgtcgtccaatcccatccaacatgtatcccaaacaaaaaatcggttcatccaatccatccaaccagacaggcaacttggatcatcccccaaaaacatggatgcctaaaacccatccaagcttgctttcaaaccaaacactacctatgtatctctcgcaacgacgtaaggagtcacaactcacaacctcataggccaagtatggctttctctaggccggtcttcatgatcaactaccagtggctgaaacaaagcaaataacgatattgggttatttcgttgatcaaaatagtccaattgaattgttagttgctaatttgattcaaattgacatcattagatgaatgcgaaaggaaaggcttttacattatgaaatgtattttagtagcttcttagtggcaatacctagtggcctctgcatggcgcgtgcggaccttgcctcggcaccatgtgtccattgcctctgcatcaacgcacacgtccgtcttcctcatgctgctccaccaaacaagtagcttataggaattcattgcgttgctttctgattgcgcatgggtttttcaggttggcgca

SEQ ID NO: 53292 - DNA, 1501 bp, Oryza sativa
accaacatctgtgggtactctatccctaaaattaggagcacttattttcgctaaaaggactattatttggtagagatatttccataaaaaaagattactctcttaataatactcgttatttcagacaataacatgtttttaaaaagcaactttaaccattatataattttctatatagaattatcaaaaatatataattttattatattactttttaagattaatctatgcctatatcctatggttcatatttctaaagtcttgttcagttaacaatcaaactagagggattgaagaagattgaggagcataattccacactataataggtgtggaataaatcattttgaaatatctcttaattcttttgtgagagggattaactgaacaaggtgtaataaagcaaatattttgaaaattattcatagtccaaaactaaaaacatataatacaccagtccagcactctctcgtctccacttcattccctaccacgccgtcatccatggccgccggttgtggtagaccccggcgagcggcgagattggcgaccaccgcctttccctcctcctacacacccttgtcctccaagctcactgttgtattatgaatcggattcggagatcgattgagttgcatcgagtgttggatcggaggcgggttccccggagttgctatataaacccttgttttgttccggcggggcgggaggcgatgacagcggaggaagaggggggatgaacgtacaaggcaagcgcaaggcgggtgcgtgttgcctcggtggcggcgggaagcggcggccgtcgtggaggtggaggagcgggactggacgtcgctccacgacgaggtcgctaaccacatcgcggagcggctgctcgccgccggcgtgagggagtacaaagcgttccacgccgtgtgctcccgctggagcgcatccaccgccgacccgcgggaccccacgctggccgacccccgcttccggccgcgcggctagatctcgatctgggagaacatcgggctccgccccgccgacgctgatgggatcacctacctccacgccgccaccgacaaggtccggcggggcatgctgccggaggcggtctagaggcaaagcatgttatattatctatgattctataatttattagattgtaaatttaagagatttaaatacaaacatattaaatcatcatcatacataattcacttaataaattctttttgaacatctttaataaatccttttcgaacatctctcattctctaaatagtagagtgattaattaaccgaaaagtgtgtaaagcaaatgttttggaaattatccctaatccaaaactaaaaatattatcaacccgaggaatatataatatgcggctataaaaatgggagccgattgcccggattaggcttaaaccctcagcccccctcattcccaatctagggttttcccccatggcgtcggcgtcgcgcttcctcctcctctccaggctccccgccgccg

SEQ ID NO: 53293 - DNA, 243 bp, Oryza sativa
cgaaaaaaaaaaagtttgaaaaaactacgccgaaacggaacgccccaaaactccaaaactagccgatcgagcgagcgccaatctcaaatcgaaatcccgctctctctctctctctctctctccccccccattcctccgcctcaaatcgcaaaccctagccgtcgccgtcgacgagaggtcgacgagaagtcgacgagaagaggaggaggagaagctgctgctggtggtggtggtgctccgcca

SEQ ID NO: 53294 - DNA, 1501 bp, Oryza sativa
tatccattggagttgcaatgagtttatgtaaaaccacatttgaatgatcagcaatacactttataataaaatgtaacccaaattaatgaagtggactacagagttgatttgagttccttcatgccacagaccagtgtttactagccaaacttttgtttttagcgagttcatgtattgtacatatgatcagcagggtaaaaagggcagggggggaaatagtaaaacgacatagaacaaggaaggaataggccccagagaaaagagcatgagcataagagggaatatgcacaaaaaattgtacataatggctaaaattattagaatgggagaacatacctctacagtttgaagttcattgagaagggactgtgatggagtggtgatggtattaagaacatgcacacgctgggaaaaatatagtgacttgattagcagtagaagattatggtaaataagtgactccaccgataaacaacttaaaacttacataactatctacaagcttccgcagttcaaactgggcctttccaagcaacagcaaaactttatctgggggatactgttcaatgtaagcattaagcagcaaagtgtataataggcaaaagttacatggaatgatcaataacattaagatggcctcattatcctatttttattcattttcctcacaatttgagatagtgactatcaactagcagatgagaatgggcacaaacaacttcccttggctcaatttgtcgttttcatgaagagcttaatttgcaagatatgtgtttatgcaagggagtgagaaccattaatcacaacagaacataattaccattaatcccgtccttgtttggtgtgactcttttaagtaaacaagtccccatttcctgcagtgcttctgagaactctgcatgcatgaaaggataaaatgatcattgatatgcaaaaaagagtcaagacacctatatttctagctgctataaccttataaacaattagcataagaactaataaagctgctagcatatgaaaaaagagcaaatgaactgaggctatacacgagaagaattggtgaacaactcataaaacacctaagtttctgcaccctctgtagtctgtactttagattaaaactatgaaatattcgtcttaaatgctttctcgattaaccaagaaacattgaggttttttatccatttgaaaatgggcagttgttagttctattgcagggcatgtgtaaaatgaaatggcaacaatacacaaaaaaatatttttacaggattgaacacatacttaactgatctcaaaagacaaaatgtactattggggaataaacataccatatgcactatttgcaatcgctgctgcaacagaaagcagattgtcataacagctcctcatatctgccatatcctgttgaaagtgaaattgcagtttaaaacaaatttagtaagaacctaacaagggaaagttttaacagaggaaacttggtggaatctggattaagctctac

SEQ ID NO: 53295 - DNA, 1501 bp, Oryza sativa
atccgccatgccaggtagtgacaaagagactgtgtttttttgcttccattatttcaacagtttattacaagtgatagcatggtctcattctcatactctgattgtcaaattctcaacatgcttacaatttcttctaattatttgataaccaagttcctccttgattatcatcaaatttttttctctgattgttctgtggtatggtgtcaaaaagctgtgttttctgatttttctctgtaataagttagcattagtagtagtaaacttgtaacccacaaaataaaaatgggatatgtgatcagaggatgaactgaaaacttggcatggaagcaaaataatgtgttcatgctgatccacagtttgtgctccgaccattttctcaagcccaaatgtgcctgttgcctgttgatattagctgcattagtattacctaagagagattctttttttttttggtaagatcacttctagcctggaaattttattttatatgactattatgttatagtcatgggtctaattaccagacagccagagaaagcagattcttcttgtgtcaatcactatgtgcttattttcatgggaaaaaagaggagttagacaacttgaaatcagagtttgttattggcatgacagatatgggattttaatctaggaaaatcaagggaccatgatgagcactctgcacttgaacttcatttcggcccaaaagatggaggctttatgatcaaaagttataatgacatgattgaggaagtttcctctagctcaaggaaagatcttcaatatatttatgactcgacatactcttttgccacggaagatattgtgtcggccaatatctaccagttgactccaaaacaggtaatccacatttcaatctttttgctattcacagatgaaatttctgtatattttcatgcttgtgtgatatttacgaactctaaaattatactgaaatataagtgaagtactgtgcgcatagggatgtatcactgtcccattcatgtgcagtgctcttgttcatatgtttagaggttcgtgctcttgatcttagatatataataatatatatacacctttgcggtctgattatatatagctgctcattgatgttaaggcacagtccataaatgtttcagacttttttatcaatcaaccttatcgtctaaaggattgatattgacagagtagaccatgtgctccgatctgatctaagatattatctggatgctgtcaccactatgggccatcatgcacatactcatcatatcctttgctcttggtccgtttagcaatgtaaacctcatgctcttcaatgtgacactgacagccaacttaatctgtgaaaagtttacaccgttgagaaacccatcgattgatcctgttgttgacagtggcaattgagttactcaagtcactattcttgcacctattttcagctgagcactgccacatccggcaacaggcgacacaagaacgagcaacacggattgacaaa

SEQ ID NO: 53296 - DNA, 1501 bp, Oryza sativa
tgattgaaattggaacgatatgataggaaagttagaagtttatatgtgtaaaaaaaagttttaatggaacggaaaagtcggatgtttggtgaaaaattttgcaactgaacagggccagaagcggagcacctgcacgaggcgaggacagaggaatggccggaggtgcgcctgcttgcaccgccgatgtggtcgccgccgcagttcgctgggcattgggttgggttgggacacgtaaaagtcacttcggtgtctcctccacaagccctaatgtaggtgagaaatttgggattataccatcccacagttcgtccaaatgcgtttccctccggtttcataattatttattttatggtttgaacatcaatacggtcttcgaaatatatatatatatagttttcgcactaaacgcaccgtttagcagtttaaaaagcgtgtcacgaaaattttaatcttcatcaaactcttattggagaaaagaacgggacctagatactacacgtcagagtgcttaataactaggataaaatacaatttgtgcttgcttgcgccgagctcatggaggagggagggcgatcaagctcgaggcgacataggtgaatggtgagcaactgagcacagggcaggcagcagggttcacaattatggtctaactcgatttgcaaaatctttctgaaccggggcaaaaacacaaaccacacggttattgggtcaagctaaaaaaaacaaactgaatttaaaaatttggacaaaatttatcaggatcttatcggtttttgtggtttatcaatgtattccataaaatccgatgatattgctcgtgagcggattatagttgagttgggtaattcgtatgttttataaatatagtagcatagataagtaagagagaaattagactaaacataaactcaatcgtataaaaagaactactccctatatctagatatagatgtatttaacattgaaatattgtgaatattcctcaccttagccaatcaaactatccgtgtatttaacattgaaatattgtcaatattcctcaccttagccaatcaaactatccttgtatttaacattgaaatattgtcaatattcctcaccttagccaatcaaactatcctttatttaaattgtatctgaaccttaatccctccaaaaaaaaacctattatttaaattgtatctgaaccttaatccctccaaaaaaaacctattatattttggggtatatgtatcattcactcctccagccatgaatatagccaaaaccagccatgaacatagccaaaccaatctcaacgaacagtactgcacaacggcgtggctgcatatgcaattgtttggttccacttccactcagacgtaatcaagcaacatcagacaggagacgaggacgttgccgcatatacaattgaaccattgcgcacagatggcagaacaatagaaatggaattaacagagcagcttccgagctccgtacaagaacacagttagcagtgtat

SEQ ID NO: 53297 - DNA, 1501 bp, Oryza sativa
gttgcagtttcttgccgtggccggtgaggcttagccggaaggcaggccgccgcgaatgcttggggcttgcgtccagcgtatcttcggcttctcgttgctcatcaaaccgtgcagccgcggagctgccacacgcgccataaccaaatcacgctcgcgacgcatgatgagatccaagaccgattactccccattagatctgacgaattactaaaaaaaccccttattcaatttttttaagttccaaatatacacttttatatattggtagtatatactgatagtatagtgtaccgtaaaagttcttcatatgaaaggtaagatggtcaattggcaatgtctggctaagtgaatcacgttcaaagaagacgagatgagttcgattgaatggagagcgagatatgggtgtgttaccaaagttaagtgacgactttcgatgcaacaaaattaaaaaacgaaaaccttcaatgctataaatcaaattgttattactccatatccttaccaaggaataatgttttccattctatttactttggagataacatgctaaaaatatgaattaatatatatgttcctatttggaaaaaggaaaaaaagttatgataccaaacaagaaaacgtgaacaacgaagaaacaactatccatcagccttcccttgaccaaactgttattcatctcttcctcccagcgtaagctcctgtgaaatccccaccatcccagtgctaggcgcgaaggcagccataccgaaattagcgtagtagtgcagcttcatctcgacgtagaccttagccgtcccctcctgcagctctgagacaaagcgttcgcgtagctcctgcgacaagtggacgttctttccccagggcaccaccgtcagcttggccgtcgacctcttctgcacgcagaatcccgggacgcgcccccacgcgagcgctacgccggagtaggacaccaccacgtccccgcggtcgagacaccatggccggaaggtgcgcgggttctctacacgcagcgtgaggttgaacgcgggcgagatgaccgtactgccgccggcgccggccgtggcggcggcggcgacgtccatcccctcgacggcggcgagatccaaggtgtacttgaccttctcggcggcgttagaaagaagggcagcggccgggatccccagcactaaaactatcgtcaccataccatagaacaggattatgactttggtctgtagcaccaacaaggggtccacctctttgctgccgtacagggctgttctcgccatgtccggctaatttcttcgtcggagatcgattcagcttgatgggagcgtggaagctatagagatcttgacagggattttggcgtgcctacgcgcagactctgtttcacgcatgataaaagggccgaacgcccgaaccgaagagatgtattcatgcaagtgccggacttaccagttagaacaggattttgggtaggatacgatacgttcgtacgagacatacgacagaagggaag

SEQ ID NO: 53298 - DNA, 1501 bp, Oryza sativa
gtgcaaaataagtctcaaagcggtttggacggcggtttcagatgacgtggcacctacatgactaaactcagtcttcatttgacgtgacacatgaatcaaaatttaacaattagaaaaagaaaacaaaataaagtctcacccgcttctgtaacagtagccatcatgttgctgatgctgtgttgcaagatcaaagggatttatgacttgtgaggaagaaaagagtaagttcgtcgtctctctcaagggcatgataatgagatggtgttcacctatgatcctcagtttaaaattatgagtactagcttattctgaatttgcatcgtatgaatatagtaattcacaagaattttcttaaaatatcttgcatttagcagatgatctagagtattgtcttgtcttgcagaagaaatattactactactacttatggctagtgcagatgaggaacttgtgatccaagttagcaatggtcgggagtgaagctaatcattctgttttatacttcctactctctcttaagacccaagggattactgtgctccagatctgcatttgcgtgctgcaatacaatgtgcagccagcagcagcagcagccttcagcacatggagttcagtagtactgtacttcatgctcatggccctcagctgctgccaaacaaacagctgaaggagcaagcaacttagaatgaaagctaaccctggtttaccatcatcataatcatcatcatcaagagcttgcacgcatgcattgcatggacatgtgccatgcatgtgaccaagcaaagaccttaatcttctcctggaaacaagtccctccaaaagtgagacacatcacatcaatgttatcaagcaatgcaacaatgttttgttaccctgatcaaacaatgcaacaattaaagctaacatctctgcatttaggacaggaatcacaggcaggatgtttcagtgctaatctctgaaaacttctgaaactttagaccagtgggagacctgctggattgaaaggagaatcactgaataggtcagcagctttctgaccagtaaaaggagtgagaatgttcaggctttggccaaaactaagatgagaaagaaagctaatttaaggccacttgcacacaaatcaacttatcaaggcaaaagaaaccctgcctaacctgccaaacatactgtcaaagttgagtaatttatactcaatacatgttcagaaaataacctactactaattgaaaaataattacctctagctttgagaagtttacatgtcctgatcactaaaagtgactaggtcctaactcctaattaaccaagccgagcttgaggcggccaaagcggatgaaatcattgggcatgcagtttccggggtcctagctgcttatctggggacagaaggcatcaacccaagcaagatcatttccttttcttcaataatatttgcctactagatgctatgaccctagccatcttttcaggccaagatagtactagtaatcaactcaaagat

SEQ ID NO: 53299 - DNA, 1501 bp, Oryza sativa
ttgaagagaaaaatagcatgagagtgtgtctttttcattaaatatagcggaagaacaatacaatcctaagagcgaagaaatataaaaggccaagaaattatgacactatacgaggtgcgattaatattctcactcgtttcgtgtagattatgccctgctaatgctgatgaattgagaggagaaaaaagagtgtgtctgaaccaatgggcattggatgagacttcatgagacagttatttcttcctgtgcataatcacacaaagaaaaaaaatatccatttcttcagaaaattcaaagagaaaccagtacaagttacttcctctgtcccagtttactagtcgttctaggaaagagatgacaaaatatggtgttggaaaaatgaccaacgtgcccctacattaatcatttcaatgcttaaaaattaacacaaaactagtactgcgtctgttattccgatatatctgcaaccagcatggggaagaaaattaatagaagtactcataatagtggctagcctgctagctgccctacgcctaaacgaccttctttctgggacaataactctacaccccaatgacaactaaaccggaacggagggagtagttatactaggaagtcagatgctgatgcagatgaatcttaagtcagataaaatgttttttttacagtgcccttgaaatatctgccaggtgtgtgggcccaggaggccctaagattcagacattggagatgcttggttgcttggaaggagggggcaggaagcaactcggcatattaagcaacggccaaaagagtgacatgattacaattagaagcaagaaaaggcgctaatgattcctcctaatccacacgaagtaccacggaagcacgcacaacacatggcgataatcagctctgccaattaagccagttgattagctcacaaggcaatcactgacaagaacatctgcacctgtgtgcgtgtgttcctcctgtcagtcacttgcaagctgcagtttgcatagggcacatcagggtcgaatccgatgtgcaaaaacgagcaaagtgccaatcctgaagtttgcttcatgatttttatcagaaaaaatgtttttaaaatgaataaccagacaaaaatgtccctaaaaacatggaatcatatagcaatcatagaaacaatagtactcaattttttttgtgcaatggccaatgggcatataaatccaagccatcgagtcaagtgaattgcttacatggcatgattaacaattgaccataaaccctctagtctatcttaaaaccaaaataaacaattaattaaatctctgtcaagcgctacttggattttttttctccactttctgaaaaaagagggaggagaagaaaaagtttttgtatcaatcagaatttaggagacatgtttagggtgaaacaagattggatcatgtcaaatcggagaaggaatcatactatttaagcaacaatggtggcaggattggagtctgctccacgccacatggat

SEQ ID NO: 53300 - DNA, 1501 bp, Oryza sativa
gccttcgtcttgagcaaactgctattcatgttgtcctcccaggagtccaggagaagctcctgtgaaatcgacgtcgtcccagagctgggcgcgaaggcagccatgccgaaattagcgtagtagtgcagcttcatctcgacggaaaccttcgctgtgccctgctgcaactctgagacaagaaggtcgcgtagatcctccgacaaccggacgtccttgccccagggcaccaccgtgagctcggccatcgccctcctcctcacgcagaagcccgggacgcgcccccacgcgagtgccacgccggagtaggacaccaccacgtccccgcggtcgagacaccatggccggaaggcgcgcgggttctcggcgcgcagcttgaggttgaacgcgggggagacaaccgtgctgacggcggcgacgtccatcccctcgacggcggcgagatccatggtgtacttggccttctcgcattctttggaaagaagggcgccgacgaagatccctagcagaaaaactggtaacagtgtcgtccagaacaggaagctgactttgttcattaacctcaacaaagggtcctcctcgctgtccatggctggctgattttcttcgtccgaaattcagtttgatggtcgatcaagagctagggaaggtggaagctattgagatcttgacaggagatatagcaaaatccatgcaaagtgccgaacatatcggttagaacaggatttctgatacgatacgattgcacgagacgtatgacagacaagaaggcatgcatcccagaaaaacaaatctactgtaatacattcatcccaaccggggattggtttggcacagggggtcgtcgtttacacgtaagctacgggagaagcaaggcctggtagtccggtacgcatgggaaacctcggccgaataccacggtaactgatctcatccgctacgagtagtctcgtggcgcggcgggcacaaaatccgcgggcttattaggcacacaaggcacacaatccaccagagaaaaaggcccgaacggccctaatcgaactcgcggcggcaagtccaaactccacacgagcgcggcgagcgcgaacccgcatcccgttcggccacgtctcccagctcccgcgagatctgggccgtccgctctgtcacttcccccaccctttatcaccaccttccgcggcttacgccgcccacgcctcgctcgcctaatccgaagcctcgctcgaaaactcgccgcctcacgccggagagcatcatcagttcatcaccgccatctcccatcgcagaagccatgagcaatcccggtgagcatacctctcccctgcttcgcattttgttgcgttgttgctgttttttttttcgggtgattccgtgattgggtttacggctaactgtttgcggcggcgggtttctgatgcagagctcttgtcagaggaaaaggccatcctcgtggagacgctgaaggtataacctcttcctctctcgttgtgatgatcgctttttt

SEQ ID NO: 53301 - DNA, 1290 bp, Oryza sativa
aatggacatcgctagcatacgagcataatttgtactttcttagataatagaagcaactaaggataattaaggataaagcatctaatccaaccgttttatacctgtgaacttaacagtactaaaatatgcataagcaagcttctgcaacagagggaattaaccacccaaaaactctagtcaatctcacgtttcattgaggatattgtcattatgtacgtcacaatgggtttgcataataaacagtacgatgaacgaaaatatgccgcgaacatcaccacctcgaagctctctctagtcttagcagttctgtttttacctgaatctctatgagcacatcgacgcgcttcctgaccacgggcgccaggctttcgagcacgtcaacatgttgctccgccaacgcctgcagcttgttctgcacagatgacacacgcacatcaccgaatcaacaaaaaccaccattgcacgatcgctccgattgaaacccaacaaagcacaccgaaaaaaaagcgatcatcacaacgagagaggaagaggttataccttcagcgtctccacgaggatggccttttcctctgacaagagctctgcatcagaaacccgccgccgcaaacagttagccgtaaacccaatcacggaatcacccgaaaaaaaaaacagcaacaacgcaacaaaatgcgaagcaggggagaggtatgctcaccgggattgctcatggcttctgcgatgggagatggcggtgatgaactgatgatgctctccggcgtgaggcggcgagttttcgagcgaggcttcggattaggcgagcgaggcgtgggcggcgtaagccgcggaaggtggtgataaagggtgggggaagtgacagagcggacggcccagatctcgcgggagctgggagacgtggccgaacgggatgcgggttcgcgctcgccgcgctcgtgtggagtttggacttgccgccgcgagttcgattagggccgttcgggcctttttctctggtggattgtgtgccttgtgtgcctaataagcccgcggattttgtgcccgccgcgccacgagactactcgtagcggatgagatcagttaccgtggtattcggccgaggtttcccatgcgtaccggactaccaggccttgcttctcccgtagcttacgtgtaaacgacgaccccctgtgccaaaccaatccccggttgggatgaatgtattacagtagatttgtttttctgggatgcatgccttcttgtctgtcatacgtctcgtgcaatcgtatcgtatcagaaatcctgttctaa

SEQ ID NO: 53302 - DNA, 447 bp, Oryza sativa
tatgttttgagcttggtgtgtcattatttccccccatttcaggctgttaattctatgtttggtcgagaataagggggtcagccagattattgcagagtttactgtaagcagcaagcacgatgatgacaacttgaacccaggcagagcagctttcatttcaagggttgctcaactacttgcatctgttccagataaaacaagaatgggagcttcacctgcactgacatcatcgtatcctcacccccaccgccccaaacacgacacacacaaacacaaacatctttgttatttttttcctttccttttattctgttagctttttctcagctaatatgtatttatttgcactatgtttgttcctccaaactgtaagtccttgatggaaaccaaggtcattcttcaagtgtgttgtcgatcagcttcttgttgcaactgaacaagcggcta

SEQ ID NO: 53303 - DNA, 775 bp, Oryza sativa
ccaagaggcaatgtgagtatgacatgtgggaccagatattaatagtgtggtatatgtttctagttaactattgtatgaattactattactcaatccttcccaaattgatcatcatgtaaaagaatctaaaaattcttaaattgatcatcatataactgcatggacacggatttcagcagaatacagttaatacagcatggaagaatgtgtgcatgctatggtgtaagtggcatgaggttttaatcgatgcatggtgggagaatgtgtgtatgttgtattgattgatgtgatttaaattatccttggttttggtgtataaaatcaatttgggaaggaaggagtagattgactatagatgatttagagctagtagttggctatactattaaacttgctcttagcagctccaattctatccttataaaaaaacttagaaataataggagtaatatactactggtatcatgaataaaagtacaattgacattcgacattcttaattccttcaattatttttttggtatctcaaacacatcttctctaacaaaagttcatttgcaaattttgatattctcaaacataccccaaaattttatcttagccaacggcagtcaagccgggtaaaactgttatttctcctccaaacaaaaccccctaattactcttgctccaaaacctccccttctcaagcgctctctcttaggttcgtcgtgtgtttcccttcaccctcccatggcgagcaacccaagcagctccgcggcgagggctgcgggct

SEQ ID NO: 53304 - DNA, 797 bp, Oryza sativa
tcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccctcgccacacgcgctcgctctcaaacatctcttcttccggcgtca

SEQ ID NO: 53305 - DNA, 1501 bp, Oryza sativa
tacaaaataatttatgagtaaaacttttatatgtgtctctagcgacttaaagatcaatgctgaaaagaaaacaaagtccaaaataccttaaaatcaactccacaatcaagctttaaattttaaattttggccgcgactgattcgttgtaagataaacgatgatgcttgagacaaatggcctccctgaactggagagagagaaaaaaaacttttgcagctttcaagaggcgaaatgagaagtttgatcagcggaaggaaggaagggaggaaagaaggacgggtccccctggctcgagcgagtcaagtgagagtgagtgacagacacctgcgaatccaccgcgagatcctggcgttgaatcgcggggcgctctgccgatcacgtcgccaacagtgtgacagttcagcaaagatggcgatctttcttttgctctcgagtggcctcggtactctgaactcttctgaagtctgaagtctgaactccttcaagtggcgatctgcatatagatactagaggttgtctcattatttatttgctcccgattactgtgaatagtaacaagaagtagtattatagtagtatgaatatatttttctgaagaattgtgacatctagtatagaaaagaacgcagtaaaagttgagaaaccagaagtttgcaggcattattttttatccagaggcaaatgcatataaggaagtgagggagaaggtttggtctgtacagttaaactgattccgctccctttgtcgtgaaaatacaatctcaaagacatgtttatgttcttacattaaaaaaaacctcaaaaacttgtttatgttcttaagacaaaaattactcgtccctacacaaaagtcaatccacgaattactcctttaaatattccttatggtggttttctaaatgtatagttgtagcggtagagtcacgagtgcatgattctactcaccagagtttaattccttgtgtccataaatatggttatgttcatcctcgttgatgtagagatgggagttatacatttttcccctttttttttgggatatacagttcccctcgcaaaattcaggtcgttaattggaaaaacatttatgctaaacaggccgtcattacggtgatagcaatacgaaagcccatcacagcagtctcccctttgacgggccggcccaattactcccacaaaccaggctgggcctttgggccaatatgtaattacagtaattattccttatactaataataaatgcgcattaagctggggggctttcctgcaaaagagcgcggaaaataaaaatctcgcacagaggcgtatccacgctttccttctcccctcccaccaactaatcgatctcctctctctctctctctctccctctctatcccattcgcgaggcggcgtctcctcctcctccccgtctctctcgcttcccccccaaatccggcggcgaatccagggccccgcgccgcgccgacgaccaccgccgatcgcgaccaggagggagga

SEQ ID NO: 53306 - DNA, 1501 bp, Oryza sativa
atcgacttaattagccgttatctccaatccaatcttgtatcgccgcaattactaacgatgtgatccccaccgaattgctggtataatagtgacaaccttttctttttagtacaacggtacagctaactaggaagacctaaatgattttttggtcaaacggtccgtgctaattgatcacggatctggtgcacgtaaccatcaatcgctataacaattattgtaacatctctcatcacctaacagaaaatcacgttccattacattatactccctccgtttttaaatatttggcaatgttgatttttagcacatgtttgactgttcgtcttatctgtgaaatatgtaaaactatatgtatacatataagtatatttaacaatgaatcaaatgataagaaaataattaataattacttatttttttaataagacgaacggtcaaacatattttaaaaagtcaacggcgtcgaatatttagaaacggagggagtattaaataagaaaacagcaataaaattcagctggaaaaaggtacttggttgatccacgcacacttgcggtcgtgcagaaaatgtatttttcttagtagtactatctcatcttttttgcccttttttccaaatctctccctttgactggaccatggactgcaacaagcaacaactaaagaaagaaaagacattaataaagcagcaaagaaaagaacagtccaattagaaaaaagattaaagtgcaaataccaaagccaaatcatccctattattatatataaaaaggattagaaatattattatttgtactaccaaaccgagcaggaatgtgtgcaagcaaggcataaccaaaaccaaccgctttccttttgtccaccgattgctctctctttgaccaaacaaagaccggggcagcttaaataaacagacaaagcaatcgaaaatactaaaataaaaaaaaacgaggcactaattaatgtcctgttcacatctaagaatttccaaagctagatattcctcgcttcacaaattcatgaatataaaatttgcaatcacttgataacatttgtatcaatcattttatttctactttaaataaaatacatatttaaatcactataattaaacaaacaaacttcaaattcaaattcagcgtgaatctaaaatctaaagctgtgccaagcatggtttggcagtcttgcctacaattactccttaattaagtcaccataaacacggcgcgccattaggggattaaagaaagcgcaacagtacgccactcgcactcgagcccggaaagaaagaggcaaaaaaaaaaaaaagaattccccatttccttctctctctctctctcatctctctcagtgaggagtggtggtgtagctaagctagggtttcgctcggaatcagggttcggtttcctccaccggaattggcggcgatctggagctcggcacggcggcgcgcggcgtgatccggacgctcgggtaggtgagggagggagggaggaga

SEQ ID NO: 53307 - DNA, 1501 bp, Oryza sativa
agaacatcaagtttgggttaccccttgaagattttttttttctgtgttagttcggagcttactatcatacatgagggcgaaaacatcagtgatgctgtttggactatagaagttttttcatttgcatttatttggttgccatcactactggccgcataacacaatatggatgtatatgcacacatacattaatagatgtggatacaaatgtattatggcattatttcaagtgattttagttccttttgagagttaagatgaactagaacaggtccaagtagaaggtagtttgtcaagcaccttcattttattgttgtgacatgtaatacaatggctctatatcagactaatcctttttctcaattaccttcccttggcagaatatttggtgttgaggtgaaagtttatttatcaaggggctcagctatctcgccatggaagaatattgtacatattagtatgtgaactcggccaatattgcaaattagttggtgtttcgtttgtatcccccatggttaagatgtaattgtgcaaataacgagttgtggaataaaatctccatttttctctccgattaattgatgtaagatttgtttgttgtgcccttgagatgacttgaatgccacctgttttccactgctcatgtaagcatcctccatcttaatttttaacatgagggagtcaattttgccaaaaaagaaaaacactagtgctgttattcatggaatctgcatgtatcatttatcaccttatgacaatctttaccatctgtgtgaactgctgggcaataattggctgtggcaagagaatgaagatgtttcatgagagttaatctacttctgtccaaatatacaggcagtttgttatacttttgagtgtattctgcaccaacatttctggttgcaaaatcaatagcgtagaacctgaacaaaatcaacatttaccatgtgcagtactttttctaagctgaagttaactccataattctgtactgtcagttagattgatcacattacgacatgggacgtaccaggttgtaccgatgaatagcttcagaagtacgaaaggtgtagtttcttcaactgggtcgtatttgaagaaacgatcaattaattgtaaagtctaacaggtgcggtcagtacatggaccagcaagcaattgtgtagctgtcacatgcctcaatcatgaacgccaaggacaatgctagatcagaagctggaactacctgacaatcttggatctgtatttgatggttttaattcaatctgtttgcttctcagacagggttatttccagctatttgtttttattctagttgttacaaatggcaggaggagtggactgactgaattgatcaaaaagattattattcagagcaaaactgaattacatgaagctgtccaagaccaagcttggcagcttgggttgttcgttttaggagaatggaatggcatcacgcttcctgatctgttaaacacttaaacggtatgatttagaaata

SEQ ID NO: 53308 - DNA, 1501 bp, Oryza sativa
aatctcatcaattgatgatgtctttgatgccgagtaaaaaaaaaagagtgaagcatatctttgccttcttttgccaatctggacaaagaaccgacggcgtcagcggcagggagagaccggagagacgtagctgccgaggcacgcaacgaaaaacacaaaaagaaaagcctttggttttcacgtgcctggtcggtggccttgcattggctgcgcctgcacatctttgacgttccttttccattggttttccctgtgcagccagtacggctgctctccctttttctttcatgccaaaagttgggttggggaggaccagaagcattgagcagccacccaacaacgtactgtatgaatgatgcggcagcggcagcagcgacgtaatccctccgtcttaaaaaataattcgttaatccacctaaaataacgaattggataatcttttattcagatttgttgttttaaatgaagtcacatttttatctatgttagattttttttagactagggagattagccgtgcttctttcttttttttttttatgtatgtatgcttctaaagaactgtacgggattccatcctgcttgattttctcttataagtttggtactacattgcatactgagacttgtgcatcaggttaggctgcctagcatgtccatttgaaatcgggacagagctagaatgaaacagcaaagtgggactcacgtattttactctagtttgaactgagtttaggttgatacgtgtgtttgaatttgaacccaattggatgcacatatacgatgaaaatagataaactataagttgtaaaaaaaattagaccgaattcatgagcacctcctaacctaatgtagctcttccacagtttggaatactccctccgtactcgtaaataaagtcgtttaggacaaggttgaaaacaaacattgggaatataaatcatgaataactctcaagttgttgagtttgaaaatgtaaaaaatatatgaatagatttgtcttgaaaaatactttcataaaagtatacatatatcacttttcaataaatatttttatagaaataataagtcaaagttgtgttttgaagaccgtgtcgctatccaaaacgacttcctttacgagtacggagggagtatatttttctttatataataataaattaaaaaacccagcatctatgtatagtataccaaatccacttgaaatacacggttgttctctgttcgtccaaaaacaaagagaatatgaacacttccttgggatgtttattgaaaaaactgtaaaattcatgcgtcgcaaactagctccaatttgaactctgcttcaattttttgtgattcaaggatgatgatgcttggttgtctagttgtaattagacaagcaaataagtttagtagatactaatatacctttccaaaaaaatgtactagctatctaggagtggatttgacaccatctagaactaccaatgtggattactgatagctatatttcaggagg

SEQ ID NO: 53309 - DNA, 967 bp, Oryza sativa
caacaggtgtctaacaatctaagaagatgtttagtgagaataattaaagcttcaatatcaaatactagaaaattggattttctatatagttttttcaatataataatttttttcgtaatatttactagtgatatttagtaatataatggaggcaaagctaatactcgtgtggaatcatgcgggataaccaattttacatcctcaaattaatcatgcaaaaacgtcacaaactgtaatcatgcatgcatgcatgcaagagatttttctcgatgatgataccatccggtcgaccaggcgggggagcaaaaatcgggcgctccccccacccctgcccccccgtgcaccactgggcctcacaacagtgcctgcccccacctacaacaaatcaaccatatattttggaacccttggtttattttttgttccactaaaaatgtttcaactagtgtactcacaatattttattatgtatagatataatgttgcagtgaactgaaatattccattgcaacaaaaaacccacatattttggaaaccctctattaagggaattcgttttattttttttccaccgaaaaatgtttcacctagtgtacttataatgtttcactatgtatggatcaaatgttgtagtgaactgaagcattctttcgctatttgctgaaacattgtttttatataaggtgaaacaacacccgatttaaacgagtgaaacattttcgatctacatagtgaagcaattccgatatacttggtggaacatcgtgcaacatttaaaaataattcaataataagataattttttttttcatcggaatatatgcatgtgtggtcttgttttgaagatttaattgcaacgaatttaatggtacaatcggatcatgatttagataagtaatttaagagaaaaatcagtttaaagtagttttgcacgtaaatcggacactgacgtcatactgacgtcagc

SEQ ID NO: 53310 - DNA, 278 bp, Oryza sativa
aaaaaaaaaaaaccctaataagaacagggagagtgcaccaatggcaagatgcaaccaactagatctacgatcaccaaaaacattggtacactcataacattgtgagccacttgcgtatgtcgtatggtaaccagagtgtcttcctcttcaagaaaggtgatctcagtcgccagtgaatacatccatgtggagaaagtgatactcatttctgcagctgaagtcttcttgtggtctcgtctccataatttcatcacaggattcagtgccaatgttcttta

SEQ ID NO: 53311 - DNA, 1501 bp, Oryza sativa
atattttccaagcctccattcatgtcctacatgtgaagttgaatgagaagtaggttctcatggaggtgtatacaagcagaagagtttgggcggcattacgttgttgccatcctatcttttccttcccggacaacatttttaccatgtaacgccgcaacaagcttagatggttttatatattataattaggatggcaagctttaacagaaaactttgtacatatggaaaaagaacggtttggttttattatttattacatctatcctataattgtttcagaattggagagttcttttccttcaaggtttgtatcttgtttttgctcaactggcactgtcagactgattgtctccaatcttatggagctgctctgttgcctctgttttggttaggatggttactctgtctcaagggctctgttttgggaaccaggatttttcttgattcatgccataattgaactattcggtaatataaagggattttggcaatgtatttgcactttcaagatctcttatattttagaacgggatagtatttcggtatgaattcaggcattctggacatgacctaacacctggatccttgttaagacagcaagatctgaaagctctgtatatcttctgatatctgaacctgaaaatggttagtagcatctgattgctactggcaactgtccatgcatgctggaagcgttgagtaggtcccaagatggcccgtgttcagacaacagcaaggaaaggtttgggtgattaggtcaaaagtatgggtcttgaaagcaagaggagagcaaccccaggaagcaagcagtggccattgccctaccaccacaagaaagctctgccagttttgttttctgaagctacacgtatcaacgtcaggcaagcggctgcgaacgtcagatttgcgcatgccgttgcgcagacagaaagagagagagagagactgttgttaacttattaaccgtagctaacatttaaattttaaaactaaaatattttagtgttgattcagatatttgcatcgaagtttatctttgggtattggcttttcaaactattaagaatggtaataaaaggttttatccataaattgtttttaccatccgttttaaattgcttggtttgttctaagtcaagaatttttatatttaatcattaatttctataaactcgtatagtttaacatctcaatatttatatttttagattcaccatgagaaatattttcataatatataattcatgtattgttaacttatacggttttctaaaaatttgtagtcaaatatagatatgtttggtttagaacaaacctaaaacgacaaataatttgaaacaacaagagtagcttatcatccgtggcttaaacgatcaaaaattattttcggttgttttcagctgtggctattttgaattttaatttaattgtagagttaacttaagaggcattttgtcgctttcatcactcagccatgacttctggaccgaaaacagaaagt

SEQ ID NO: 53312 - DNA, 1501 bp, Oryza sativa
accatttgcgccgcccatcgcgtccagctagcgcctggcgcggctgcagatgcagctgctgagctgcaggtgcatgcacctttcccacccccacctccctctctccccttcgtcttcctctatagcccgcgccgcgcctccctgtccccgagtccgaagcccgaatccgaagcgaagtgaccgcaagagctcacccccgagtccccccctcgccggatcgcgcgggccgcctacctcctcccgtcgcaccagctaccgcggtgagttgctcccctctcgatctctgctctgttaggttcggttggttcgtggccgtgctggctgcggcagtgttggggaaggacggggggttttgggggctagtttacgattcgattttccctctgctgtgtttgtgtttttcttttccccagcgaggatgaaactattacatatgactatgtggttatgtggtatcgaagcagatcgaataattgatccggaatgtataggagtagtacttttgttcgaatcgacataggcgtttactagtttgtgcggttgggtacaaacaaattttgtaagaggaagcttaatagtgtacccaactactagcttcaattcatctatagccaatcaaatacatcattcatacaatagttacatactacactattaatacttggtcccacctgtcatacacacacttcgtcttggagtccgtgctacactgccattctttctccttatttttcttcttaaaatatgtttgcagctagcttatagcctgctattgtacataatctaatggctaataaggttctcgccgcggcggtaactctgccccttgcgtgagctgagctcagaagatgatgtcaccaagtgcactaatgactcatgtattcttgatgatctttgttgaagtagtttactatttggggtagtataaagtctaaaactgccatttggtgctaatcagggccgttgtagctgtttcttttttcattttgatgccttgatgctctccttgagaattaagatactacaataattgtactagccaaaaagggattaggagtttgaaagatgatgaactggggaaggactaaagtttgtaatgaatggccgcataggtaatgatttgatctgtggagaatttgtaaaggaagttaacaaagtttgttctattcaagaaattgttttgctctcatctctttttccatattcaacatcttttattagattttattgtgacatgacattttgtttgtgtatttgtcataacagaggtaccaaactggatatatgattgagtcttcatctattactttttgtcctgaagtatgggggcctaaatttttgtcattaatttcagggaatgcgaagatcttgcgatggaagctagtcaaatctgatttcgtttaagtacaagtaacaacaatggcaccaaacaaaatttcctcaatggatgctggagcagcttttgatgacgaagatgctagttccagcaattcactgcagg

SEQ ID NO: 53313 - DNA, 1501 bp, Oryza sativa
cgtgagatttttgtcccagaacatcaataattttaaaatcggagggggacaccatatataggagagtggtattcacaggttcaataaatctatagtactattataatatatttcaagcctcccaagtccaaacgttaactaatttgacaccggagagaagcgtcacaattaatcattccttgatatgtgagatttctgtcccaaaacatcaataattttaaaatcggagggagcactatatataggagagtggtattcacatgttcaataaatctatagtactattataatatttttaagcctcaaaacgtcaactcatttggcacaggagggagtagtacgtgatattctgtccaaaacatccataaattttaaaccaaagggagtaccataagagaagagaggtggttaaatttctgaaacctcgacattcaattcatgttataataaactcgcagatccaataaacccatagtactataataatatttttcatgccaaatcggttcatatcattttttttaaaaaatagtgatttagaaactaatgatcgtcaacgttttatcaaaagtccgaccgtgtcttactccaaacataaaatatttataatcgaagatagtatacttcatttgtcttaaaatattacaataaactttgaagtagttttgggacagagaaagaagtactccctccgtactcataaaggaagtcgtttaggacaatgtttaaatcaaaccttagaaatataaatcatgaataactctcaagttgttgaatttgaaaatgtaaaaattatatgtatagatttttcttgaaaaatacttttataaaagtataaatatatcactttttgaataaatatttttatagaaacaaaaagttaaagttgtgttttgaagaccgtattgctgttctaaacgacttcctttacgagcatggagtacaaattttgaggtgttttccataaacttgaaacgttgtgattcaacaagtgctagtgcaaatttgaccgccaacgcaaccaatcagttgcacagttatccacgccaacaccggaaataactgccgaataaacaaatccagcctaccattatcctctcgtagcgtagacgtctccgcccattcccaatttcccattcccccctctatttcaacatctccccccatgtctctcctcccccatctcgccatttcaattccaccaacgcgagagagagagcgatcgagaagcaaacccgacccgacaaccaatttctccgacccaattcgcctcctccaagattcttgcgccaccgccgaggaggcgatcggttcttgatttcttgaattcgattcttgaagaattcttgggggtggtatgaggtcgtcggcgacggcggcggcggaggcggcggaggctgaccagtcgagggcgatgtacgagctgtgcgcgctgctgctgacggtgctccgggcgtggccggaggaagggggcgggcggggggcggcggcgtggccgcgg

SEQ ID NO: 53314 - DNA, 1501 bp, Oryza sativa
ttttgtcatggaaatcatcaccgcgaattagtatatggaaatgctagatactacgcgttgttacggaatatgcatctttgatctattattaagaacggtagaatagttgatccagatgatgttgtttataagagacaagagacaatatgatccataggttgaccatgctaagtctacaaataattgagacgatgtatcttttgtaaaaagaggaacacaattaagatcattaattaatcatataagtattagaaactagtattaaagtaatgtggctttataagaaaaaagagaaatagtatttatgaattgcactaagtgagcaacgtatataagtataaagaaatatataggattactactaattaatgttcattaggacacgatatactcactctaacttcatctgtctaatagaataagggcccatttaatttagatataaaacagagaaattttttaaaaaattaatcttgtaggaaaatttctttgaaacaaatgattgaattatatcctatccttcaaaaatcctatggagtaaataatgattttggaggaaatttagcaagagctccaacctcttgaaaactttcttcgattatatctctctcattcgattcttgtatttcctgcggtctaatcaaatggttatttctgtgttttttctacgttcggtagtcctttgttttgcacttatattcttattagaaacatgtgttttttttatttctccgtttttttcattccagtgattcaagtggagcctaaagtttataaaactactagtacttaatattctgtttaattttaaacgtatgccaacgtttattgacaaactattaattgacaaactattgatagtcaatgtttcaagatcttgataaaatcttatgctaaatatcagatactcccacttgactgtgttctttccctcatgttcccaactccccctctcccgtttttcgcgcgcacgcttttcaaaatgctaaatagtgtgtttttcttttaaaaaaattatatatgaaagttatttttaaaaacaaattaatccatttttttaaaaaaattaccaatacttaattagtcacgcgcttatgtaccgctccgttttcatgggagatgttcccaactgaaacgaaactagcgaacacagccacgcacacgcttatgatctgacgaagtaccatgcccccacacgcgcacacgagccacggcccggcccaccgtcgaacgcttcaacctgagctctgtagctgcttcatgcttgacctggtagtaaagccccagcccccagttatgaacgcgcgcgcaaaatcacacccactttgacgcgcgtaaactatataaatccactcgatgcctcgaggcagagcagtgcaaagcacaaagcgcgcacacacacacacctcgccgattgctcacgaaaccgatcatttccaagcctctgatccgtcgcaaaatcccaatccttgagctcgatcgtcagctttgtgcgcggtga

SEQ ID NO: 53315 - DNA, 258 bp, Oryza sativa
accaccaatgctactctaatagggcaatgtatagggcaacgtatcctatccacacgctacctctaatgcacttatgcactcagtcattgtaggccctccgattccaatccaacggatacaaactgaggttggcatatttttgcacgaaaccgcccacacccctccacctaaatttagaggtaacacctcacttggctttcctcttctcttattcaacatttttcccaaatcgatcaccaatctccaccatgctgtagg

SEQ ID NO: 53316 - DNA, 1501 bp, Oryza sativa
tctgtgatacgttaccacaccaaagttacatacacattaatgattaatcctttgatcagttcctatatatcccaggtagaatatatatcgatctcttcagaatcacgaccaattaggtaaaatgaaagaacatacactcctgcctagccaagacttcaaaccttacacacacatatatatctactactgcaagcactgcaacggcaaagttctctgcaggcaaagagatataccgatcgaagaagcctctctctatccaaacccaaacagctccattttgtctacacgaactatggcaacttggcaaccacatcgctagctagctagatatatactatgctaccttggttcattttgctgctttgatttgcaactgcaacccaagagaaaagttgtaagggtctgtatggggattttctgaccgctgtatcttctctcaaaatcatattaatcctctctacatagtctagtttttcatccaaattctcaaaagctctaattatagaatctaaaaaattaactagaaaacagaagctgagaaatccacattctccatattctcagaagcttgatactaactagctatttcccaaaatcttaggccttatttagttggggaaaatttttgggtttgtttgtcacattggatatacggacacacattagtattaaatgtggtacaataacaaaacaaattacagattccgtcaaaaaactgcaagacaaatttattgagctcaattaatccgtcattagcaaatgtttactgcagcaccacattgtcaaatcaggcgcaattagacttaaaagattcgtctcgtaatttacacgcaaattgtgtaactggttttttttccacatttaatactccatgcatgtatttaaatattcgatgtgatgggtgaaaattgtttattttggaaactaaacaaagccttaagctctcccaacagatcacccaccggctcctagtggacacaagaagggtatttttcccgaaacccgaaaactccgaggtttcaagtgcaaaagcgcccaactctactcacttttccccagcttttccgcgcttaatttctcgacctgtcgaatcctcagtcgccaccgctgcgtcgacgaggagagagagagagagagagagagagagagaaaatccaaagcaatcagtgagagacgcattgaattgggtcggagattagtgcgaaattaacctagatagctttgcctttgcgtacgatggatcgatcgaggccgcctagggttccgcgtcgttccaccaccttgccggaaatggcaatgccgggtagcccccaccgccgctgcccaccctctcccccttccctttttaaacccctcatccccttccccctcctcctcctcctcctcgccttagctttcccctctctttcgcttcgcgagattggttgattcatctcgcgattgatcgagctcgagcggcggtgaggtgaggtggaggaggaggaggaggaggagatcggga

SEQ ID NO: 53317 - DNA, 175 bp, Oryza sativa
ccgttgggaggggaatattttttttatctaatatatcgatcattctcttactcctagatatattgtattgttttttcctatggataaagtagtacgggaatgtcatggcatgaaaatcgtgtttggcaatttggcatgctactactatgattgtaaactttggttagttttgcaa

SEQ ID NO: 53318 - DNA, 1501 bp, Oryza sativa
tacctgtgatgtgcagtgttattcgatctcttcttgtggtgcttccgttttagttaccttacctctctgagcagcagcaaagtttcacagaaattggcagagaatggagattgattctaatcatcgggtgaacgtccatccattagttgcatatcaactatatcaactaaatagttataaatttatttttaaaaaattaactagatagattaatatgtaatatatcactatacaaacatgtaatattaaatttaacttttacaagctgtaacaaaattgagaaatttaactgcaaatatatatacactactttgagttttatttgttgtttatgttacaatttgtagaaattaaattttaatttacatgtttgtgtagtgatatattacatatcttgtcaattattttttaaaaaaataataataatttagatgacatgcaataaacgggtggacattcaccggtgattaaaagagaaattaaatttgaaaatgtaccgttcattcaattttttctaaggaatatttgggatgcaaaaaattatgcagaaatatatcatcggtgtcgcacttccgttgcgcgaaaatgacgcgggaataacatcacggatggtatcgcgcggcgaaagcgcgagaccgcacggtctctcgcggaatggaagagtgagactgcagaagccatctgtgacattgtccaatgggatccatttgattagtgatcaagtacttaattaacaattaactaataataattagtgattaattatcatgattagtgattaattaataatcagtataattaaccgctaattaaataggcaaggcacgatatctctctttgcttgagcgatagcgttgattgtttgagcggtatcgttgtttgcttgagcgagaccgcacggtctcgcactttcactgcacgataccggtcgtgaaatcatttatgcgtcattttcgcacaatggttgtacgagaccgatggtatatttgtgctgtatcctaaatatttctaacaaaaaataattgaatgaacactatattttcaaatttaattcattaaaagagtatagcggcagagaattccatggaaattcctgtacagaaacttcactggcagcactgcagcaggaggaggagctctgttccgtctgggctttttctcggccagtggtaattaactcggcccatctgcagcccacgttaggtcgtcgtcttgggcccatgtgacatgagtcacatgacgccaatggaaatggcgcacaactgcacaagcacaacacgacacggtcgctgcgtcgcatacacacacataatactgattgaactgattgatcgttgagacgtttgattgatggattgattgcaaggcagcaacaagcaagcgcgagtagtttgtgggcaggcaccgggccggacgggacgcgccgatagatcaagcattcaagctgcctactactccctccgttccataacgttgtaacctaatatatggactatatggg

SEQ ID NO: 53319 - DNA, 293 bp, Oryza sativa
catcgtaaagcagagcagctgcagatcatcctgtggtgccatccgatccatgttggtgttgatgctgtgatgctgttgaaggcttttccatcttttgccgcgttgccaaaattttgaattttgaaacctgattctttttttttaacaaagtttgtttttcagcatttggcttttaaatcgctaagtacgtaactagaagtttatcatatttttttcctaattaagccagtattaggacaaccaatgtttccaaaatactataaggaagtgaatgatttaaattttaaattctt

SEQ ID NO: 53320 - DNA, 1501 bp, Oryza sativa
aggtagctggactaccggcctagagcggcgacggtggcaacttggagacgcggcggcgatgctcgaagtagacaaagaagatccgagtggctgacgatgaccaatgcggacgacgagggtgtcgaagcgctaacgacgatgaaaacgacgaaagcggcaaagttgtggttcgagaagacaacacaactgcagttccatgtcgatgcagcggcgagaagtccactggtgatgtagccatgctaaggagggcgcctgtcagcactgcaacaaccagtggaggtgtggaccacaggcagcggaactgcggcccgaggggggcgacgcagcggcagcccgaagcttgatggcgtagacgcgtagtcgaagatgattagcagcaaggtgtcgtcgtagccggccgtttgaacgggtgatcaagccgatgatgcgtggggtagaacgacgaagtggaagccgaagctctgataccatgttggatagtataggtagagaggatattgtgaatcgtggattgactgtattgagcctcagggggctggtatatataagagtacatggagaggagataagaaagaattacagatatggaaggagtctacacaaatcaatcatatcctaatatgactctaactaccatatactctaacatatatgtccagtttcgttgatttgacatcctactcagcaaataaagataacaaaaaaaatacgtgggagcccacatgacagctatcctcctctttcttctcttttcttcccaaaacgcggctggcgaagaaggttgtaacatcccgaaaatttcgattctgaaatacggaattaaaaactcagaataatcaaaaatctttttaaaacctttttgcatgctgggatttattatgcatttgtgtgtatttaggttgtgtgctaaagatctcgattaaatcatatctcctaaagggacgccctcagtccaacgtcctttctttcccatatcttcacggtctgatttattaagtgctaccaaatcacagaatatttaacctgaaaatcttcccttatgtcgcagcacgacatatctttctcaattcttaccctccggttatttcaaaccgttgtattaattcaactcaataaatccttcgaatgtctacaattgatcggcgtatttatttattgtgtgtcaattcaaatatattcaattctattcctaccgcgacgattggatttgtatgccatgcgtcgtcccaaaaatcactgttttgtttccgtcgcccgttcgtgcaaagcgctcacgacgaaatcctaagactgccgatggaattgtttatcgggcgtcatccctaattccctgttcgaagatgcggtgtatcatccaagcaaaccaaatctcgtattgcagttcaataatccaatccttgtgcatattctatttctaataccgatccaagtccagtccaattgtacagttccatatatacagtctgagtacagagccaaaataaatgttcaaattacagtc

SEQ ID NO: 53321 - DNA, 1501 bp, Oryza sativa
gtttggagacggcgaaaatagagacggcagtggaggaggcgaaaatggggaggaaaggagaaggggaaggccgggggtttaaggaggcggcaatgtcggtttggggaaccgacttgcgcggtcaagagcgcgagctggctctcggctagcggccaaagcggtggcagacgggatgacgccggcgggagaggaaaaaggaggaaggggaaaaggaggaggagaaaggaattctctcctttgccgattcgggaaaaagagggtgggcgcggggcgacgacgcggcagagggaggtgaggcacggcctccgggccttggcggctagcgcgcggagtggcgggggccggcgatgacgacggcgggcggtttggagcggagcggcgacagcggcgactggcgcgggcagagctgacggcggcggcgaccgggcggtcggccactcggcttgcgcgggcgcgaggcaacgggcgacggcgcgcgggggagggaaaagcggggcgcgggcggctcacgcgcgcacgcgcgcggcgcgcgggcaaagcggcgggatcgggagagagcgagggagcgcgagggagagagagagagagagggaaaagggccggggagagatgggccgggggaggcaaggtagactttgcggaggaaatgattcggaagatttggattcggaatttgagctcgacgatagatcggggattgagatcttgagatggcacggacactagacaacaatcaaaggaacaaatttcgcaattagggtttttgagagataattttcccgctaggcgccacgacggaacgggcgctacaacaagccatgggaaataagtgtttaatgcaggcttcaaggaaaggctgttgtttttgcaattgattttatttgaactcttttttctaaaaacaactaagtgagtgcttctcaaacgacacggatgagacagtgcgtctcgtccggtcggagtatgtgcaatgtatcagtctttagaattgaaacaaggttggcacccggccaacagcttttcaaacggccacccgggccaacaactttcaaacggccacccgggcctagctgatcccatcagctgcaggtttttcaaacatcaaacccctttccacaacagcaatttcacaagcagtagtcaaacaaaactacgctaggaatcacctcacatccgcccatgaccgtgggcacggctgcgggtcttcgggcttcgaaactatacgcaaaacgggacaactcaacaaacggcgaaaataaagccctattaatgacctctaagcgtgccattagatagatctcgagatttgaggaattttggaagttgaacggagtcaaacggatttacggttgagaagatattgaatttctaagattattggatttttgtctaaaggaaaaggatttaattaaatcctttttggaaaagaaaagaaaagaaaagaaaagagggagggaaaatagacttttcctcgggcggctagggcgcggcccgagagaat

SEQ ID NO: 53322 - DNA, 1501 bp, Oryza sativa
tagatttgaacaagattggcacccggccaatagctttttaaacggccacccgggccaacacctttcaaacggccacccgggccaacaacttttcaaacggccacccgggcctagctgatcccgtcagctgcggattcttttcaaacatcgaacccgatttcacatcagcaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggatttggaaattcatttagttcgcaagcaccgacccaggtgtcgggttttccaagtcttttgtaaaactccagttttacccaagttgttacttcagattttaaatttgaaggcgaccgtcgatattcgcacagagtgcacgaatatcgcgtcgcatctgggtggttacaaggggacatggtgtaacaattaacaacggatggatcaaatgcaacaagttaggtaggtccgccaatctgccttgcagacgggacaacagattaagtgtgatcctatcaatgcataatattttgcaagcaatataattaaatttcaaatataggctcaagttgttcaaaggtggcttgccttgctcgagatctggagcttgatcctcgaaatcctcgcactgcgggtcttcgggctccgaaactacacgcgaaacgggacaactcaacaaacggcgagaataaagccctattaatgacccctaagcgtgccattagatagatctcgagatttgggaaattttggaagttgaacggagtcaaatggagttatggttggaaagatattgaatttctaaggttattggatttttggtctaaaggaaaaaggatttaattaaatcccttttggaaaaagaaaaaggaaatgatgaagggagggaatctagactttcctcgggcggctagggcgcggcccaaaggtattcggctcggtccggccgagctaaacgggccggacggcccaaggcggcccatttacgcgcgcgcgcgggagaggagagagagagagccggtggaccgggctcacctcgcgcggccccgggtgggacccgcttgtcagcggctcggccc

SEQ ID NO: 53323 - DNA, 1501 bp, Oryza sativa
tttacacaacctgttatcaaacttaaggggcagtttggcagagctccacctccacctctcctagagctggagcccaacctaacagtttcagctccacccaaaaagggagtgaagttgctggagtgctctcacaaaatgaactagagagttagagttggagtggggttcaggctgctccgcaactatactccaaacccaactctgagttaaatttaagagttggatccctgccaaacgggccctcactatattatttctgctcttgctcaatcattaatgacatgtacacccatggattaacctctgaagaacactggaacagtaggtcataaagataggaatgaaatggcacagtaaatcctttgttttctggaatagatttgctgcagtagccacaagttgggtgattcattttgatgttgccgctagctgtgtcattttcttagactattttggataagttggcaaagcattagtgcaatgctatatgtgaggtaaagactacaaataatgaatgctcgagtcttttgtgaacagaatgccattcgaaggtagcaatgagccaatgattgtgatggattttatctgtgattattactgaaattatctttaatgttttttatgagccatcaaaatttaatgcagtcattttaaggccatactactctttcatgtcttgtatttcttgttattactgtgatactgaactaacattgtcgcctacataaacaaggaaataacaagagaacaatacactcgtgcatattaaataaagtgtttagtgttcatatgtcagctcggcatcaacatgttaggcctagccagtagagataatatgtacttaaaacaactataaggttactttccaggtttcactggcaactataagcttatttccagttttcactgaatgaagcctttgcttggtccttatatatgaacttgtctgttcagtgcattcatgaaactttgtgattcattagtgacttactgatacatatgtgaccatgtgcgctggatatgaaggttcattccaagcactagtcatatgtaaaaaaaaggtgcaatatgcacctgataattgtagtgctgtgtatgtacatttaatctaacatagttagtagttcattagagtaattagagtggttcatgatattagttcattagttactctaaacatagttatatgatgtgatctttcttgtgatttctgttgtgttacacagttacggcatagattttcctgctataactccaacaggtcacgatgatgccttccccgatcctcacaggttcgtctccaatcacctaaagtataggtaaatcatactcacatagttaatagtttctgtttttgtatgcagtggtattggtggtggcagcagccagcatgttggtaatatgacacccatggaactctcaaaaatatttctttttatgtttctgcatctctacagtcttgttttaccacttatttatacaacagatccaaatgatccaa

SEQ ID NO: 53324 - DNA, 1501 bp, Oryza sativa
aattcttcctcgcaaaatagtacaatagtttatagtatacttgtttgattaatcatctctcttttattgtcttaatccaagtaccctccaccccttctccatggctccttaatctcttctcattatattatgggggtggtgccatggagacagtaactagaattggacgatgcgtctgaacgcgcctgaactctgaaataaagcaattttttttttcatatagtatagttggtccgattacaaaaaatatgtagttcaaactttaaaactatagtgagatacataaatttgttcatgtctaattttaagatttaatttgagtaattttttttaagggactctagttgacaaacaactgatttctcttatactcccaccgtcccaaaataagtgtagttttgcactatttacgttcaacgtttgaccgttcatcttatttaaattttttttatgattagtatttttatcgcattagatgataaaacatgaatagtactttatgtgtgactaaatattttcaattttttttacaaattttttaaataagacggacggttaaacgttcggcacggatatccacggctgcacttattttgggacggatgtagtaggtttcagcagtttttcttgaccgtacggtacccacgtgtcgcccatcgctcttgtcacgggcctgttcagaatctcgttttgttggttgtagtagaccttgctacttttgtggcccacaagccacagtccagaaaaggaatgactttatgccgactttgtataacatccctaatctaatattagaaatctttaccccttaattatatacccgtcacaagtacaagtagaatgcatgtcaatgagggtagaaacgccatatcgtgtgcctggctaggataagacggacggaaaacgatcgagaattgacggaagtgttaaaaatgggaacggggtgaactttgagtgttattaaagtgaaccggtatctttcggtgctataaatcaaaaaacgtgaactttcgatgctatataaccaattttgccttattatataataaaaccgtataatttgggtctctggttttgttgagtcagcaaaataaaaaaacaaaaagattatgaggcctacatgtaaatgaggtggatggtgggagatgggggaagagaagaggtggcggcggcgatggtcccatcctcctaggtcgaccgcgactccgcgagaatggtagatcggcagcagcacgcgcacgtccgacacagcgccatgggtaagctcccgcggcggcggactcgtcgtctacgacactgctctggcgggtgcaaacgcacgcgcccggcccaactccacccaggtcgttggcttcctcacgctcaccgtcctcctgctcccgaccaggctcacgctcaccagcaccgtcgtcgtgctctgcccatcgtgctgctcactagccccatctgggtgcatgtcgccatcgtcgttgcagacgaggcagcaacaaccttccatagt

SEQ ID NO: 53325 - DNA, 1501 bp, Oryza sativa
cctcttccttgtccctaggtcgcctgcgtttgtgttacccggccttgagttgcatcgatgatgatgttgtttacctcttgggcaacgctgctggcaggggtgctaagacgggaggaatgatggtcgctgttgacgtcaggaacaaggagctgcgaggagtggccaagcttgaccccgaaaagaacaccctctactccatgcgatgctaccttgcaactgggatctccaaacgcctcaacactaccacaggtacttaattaccgctcgtattccagaacaaatgcagcaccatgtgcatatgggtaataaaatgccatttaaggatctagggctgatcattatagttctttgtttatgatggtccgaatgaccaaactaggactagaatgtagtaactttatttagggtgataggcttgatatgttgatacaagggcagaacagtaccaagagtccttttggcagagtagtaccaatactcattatgcaatatactgttttgtgtgagtttcagacaaacgttgtgtttctgactgtacttgcaaaaacaaaacctgaactttgttaacagaataaagacacctccactaaaatgtcgacgactaatgcataaaattacttgcattcttcgtgaaaattcatagcagtaaatgtgtcgtcactcttgtttccttgtcattatgcgtgtaatatattttgctagcatgcatttaaatatgaagtaattaatcaaagtgcattcgtaccatgtcaaaagaacaagagaatagagcaagtaataataaggtagtacttgaccaaagcatacttgaaaaagtagtatattgctttaggttttgcttttcctgttgtactcaatgtggacaacatgaatgctcttcctcttgagtactaattcttgcttcaaggacattttatgagataatagctattttatttgatgtagacacaagagttggacgacctgaggaggatgcagaagccgccgagtagaatgtgcgaacccagtgacatatatgcatcatactgcagcctgcctggatgcaaatattatcgtatcagtggtttgttggcttgaatgggggttaaggagttgtgctgttgctgggcatatatagttttgtgacaagaatcttatccaggttgcttactttgggttgatgataaaagtaggagtagacgttaataacattaatatatgttggcttattttttgaggggatgttggcttatttatgtggcactaattgtctttatgcctttgagttaaacacaaaacaatgatccaactctttgaacctgtttgtttcaagtaatgagttgatgaatttttcaccacttggagtcctccctcaaactggatctgctccccgctgcctcaaactgttttttttttttgaacgaatgtgttttctaagttcattctcagaacaatgcccgccatcagattcatcgactagcatagcaagacagtataactttttaccaaagaaaactgatta

SEQ ID NO: 53326 - DNA, 1501 bp, Oryza sativa
ttttgtttaatatacatgagtatgcctatcactttattaagaagtaggaaaccacagtggagagggtaaaacaccctcaccacaaacaattacccgtctgttgtataaacacaactcattcgaccagaccttattcaattgaggtaaacgactttctaaggaattcgtcatcgagctgaaaggccctggcaatacaccaaaaaccacatttatttgctactgtttaaatgacagtcgtaatattaggactagcctcattaaacacatcagcatgatatttttttaatgtacgatttaagcgatgtacaagcagatagatttgaatgtaagtaattcctaaaaaatacatttgactcctcaattgaatgatacaggtttgatggtaatagccaaaattatttctaaagccactattgatggaagcaaaacagctcaaagtcaaaaccgatggttatctgtaaacagaaggagtattataatgccacacacacacacacacacacacacacacacacacacacacacacacacacacacacacacacacacacatatatatatatatatatatatatatatatatatatatatatgaccacctctcctcctcctcttcctcccctcatcactgatgaagatcactcactcactgcctatacaacactacacaactctgcagtctgcacttgcctcctctgcaaaaaccaagtaggagtagtactgactcactgcctaccactactagtctcctccttggtggtagagtattcttgttgtgttgtgcacttgtgctgcatctgtgcagtgtgctgtgttgtgtagcagcagcagctacaagtagcaaagccaagcacaaccaccatcaatttcacttgctcattcagcagcagcagcagcagcatcagcatcagcatcagctgcagctgcagctgctggtcatctctcttctcctctgctgtgtgaagagagtgtgtttttgtgtgtgtgtttcagtgtgtctctcatccctatcaggataagcttctgcttctgctgctgatctgttgcatttgccctgttcttggcgctcgatttgttggtatctcggtgtttgcgatcaataattcgttggttcgttcgttcgccgctagttgccaccttcgccgcggcatgtccgtgggatgagagcgacgggcggtggcgacaaaccggccattcctcgtcctcctcctccggtggtggtggtggcctcaccgtgaaagcgagaggtagacgacgaggtgtccaagttgccaacaagtggcgtggagtggagccgtgtcgtgccatggattgggatctcaagatgcctgtttcttgggacctggccgagctggagcacaacgccgtgccgaacatggcggcggcggcgagcgcggcggagccgggcattgccgcggtggcggcgtcgcgcggggcgccgggccggccggagtgctctgtcgacctcaagctcggcgggctcggcgagttcggcgccgcg

SEQ ID NO: 53327 - DNA, 1501 bp, Oryza sativa
aaagatgcgctccttgcgtattcccgttttttaaagtgacagggggactaagcgatacaatctcttactactacacatccaaatttctgttcgtagatcaactctcaaatccctaaatcaaaacagggggactaagcaatacaatctcttactactacacatccaaaattctgttcgtaaatcaaacagggaggtaaatcaaacaggcgatcccaacatgttggtaatgcgatggagagcgcgatcgagttgacctggagtcgcctcagggagacggtccgctcgcacgccgttggcgatgtcgttgtgcagaagctcgtcgagcgcctgcacactcgtcgagatcggatgaccaatcctgagtgcgagagcccgcgcctgcatggagtggaggaggaggcggtccagcaggagctccgtgagacgggagtgcgtctgaagaagcagggcaccggagccggcggtgggcatggggctggcagcaaggacatcgtccgccatgtcctgggtgagcgcgtggatggcgagagaacccctcacgcggaagccgacgaggtcgttgaggagcccgcgccgcaggtcgacgtcgacgagctggagcttgagctgcgggatgtggaccttgagcatgaggtcgaggacgcgggcgagctcggcgacgtcggcgaggcgctcgaggtcgccgtcctcgacctgccactggtagtcgacggagagggcggagagggcaaggtacatctcgggggcgtcccgcagcgccgcgacggagcgtacctggacgcggcactccccgaccacctcccggacgagggcgcgcagctccgggaggctggcaacggtcgccgtcggaagagccatggcgtagcggagggggcgcgccgcgcggccgcgccgcgccggatgaggggtgggacgcgaacgcgactacgcgagcacggcgacggcggcgtgacgcgagcaaggaggacggtggcggtggagcggggtgggagacgagggcgaatcacggcgagggggagtacttttatagctggaggcaggctgccaggctggcgcagcgtaggcgggtcctccaaatctcggaagcaggaaaccggaaacgcatcgtgcccgtcctgtcgacgtggcagacacgtaattaaatttacggctactactagtacttgttttacaagttaattaatttcctcaaaagaaaaggcgctcgggtacggtaatttcctcgaaagaaaagcacccgggtaaaaattcataacactttaaatcttcaatatatacagtagtacttaaaaaagaagaagagaaaactagctctccaaagccccgcaaattctctcgctctctctctctctctctctcccactcctctcccctctcccttctctcatctcgcgcgcggcgcgccgccgtagagacgaaatggtgggttctcgcttcgatttcgcgttgcgcttgctggtgtgtgcgtgctgatcggagtgggtgattgcgatgcaggtga

SEQ ID NO: 53328 - DNA, 1501 bp, Oryza sativa
gctccaaatcttggtagttttcactttggaattaatcatgtgcaactcttgcttggcgaatcgttgcaaatgaagagcctatccatgtgctatcctggtgctgtctattatgcttgtgcagagcttccatccaatgtgccaaatcttgaaactctaaccattggctctcctcatgaggtacacccaaaaactttaaatgattatggacttgctatatccttacaacagtactttagaagaatatcatcagtctgattatctttccgcagatggtcgacacaccaatgttgcctagcaaattcctccacctcaagtgcttgactatttctcttgttggaatggtcactttttccccagcctatgattatttttctctggtttcttttcttgatgcttctccttccttggagactttctttctggatgtaagttaattttcattctttaaacttatgtattggccatttacagtggtaaccatcaattgaagcacattggcttttcatcttcaggtatcacaagaacgcatggggcatgtctcaatttttggagattccttgcaattgaggcagatgcctgaacaccatcgtcatggcaacctccagagcgtgaagatcactggtttctgctctgcaaagagcttgatcgagctaacatgttatattcttgacaatacaacctcactcaagtgcctaacactagatacaacccgtggtgtttctagctgttctacaggcgaacacaagaaatgttttcctataggcaagatgctcactgaagccaacagagcggtattggcaattgaaacattcatcgagcgaaaagttccctcgacagttaaattagctgttacgaagccttgcagccgttgtcatgttaaatcttagttgtgtttttctcagcatttatccagcgtagatggttatgtaatttctctcttcatttactacattattataatactgtccaataagttttgtaactttacatgcttgcgtttctcttcattaacccaggacacaactgaatcattttcgtctttcatctctaaattttgctagtgacattaactggaacatctaccttttgtttgacaccaagtgataaacaggttaataagaggtttctgcatttgaatttcaattacagatgctctaccagctatactatcaacatatttttggttgcattgggctgacaagatatctacagcttgacctcaattcctaaaacaaatttcaacactcaaccatggttagttgcacattcaagaagtcaggtaacaagccaacgaaaagaaaaatctggcagccactggatttaatttgctgatacatgaaggtcatcaagagcgtagaatcatttcatttctatcccagttggtagattttgctgatacatgaaggtcatcattcatttctatcccaattggtaaatgcaacaaatcgtaacaattggtaaatcaaccataacaactctcaaatccctaaagtgacagggg

SEQ ID NO: 53329 - DNA, 204 bp, Oryza sativa
  unsure (1)..(204): unsure at all n locations
acgggagcgactcacgatgcaaggaggagcagcgccgaggaggaaaaggtccggtggcggggtggctcgtctcggtgaggaggagcggtaaagagaaggagggccgacggcggcggcgacagctcatcgaggaggaacgccaacgagttggaggctagcggcagatnggctcctcccctcccctccaatcccgccggcggcagt

SEQ ID NO: 53330 - DNA, 1501 bp, Oryza sativa
atgcaggcttcaaggaagggctgttgtttttgcaattgattttatttgaactcttttctgaaacaactaagtgagtgcttctcaaacgacacggatgagacagtgcgtctcgtccggtcggagtatatgcaatgtatcagtcttttgaattgatcaagattggcacccggccaacagctttcaaacggccacccaggcctggctgatcccatcagccgcagattttccaaacatcaatcccaaaccacttcagcaaatttcacaaagcagtagtcaaacaaaactacgctaggaatcacctcacatctgcccatgaccgtgggcgcggctgttcgaacagttttaataacctctgcagagggggtacactttacccacacgacattactaacccgaatcatccagcccgtgcagaacggccacgactagagaccttaaggatttcatgacaaggcatttcgaaagccgacacaggttcaccatatgccaacgagaggggtcccagaccaacaccagattaggtctcagaccatactatgccaggaagcccaggggtcctccccgacaccaccccggcgaatccacatgtctcttagcatcatggctcccccgataagctagttactcagtcaggggtgtcccatttcacccatgtggtcgcacttgtcttatgttcggatgaaattccaaggaaacggtccttaagtgcaagagcgggaaaccgtacacccggtacgtttcccggtccgcggttttggaaattcatttagttcgcaagcaccggcccaggtgtcgggttttccaaatcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcggattaagtgcgatcctatcaatgcataatatttttcaagcaacataattaagttcaaatataggctcaagatgttcaagggtggcttgccttgctcgagatcttgagcttgatcctcgaaatcctcgcactacgggtcttcgggctccgaaactacacgcgaaacgggacaactcaacaaacggcaaaaataaagccctattaatgacctctaagcgtgccattagatagatctcgagatttgaggaattttggaagttgaacggagtcaaacggacttacggttgggaagatattgaatttctcagattattggatttttggtctaaaggaaaaggatttatttaaatcctttttgaaaaagaaaagaaaggaaaaggaggagggagggaaattagacttccctcgggcggctagggcgcggcccgagagaatggggcggctcggccgagcttaatgggccggccggcccaagaaggcggcccaaggcgcgcg

SEQ ID NO: 53331 - DNA, 1501 bp, Oryza sativa
ccggcctcggcccggtggccgcctcgcccggccaccacctcggcctggcccccgcctcacctaggccgccgccgcgcccgagcgccgccacctcgccccagccagttgagggagtggttgagggagaagagataaggtatagagagagggttgagggaggctgagagagaggacgggataaaagaagagataaggtagagagaaaggggagtgattgagagggaataaaggggaaaaaggaagagagagataggaaaaatttgaagtgggtgtgagggaaaggagggaggaatatcccgtgtggttggattaggacgtccgcaccggaaaatcaattttcccgtgcgggcgacaccctagcgccggttccctatttttccgtgtggttccacttatggaccgcatggaaacaaaaaggggggcatccagtaaaatcaatcgtgcagtagtgcgatgagcaatgtttattttgactgtcatcatccatgcactaaaaaaaatatgagatcgactttaggtgtgaaaagatagatatttgctccggtctagcaaaaagtatatcgagttaccggtacctcatgatatcaaatcatttttgatcgttagatctagttaggtaggattggcattgttagatccaagagatttgctccgttccaacgattaaaaacgatttgatgtctcacggtaccggtagctcgatgtactttttattggatcggagcaaatctcccaaagataacatgggagcctccgtgcctagttttactgtagtatgggttgtatgggggtaaatatggggttaagttgggaggaactaggaaggagtgcaatgtctccatgggggaaccgatgaagctaagcacccataaaactatattgcatttgttgcttccaatgaccaatataagcaagaacttgacacagttcactacttttttctattgaagcaagagattactagtaccctgctttggttgaaagcatataaggaggttttgggtataggacagctgttaaggacaccaccttactattttatttccctgttcatgtctgtacataaccatgcctgatgtatctgcagacggttcgattgattcagcggctaaaagaaagggatcactctgtcaacaagttgcaaattctgaaggcaacaaaaaaacaagatattcagggctagaccttccagaggtatgtcaccaaaagccgacaatggaagactctaagtagcctctaagatattagaagtgaggattcactatgagtctatgactgctagtagcctctaactgtgcacaccggtggtcctatgtcagtatgtcacctagataaaattttgtgaatggatctttagtgctcctatgccttataagctactagtattgttttctcttccaatagaaccagttgtttaccttcacaatagtttgttttttaatcttttatccttgcttgtgcatgcaggaaatctggtgccatatacactccctaatggcat

SEQ ID NO: 53332 - DNA, 1006 bp, Oryza sativa
catgacaaggcatttccaaagccgatacaggtttaccatatgccgacgagaggggtcccagaccaacaacaggttaggtcccagaccatactgtggcaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcgagagcggaaaaccgtacacccggtacgttccccggtccgcggttttggaaattcatttagttcgtaagcaccgacccaggtgtcgggttttccaagtcttttataaacccaagttttacccaagttgtttttcagattttaagtttgaaggcgtccgtcgatactcgcacagggtgcacgaatatcgtgacgcaactagatggttacaaggggacacgatataacaattagcaaagggaggatcaatgcaacaaattaggtgggtccgccaatctgccttgcagacgggacaacagattaagtgcgatcctatcaatgcataataatttttcaagcaacataattaaattcaaatataggctcaagatgttcaaaggtggcttgccttgctcgagatctggagcttgatcctcgaaatcctcgcactgcgggtcttcgggctccgaaactacacgcgaaacgggacaactcaacaaacagcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatccttttggaaaagaaaagaagagggagggaaaatagacttttctcggacggctagggcgcggcccgagagaaagggcggctcggccgagcttaa

SEQ ID NO: 53333 - DNA, 757 bp, Oryza sativa
gagcttttgcgccgtactccctccgtcaaaaaaaagacaaatcttggtttccatgtccaacattttaccgtccgtcttatttaaaaaaattatgaaaaaaaataaaaagataagtcacgcataaaatattaatcatgttttatcatctaacaataatgaaaatactaattacgggatagtcaaatgttggacacggaaacccatgtttatcttttttttgtcggagggagtaggataaggaggagttcggagatttattctccgtacccctaacataggcttacagccgtcagatccatcttgcacggtgcagatcggcgcgggagaaagggcgtcgcgacatttgcatataggaccctagaattgttgaatattaccatttgcccctcggaggataggtaacccagaactgggcctacattaccgtccgatctaaatcgtgcggtcaagatcgaggtaggagagacgtttcagattttatagcaaagccttgagaaaatcacgtagattatctgcgtcgttagttcgggataaaatttcaaacgaaactaaccagaataaccagatgcctaacgactaacgacacgaatttcatgcaaacttttagcaaaatccctataaattcgtgacctgcaaagccttcaacctcctcctcctccccgccatagttttcttcttcaagcctcgccgtgtgttcgccggcgagcagagaggacgatgggcgccgcgcgcggcgtgctccaggcggcgcttcttc

SEQ ID NO: 53334 - DNA, 1501 bp, Oryza sativa
caaaggagacatgtcgaagacagagtgatttgggccaaaaaaaaaaaactcaaaataatttgaatagtacactgcctggactgtcaccttaccttgcatatggtggtttgacttgttctttcagatgtgttgagacattccttgaactttatttgttgccattcagcttccagagaatgcaggtatgactaactggatttcgaatgcagcagttttattgtatctcagatacaagctttgtttgatttcctgaattttcgttctgtggcaatgcttcagttgaatactaatgcccagaatgcaggtcgtcaattcaatgttagtgtagcctaacactgatgattccaagttcttgcagacaaaatggccaaaatgctctcaaccactgatgaaatacaagcaaaatcaccatctgaagatagaggtcaggtatttatgtaatcgttttttttgttcttttgttaattgttattactaccattaaattgctgtacaatattcatagattgcatgcttactgaactgtagaatgttcaaattctacctataatggataaattacaatactagagctataacattagtatagagtgacataagaaaatctaccaaagtaattttacactcttatttaccacatcaaaatggaaatggccacacctgtgtgcgtgtttcagcattattttctcaatccgtatgtgactttgtgtatccattatctctaattctctactcccaaatccccaaaattttctcaatttgtattcgtgtctcccttctctctattcgcaaattgatgcacagtgctgcaccgtgtttcctctcctctggtgtgtgcccccgtcatagccccggaatcccggtgggggcagggacggggacgggtggtcactgtccgtcggggatggcccaagttgccatccctaactacagcatgaactaggctaggctgtgttcagtttcaggggataggaactaatccctcctacatgaaaaacggagcgatttattagcgcgtgattaataaagtattagctaattttttttcaaaaatggattaatttgatttttaagcaacttttgtatagaaactttttgcaaaaaacacaccatttagcagtttgaaaggcgtgcgcgcggaaaacgagggagaggggttaggaaaatgggtgccgaacacaccctaaatgcatagacagcccgtgaagaaccccttaaactcagcttatctattggcaaaggtctttgatgacacaaagcgttcttccggagatgaattacacacaaaaatccgtcccttttattcagtacatattatactctatgcatatggtctaggatggataattgcgaacatatgcaagtacaagcatatgtacgctaaagcatcacatattgactttacataaagtaatatggaaagggaagaacagcatgtatggattaataagagttaaacttatgaagctgagattcatctctgaactttctcctcagcagt

SEQ ID NO: 53335 - DNA, 580 bp, Oryza sativa
ggtttaccaagtttggcggggaagcaacgtaagcgctctctagctctctgtctctttctgtctagcttcatggagcaattcgattttgtttgcctgtgaacggtggatctggatctgggcgcgcgcgcgcgagattagctgcagcttttagggaggatttttagccgttttattatgtgactgggcgcaggcgtgggaggaaatgagatgttttcggtttcacgtgttcgcgatttgtgtgatgcttatgttcgaaatgcgagtttaggggcttggtgtgacagaaatttgagccgtatttgatgcttactgtagactgttcgtgttctagttgtttatggttgggaaatatagctctggatgggtggaaatcagttcatattcgaatcatgaaatgttgatacagctaggggaaagtgtgtgctttctattgttacgagaatacacagcagaaaatgttttatatttatgttcagtgcttcagtttatttatcaggttgggtggggactggggaatgctagttcattagtttgttggggaagctacttcaattttcagaatatgaacttttaatgactc

SEQ ID NO: 53336 - DNA, 302 bp, Oryza sativa
cttaatgacctgcttcttgtcccgctctcttccatgaagggagcatttcgtcaaacagctggtcggcgtcagtgggctcggctcacgtcgcctctcctcatcactgcttcgcagccgcagcgcgtcccggtccctggcgagatcgttgtagcgctccatgatcttcccaatcttgcggttgaggcgatccggggaggaggagaagagcgagctgagctcgcgcttccgcttgccggcgctggaccggaggagctggagcttgaaccgctcgaggcgggacgcgcggagcgcctcgaactcga

SEQ ID NO: 53337 - DNA, 636 bp, Oryza sativa
cctccgggggagatgggccgagcgagattcggcccatcgaccccggaggaggcaaaatagacttttacggaggaaattgatttggaaggatttgggttcggaattgaactcgacgatggatcggggatttgagatcttgagatggcacggacactagacgacaagcgaagaaacaaatttcgcaaatagggtttttaggagaaaattttcccgctaggcgccacgacggaacgggcgctacacatactttcagtactcataaactacaacgtgcaacatgtgagtaggattaaattagaggaacgattattgatcactgacaagttgtctctaaggttggagctttgaaggtgtccttttggtccgtggatctagaaatttaatagatagaaaaaaaaagacatggtcacaaaaactatagtgcctatagtattccatatctatagtaagtcataccaagcgctattctcttattaagaagaaataggcactatatatattcggatcagtatgtcatacaagtctaatatatacgacggtccctattactccttaaatcaaattgataccgagtttcttaagtattccatatcttctatttatgagaactaatttatgatacctactacaagatta

SEQ ID NO: 53338 - DNA, 1501 bp, Oryza sativa
ccccaaaagaagaactcataagcatgtgccatgcattcagatttacagaagaatggtagggtgattataaagttctttgtatatgctatgcagtgatcaataattattagttgcaaaacctaagcaaacctggtgcattgtggctaaggctgtaaggcgtgaagatacattgtactctactccctccgtttcatattataagttgtttgatatttttcttagtcaaacttctttaagtttaaccaaatttatagaaaaatatactgacattttcgatacaaaacaaacatattatcaaaatatatttaatattaaatttaatgaaactaatttggtacaaaagatgttgatgattttttctataaatttggttaaacctaaagaattgtgactaagaaaaaagtcaaataacttataatcaacctgaagaattgtgactaagaaaaaaagtccaataacttgtaatatgaaacgtacggagtatacagctagctctctagttcccaattccctgattcataggcacaattgcaagcaaccacctgagttagggaaattatatagtttttcaccagctagatcgcatccctttccacagttccagatttacaggctcacgctttgctgcattctcatatgaggagttcccatcaagaggaaggagcgtggtgatgcagtacctggaactcctggacctgcttctgctgctcggcttgccactgccccaccacactgaacacctcgcccaccaccgactccaccttctcggtcagcgcctcggcgaaggccttcccaaggaagaaggcgtcaagcacagccttgctctcatcgtcacctacacggacagcaacagcaacacccaatcccacagttcagaagcgcctctctctttctctcggttgcacctttctgaccacacacaccaaacaggtttacctacctggtttgggccctggattggtcccgccgccgccgccgctactcctggctacgaatctggagaaccttctggcggagcacggggcggcggggaaggaagcgctgcggccgcgggggccgggggcgtggagcgagacccagcaggtcggggaggcagccgctgccgccggtggtgggagcggcgccatgtgtgtgctcggggtctgagccgtagttccgtggaattcctcggcttcgccagcggccgctagcgggtgggaattgctgaaacccctccggcaacccccaccggcggtcggcggacgcgcggcttggattggggacagccgggggaaatggagggattgtttctcggtagttcaggatttttttttttcttttgggtttcccgtccatcgagaaaactcactagtggtgggctccgactggactggcccatcacgcttgaacatttggcccaccgaggccttcacgcctgcccgtttcgtcctcacgctgcgtcgcccggagtaaaattcttggtcaactctctatcgtcaacgtcctcgcatcgcggatggcc

SEQ ID NO: 53339 - DNA, 1501 bp, Oryza sativa
catgcatgcaggtatttccatttttactgtgcatgtatttccaaatttgcgccctctaatcatgcatacacattatgattagcactttccattttctatatcacatttccatatatacaacgtttgcatgcagatacttaccttttgaatcatgattcgtttttgaaaaatgacgccattccactaattgcgattattgccatctattttcaagattacattccattttcaagatgcacatataaccggctactgtattcctttttttgatttttcttttccacactgtttcacggtccaagagctagctatccacatcgtcttcaccgagttacctcgccgggattgctcgccatgccgtgaagagggccgacgtccgtggttttcgtcaccgacgacgttcgtccacaagcctcttgctggaaaccagaactcctcaaccatttttgtcaagccatcacagcgcctgatgtccaagtgccttttcgctgccgtcgctggttgttcgtgagcttcggaacagacattattcactagcaagctgcattacctgaaaggtatggatctcagtgtttatcactcacacatcttacattcacatgcagtccctgttatgtatagatgattcgccattcctcttctttttatctactaaactgagcacatgatgaatcacctggaacctaaatttatagattttttgttgaaatgcagttgaatttagattgttttaggtatataacatgcccgttcgaatatcttgatttgcatccagtgaataaaatttaggtaggtagtgaaacagcagcaatgtctcttttacgtggacatctcaattataatctttgtaaatatagatttaattaattttaaattgaagtatatgacccgaagagaatcatattgcttgttttaataatggtagtttttaatagcatgccgcggcttccaaagtgtgcgagcatgagaagaaatgtgaagcgtcgttccattcacgatgatgatgactttgtcactccacctacaaggaagaaggctgttcgtgttaaattcgtggcaccggtttcgcgttgtgtaccatcttccatcacacctatcatacagagatttagtgctgaaaagaaagagctggtagctgagataattatgtcattcatcttgtgggatatacatgtatacgtgttcgctctgtcactcataaacctatgtgtacatgtacacctgtaaaagtacagattatgtcattaatcttgtggtattcagacgtgcattttttcactctctctctatcccgttgactatggccaattagtaccgaaatcactcgttggttactaaattaatcaattgatacccaattctgactggatcgatccatgctgacggtaacaaattatattatgtaacctatcggtcgtaatagctataaatattaccataaataagatctttatacttggtaatgatattaattttttcattccttccaacggagacacaa

SEQ ID NO: 53340 - DNA, 1501 bp, Oryza sativa
tttgaaaatgaactataggaagatgcacagctagcttgactgaatcatttacattgaagcataagaactgtgtgccatgcaatgcaaaacttcttttctcaattagaaatttaactattttcttgacaaactgcaatataaatttctgaagctgcacaactggtgtttattatattaagaggtatgatatctacctctgccatggcattagttacgatatctggaatgggctctatagtgtcaccgatccaccgtatctggaatgagctgcccttctcttggtaatttgctatctgctccacagttgtcaaagaaccaatatcaaaatgcaatttcaatatagcagcatcaacgaagacagggggaacggagagagttaatgatgggtgataaactcaggctattcttcagagtgctaccaacaggcagagataaattacagagctgtagaatatctctttttgctgaagattattaacaacatcagtgattcagtgtaaaaaagtgaaaccagattaatggaatggaatagtgaataaattcgttagctttagagagatgatgctgccagactggaggtttcaaaatgttacataagattataattcaatcaaaggacacatttctatttcagaaaagatagctaaagagagcatttgcttttcattcttcaatgataatttcagtttgaagtggagtcgcgattgaacttttgtagtgtacatctgagaatagcatagtaggatgcttcactggaatgatcaatttatattttgaactcatgaaatagtaaaagctgaagtactcctacatcacatttaacctgtctcaaccatagtagtgctcagagaagaattcagaaaccatggtttgcagagaaattgagcatcatgattcaccaaatatactgaacatttcaacattggcacagtaataactaacttcaaggcctcaaggaatattcatagtaaaatgagaagactttttttttctctgaggaataaaatggaccatatttttatgaagctgtatcagatttgctcagaaaattgcatggtacattgtatagccaatattctatttcttgaacctatctaactatgtcaaaaggtgtgagttggacttattatataactatatgagtgaactgacaacaggaataatccctgcgagtaggttcaactgataggacctatacattctggaataaatgaactaaatttgtttgacgacataaacttgataggtctagatactcgctaagctatcataggaagagtaaaatctttctcataacaaagctatgaccattggcaaaagacaggatggtctagttgcatagaagaattatcaacaaggacaaccacatgatagactatttgtcatatttcagacaataatagacatatatacatgtttcttttgttgggatacgcgtaagctacgatagcataaattaaaattttctatcgcgtaaaccaggaaccatgcaaatattaga

SEQ ID NO: 53341 - DNA, 1501 bp, Oryza sativa
acaattgactttttttatctcaaacaaatattaaagtgaaagttttggtgattatgatgtcaacaatataaaatatatcacttgtctgggaagtatacgtgtatcttaattttttttggggcatttaactatttgtcacttttaagatgtggcaaaaaaaattgccacttgctgtctatgacatgtgggccaccctgcgtttatgacatataggcttagtgacaaattctttttatcacttgtaagattggtaaatagttaattattcttttttttcagcaaaaatcaacttggtggatcagcaaaaatcaacttggtggattagcacaattacaattacaaagaaacttaccgcacctaaacttggtatattgctctctcgttccgaaactaccgaggagagccaaaatctctcgtttactctctctcttgctctctcgtttcttctcccccatctcatttactcctctcttggttggagggagtttttagttgggattaggagtttagagggatgaggctattaaatgtcttgtttggttaggagacataagaattttggtgagatggagatgaggaattgaggaaggaactccctccttttcaatacctgggtaggggtaggtaattgggagaaaattcctcctttactttgtctaagtaaatctcgaccatccgtttttattaatgatctaatctccaactaaactccctatcaatttccatcacctctaccaaacaagatattgagattaaaaatcaaattctcatcttaatttcatcatcaattccttcctgtaaactcccaatcctcttacctcgagttaccgaacaagccgctcgtttactctctccattcctctcccttctcacgctcgccctcaccagctctccgtcattccgcctcccgttgaccggcgctcctccacatctcctctccatggtcgcgtggatccgccgtcggcggcgacggcaggggtggatccaccgagctccatcatttgtccgcccccgctcgcgccgatccaccgcctctcgcgtcggcagcgacgggaggggtggatccggcgacctccgtcgtctctccgcccccgctgacgccgatccaccgcctctcccgtggatccgccgtcgacggcgacgggaggggttgatccggcgacctccgtcgtctctccacccccgctcgcgccgatccgctcgggctcgtcgtcgcgtcgtttgtgggctgcttcttcacgtccgtcgcctcgctcatcatctccaagctgcatccgccgtcggcagcgacgtgatgggcggatccagctcatcccttcagtcccaactctgtctggtgagcagccgatccgcgacgtttagatctttgctggttcttttgcggtgatcggtgacggtgagggatatcttttggttcttggttcttgcagggtgtccaggaagagaccggcggcggggagggccagaatggcggcggtggtgagggcggaggcggtggaca

SEQ ID NO: 53342 - DNA, 1501 bp, Oryza sativa
catcatttgtccgcccccgctcgcgccgatccaccgcctctcgcgtcggcagcgacgggaggggtggatccggcgacctccgtcgtctctccgcccccgctgacgccgatccaccgcctctcccgtggatccgccgtcgacggcgacgggaggggttgatccggcgacctccgtcgtctctccacccccgctcgcgccgatccgctcgggctcgtcgtcgcgtcgtttgtgggctgcttcttcacgtccgtcgcctcgctcatcatctccaagctgcatccgccgtcggcagcgacgtgatgggcggatccagctcatcccttcagtcccaactctgtctggtgagcagccgatccgcgacgtttagatctttgctggttcttttgcggtgatcggtgacggtgagggatatcttttggttcttggttcttgcagggtgtccaggaagagaccggcggcggggagggccagaatggcggcggtggtgagggcggaggcggtggacacatccatcagcccaacgatgagggcgctccggtcgtccaagaacatggccatcacagaccaggccacgacgttgcggcaggccggcgagctggtcatcggcctcgctgcaggggagcccgacttcaacacaccggcctcgctaccgaggtaggtgccttctcttgctcccgagagaaaatttaatcctatcgaaatcatgatatctgtatccaagttgtgtgttgtaaggattgaattgattcacatttctaccattcttaattgtactctaattcatgcactaagtccacaaaagctcaaatgtttgtttgtgtataacttgaattggccgattttggcacttgcagtgcagcagacatctaagtaagcaatacctaggtgtcagagtacttgtgttatttcttatactgacaacctataaaaacacacacacacacacacacacaggcaactgttgctatttgtatgctaacttctagggaagaatattttgttttacttacttgctccctcttgttatacatgtgatgaatccttttttttatacatgtcgcgaagcagacggagttgggtttagatctttgctggttcttttgcggtgatcggtgacggtgagggacggcgccctccctggtcgtgggaccatgcagagggagacaggaggtattgaacccgaacctatcttgggccgtatggttgcggtcgaagattatatttcttgcggttttcttcctccaccttccgaatttcttcttctcgttttgaacttctatggcctttctttgcttcacttgaatcccaattccatcgtgttccttagcattttctcttatctttgcgaggcctacattggggtagagcctttccttgatctcttccgcttttactatgagttgcgctggatggaacccaacagggtatctggatgtgttgggttccgacttcgagatcgcctgaagtcgcgttacatccccttccggtgcccctcttttcg

SEQ ID NO: 53343 - DNA, 306 bp, Oryza sativa
ccgcttcgcgcgtaattcggccgccgtcctccatgaacagtcccaccgagttatctatttacgtttaggcctctggtgaatccagttattgcataggaggaagggagatgtggcgagttagggtcgcgctgtaaaacttgaaagacgagggtctttttcgcaaaaacgccgtgcacctgcccgccgctgcctgctcgtctcctcgtccctcccgtcccccgtctcgccctctccctctccttctcccgcctcgcgtcgccgccgccgccgccgccccgcgcgccgcccctcctccctctccctcag

SEQ ID NO: 53344 - DNA, 1501 bp, Oryza sativa
agaatttaaaatggctaggttccctgtacttttgacatctgtagagtcaaatgacaggggccacattgtttcgctagccctagtatcatccgaaaagctacaactcagtctaagactcggtaaataaaatcaagcagcaagaagaaaatgtcttgttacatgaaacgggctgacctttcaaagaacaagtgttggaggcgagaagtttttttcttatactcgattggaggcgaaaatggttgtgaaaattatacaatctggcataacaaaatctggcaaatcaaacaggctgctggttgtgtcatgtatgtgatcttaagcaaggtgtgggtaaaatattcactctttagatgagttttttggatctttacctcaaattcatagagtcctggttttcaatacttgcctcaccactagaatgtcttcagaatatggattctgaagccgtcaatttgtaaccaaattacaagaagaatgcagttacatggtcgcatacttttaaagcatgtgcagtaattcagattaggcataccaagactgcggttgcgtggtttctgctctacaaagatatcgcaattacagaagttctggtgaagaaacacaaagtacacacccttgcaactcctgaaactgagttcacttattcaatactcattgagaaacagtgactctcaacctccttcaggcggcctcctctgttgcctctgaccactgtgctctccttcttcattcctgcgttgactcgccaagggcgcagcgctttcgctttgaggccttttggcctaagtttgagggattcctccaagttgtgcaggacgcctggcaacctcctgctaaccttccccccctccccgcgcttgcctggtgtttctctaacacggctaagcgccttcagagctggagtgatcgtcacgtcggtagcgtccgcctccagctgcagatggcgaaggagctcatcttccgtctcgatgtcgcgcaggagaaccggtctctctcccccctggagacctggttgcaacgagacctaaagttgaagtcccttgggcttgcctctcttgagcgcaccatcgcccgtcagcgttcgcgtctgctttggctcaaggagggtgacgccaacaccaagtttttccaccttcacgccagagcccgaagacggaagaacttcatctcacgtcttagagacggggactagcttgccgtcacccatgatgagcttcaagagctcgcctcttctcactttggcgccatcatggggacgtgcgttgagcgcgagctcgctcttgatctccactccctcggcctctgtccggcgcagcttggggagctggacggccccttcaggaggtgtgggcggtggttaagtctttgccttctgacaaggcgcttggtcccgatgggttcacgggtcggttctacaagacttgctagccagtgatcaagtcagtggttttggcggctctcaactccctcttcttggcttacggccagggtttctcctccc

SEQ ID NO: 53345 - DNA, 1501 bp, Oryza sativa
ctctctgctctctggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcctctctgagggccacctttggtctttagctggtatcgctaattttggggttctcctgggaaggtagtggctctgccccctccaagctatttggagttgtgtgtagccgtcacagtagtcttttgtctcttctttattttagtcttttttctcccctttcttggtataagtcggtctgactgattgcgtcatgtaacaaacattctattcttctgatatattgacgtgcaattcttttgcgcgttcgagaaaaaagaaacagtgactcagtgaggcccataggaagatatttgatcaagctctaaattcaatagtccctgacaggttcccaggcatagaactttattcagaattttggacgattgcctcaacaaactttgaaaataggtaaaaataccaatatttactggaacctccattcccaaagtcccaatctacaacttgcaataaaaaccaggcgattacagtttctccccgaaaccaagtaatcctactgaccaccaggggagatgcaatgcatcgcaagacataactgtcggaatccccaagcaaaccgcacaaaaatcgcatcgcatgaatactagcgcgctatgatcctaccagtacacagagcacgagtatggaaggctagttgttgatgacttgagatctgcgaagagaacgaacagagcgagggagattcacctgggaatccccgcgcggtggaagactgcgaatcgctctccccggcggctcgccgtcgccgcctcgctccgccgccgtcgccattgggtttaccggaagggcaaacacgcaatatcaaagtacacgaggggtctacgtggaaaagtaccaaacaaatgggctggactcacaatcaattacggcccggcccagtagataccaccacctcacactccattcgcgaggcccacggcccaagtgacgcctcctaaaccctaatcctggcaacggacggcggatacagcccacctcctccccccacgccgcatccgacgctcacgaagcgtccacgtctccccgacgattgctttataaaaccaccacctcctcctcgcaccaccagtcgccgccttcttcctcctcctcctccgccgcccgcctcgccgcctcccgagagctccaccctcgcctccggcgaaatggtaagctcccgtctccggtgccagttgccccccgcggttctcttcccgtggatcttgcgatccgccggcttagattttttttttcttcagttgcagcgtcgatttgtagctttgtattttgtgtgtgaatattgggatgctctaagtaagattttggatggcgaatcttgc

SEQ ID NO: 53346 - DNA, 1501 bp, Oryza sativa
acagagtcccgaatcccgatacgcgtctctttccgattcggaagagaaagaacaggatcgcgcagcccctacttccctgtataccgaatcagaacagaaccgctacttccccttatataacacaggccggccttaacagggaggcgcacacttcacccaatgctgatcttggcctcggttatttcaatggcctccgtcggtgacgaggggagaaaccaaggtggtagtctttcccacggcgagactaatgcaggccaagagttggaaacatctgatcgcactcctcctaactcctccaacaccaagactagtggcgtgcaggaaattgcggcggctgcaagcaaagacgtgcccaccatccactttgtgcgcgtgagctccggcgacacggatcaccattgtcaatcgttgttttcccctcccgcttactgcaattcctactatcccccattgccgccgcagcccgggagcatggcaaccaaccagatagtggcaaggttgatggctcagatgaactacgaggagggcaccggccttggcaagtacggccacgggattatcgatcccatcaacccgaccaaaaagtatgggaaaggaggcgttggcaaattcgagtcgtcgtacgatagcgactcggattatgacacggggccgcctgtagagcccaagctcgagcggggcaccggcgaagcagagccggaagccgttgtcgacgtcgaggaggttcgcgccatggacacgctgcagagagagcgtgaagcctatgccgccgcgcgggcgtgggagcggcgccacgagaaggttcgagcctataacatgcgcaggcaacgcccaccgaaacacgccaccgccgccgacgactgggaggggatggcctccaggtacacggcgatcaagcgtgccttgaagatggtccgggagctgaacgagtcagggaagctcacgttgggcggcctgatccacgagttcgcgggagtgaaggcgaagttcctggaggattacaggacaaactgtatgccgtacaaggcgatcagcttcgcggcgccgctgctccactcgcagctgagctggtagtacaacgcaggtgagtatggaggcacgcagccgttgctgaaccgtacacttgtcatggtagaagcgctcaaggacaagctgggggcggacgcatcggcggcgtaccctcgcctgatccacgacctcgtgatggcaccgcccttggatgcgtggtggtggagcgctgaggagccggagccgatgctacggttcgtcaatagatggaagggcctccttccgcaagccaccatggattccatcctagatgaggtcatcttgccgacgctggtagccgcgacggacgtgtttaggctgacgaggccgagtaagctgagcgtctgtgtgggcatgtggattcctcatctcagccacgcccgcctacgaatagtgtacattataagcaggcggctcagagattggctgtgcggtgggatctctgagtacgact

SEQ ID NO: 53347 - DNA, 540 bp, Oryza sativa
attcctgcagccctaaaaagccatcaacaacaaaattgtataactcatcaatatctataacttttattttggttatttttctatataacatttttttgaacaatttgaatttgaatttgaaaatataacaacttcaaacaacattttcaaatactaaatgatttcaacttaaaaagccatcaacaataaaattgtataactcatcaatatctataacttttattttggttatttttctatataacatttttttgaacaatttgaattttaatttaaaaatatgacaacttcaaacaatattttcaaatactaaataatttcaactgaaaaagccatcaacaacaaagttgtataaatcatcaagatctataacttttattttggtcttttcttcatccgataaagtgatagtaacattattcacaaaattcacatatctcttatctgattttataaactataacatatgtatgtaaattctgtgaacaatgttactaacatttcagatgaagatggtttgcagtgctctcactagggaca

SEQ ID NO: 53348 - DNA, 1501 bp, Oryza sativa
aaaatgaagaaagaattccttttctgacaaagactcctaaacttcagctcatcagcattctactttagtttcacaatttcagaatccatatttcgatgataaccatttagtatgaagtattcaacgtttattgagcctgtattatttctgtatttagctgtctggaggtagaaaagctcagacgataccaaatccaaggagatgacaccaaattggtttcttgctaacatcacaccatctgattaggatacagttggaagccatgtgcagtctggttggtcctaaattcttttgctgactggattttttcgtgttatggataatgatttcacaaataatgattggcactactgcttgagccgataagcataacaactctggtattcgcatttcaatgtccagtttggttggtacatggagtcactgacaatcgagtttggaatctctgaccaaacataacagccgcccgtgacacgtatcaacatcaaggatgataaccaataatcttgaatttttcagtaaattctgcctgaagcactgtactttgtaaagttgcatttcagatatcagcacttgttctctgaatcagttgtaactttgtcagtaatttagtagcctgaagccctgtactttgtaaagttgcatttcagatacacgaaatcaggcatcagcatttgttctttgaatcagttctaaacctgtgaaaccttttcatgagtgtgtgagctccaccagaacactacctcactgttcatccacagttcatgctgctgttattaagctcaacaaaaaccttgatgcagtgatgattgcatagtttcaagggacaaggccatcagtctctggatgaatctgaggctgaaaaccgggtcaagttttgtcatggttcaagagaaacgaatgccattgtttgttcagtttaaatcttagcttttacagaacaaatcctaccaaaatgtacacaaattcataaatattacaaacttgttattagattttataaacttattctgatataaaattgatggttggaattataaatatttcgattgaatcatatcctaaacaatcatatcataaacatcaaatatttaggcctgtttagattctaatttttttcttcaaacttttaacttttctgtcacatcgaactttattacgcacacaaacttttaacttttccatcacatcgttctaatttcttcaaacttccaattttaacgtggaactaaacacagccttatatcggaggaagtagttagctaacaccaccttgcaatttaattaatactatacaattatcatcaacaaaaagctcttccacctttcactcttccccactgcccaccactgtactgtacccccaccattcctgtctcttctcttcttcactccactccactccactccactcctctcccccatttggccactagcttaatccctcctcccccattggaaggaaggacaagctcgaggagctcctcctccatggagcgac

SEQ ID NO: 53349 - DNA, 1501 bp, Oryza sativa
ctccagtaaatacataagaaatcatacaaaaatttgataatattgttaaaatttggtaaggtttattttggcttcagtttaaacagacctttaaatttttgataggtgtgcaaatgctttgatcactttgaaaattgaagttacgtacgttttcaattggcactgaaattattttgggggaattttaaccttttctgacaggggtgtgacgcgtcggtcatgatcgcgtcgcggggcaacgacgccgagaaggactcgccggacaacctgtcgctcgccggcgacggcttcgacacggtggtgcgcgccaaggcggcggtcgagaagaagtgccccggcgtggtctcctgcgccgacatcctcgccatcgccgccagggacgtcgtcgccatggtaaaccatcccatcaatcctcctcctcctgccatggcgaaagctttgctgcctctaacaaggtcgatcaatcaatcaatcaatggcgttgcagtcgtccggcccacgctggaccgtcgagcttggccggctagacggcctcgtctccaagtccggcggcgtcgccggcaagctgccaggcccggacatgcgcgtcaaggacctcgccgccatattcgccaagaacaacctcaccgtgctcgacatggtggcgctctccggcgcgcacaccgtcggcttcgcgcactgcacgcgcttcgccggccggctgtacggccgcgtcggcggcggcgtggacccgtcctacgacccggcgtacgcgcggcagctgatggcggcgtgcccgcgcgacgtcgcgccgaccatcgccgtcaacatggaccccatcaccccggccgccttcgacaacgcctactacgccaacctcgccggcggcctcggcctgttcacctccgaccaggagctctacaccgacgccgcgtcgcggccggcggtgaccggcttcgccaagaaccagacgctcttcttcgaggcgttcaaggaggccatggtcaagcttggcagggtcggagtcaagtccgggaagcatggagagatcagaagagactgcacagctttcaactgaacatagttgcatagctgcactgcgacatttgtaagttgtagcaattggggatttgatcgtatattaaaaatgaaatcatttcaaggtaagaatttcatactttctgttttcggtccagaagtcatggctgagtgatgaaagcgacaaaatgcctcttaagttaactctacaattaaattaaaattcaaaatagccacagctgaaaacaaccgaaaataatttttgatcgtttaagccacggatgataagctactcttgttgtttcaaattatttgtcgttttaggtttgttctaaaccaaacatatctatatttgactacaaatttttagaaaaccgtataagttaacaatacatgaattatatattatgaaaatatttctcatggtgaatctaaaaatataaatattgagatgttaaactatacgagtttatagaaattaatg

SEQ ID NO: 53350 - DNA, 1501 bp, Oryza sativa
gcatctcttcccccaaaaagtacaccatacaacccaatcatttctaacatttagataatttataaagtataaaaataaataaatacatgaaaaaaaaatcgaatagtagataagaaagaaaaatttagaactcatatctactatattatcacacaatttttccgcagcaacgtgtggggtatccatctagttatttttaaaggaggattcttttgaatccacctaaaaaataaacccatgtgttgggaaaatcgcttcttatagtgcagctaatcatctccattaaatattcatttgttatatatgctacaatttatttagatgacctggaaaatatggtatttcgcttactcatgttctacgtacgcacatgcctgatgcatattttacccttgatgtattgcgcattatatactggtcttttattcaaagccgtcatcattagttctaaactgaatgattaacatgactattattctactaattaatttcacgacatattttattggtctttttaaagatttgaacaaaaataataacctattgtttaaaaattatattttcgctggaaccctgaacctctgaagtcaacacaacaatatggttaatttctagcaaaacgtctctcgaaatgaatctaatacccatttccaaaccaaaccgagttagtcaattaaaatgacctgataccattcacagttgatataaaagacttcaagtttccttttaaaaagcaacaatttaagagttatatcactgttagtacgtaacatttttttaaaatagaattagcacgggattgtgctttttattaaatataatggaagaaaaaaaaacccaaaagcaagaaaagagaaaaaacatcatatacaacccccgcgggggactcgatgggtgagcgggacccgcacaaccagatagagttaggctgtgttcggaagtgcctgttaccaacacacacagtgcgtatagaaaacggagtggtacattagcacatgattaattactagtaattattagctaatttttttaaaaaaaatggatcaatataacttttttaagcgactttcgtttataaacttttttaaaaaaaacacaccgtttagcagtttgaaaagcatgcgcgcggaatactagagaggggttgggaacctagggctccaaacacagccttaatactcattagaaaggacacatcacactgaatgataatgtacaaatcacagaattaaatcctaggctattgcattggcaaatagcacaggacccatccatgagagatgtattggagtctagaatatcctcgttcctcactggttgcatgccggatttaacatcctgtcaaaaagaagtggttaaaaacggtgagaattaggactaagcacatcccttctttctataaagttaaggccaaaagtttaaacctcgtgcttccacgtcatcatcaaattgtgaaccgttggataaatatattagattgcttctcagacattagatataa

SEQ ID NO: 53351 - DNA, 1501 bp, Oryza sativa
aaagatctaagcagaaaagggagctaggcaaacatgtcagaaatggggcctaatcaaccagggtattacttaactaagagacattctgattcttaaactcctcaaagcaaaaaaaaaaaaaaagaaatcacatagatcctaaactacctacctaatgtgttggaactccatttttactcttaaattttgcagctgaccacaaaagaattgctacctgatgtcaatgacactacccgtgaaacataataaatttcttcggcgatacaacgtaaaattcacgaatttccagttcattcatcactttcaaacaaaaaccatgaagaaagtggccccagggataatgtgcacatgtagcaggtatcataacaaaagacccaactccatctgatctttggcacatgaaatgcatcagtggctttttagggataataattaccactgatgggtcagaaagttactagtgcagaaataggaaaagaggaggttataattcaggtataccggttgccaaggtaaagtgcaacaggggaaaaacttgtggtacatcttatgaaaaggctgaaaagttggcgccggaaaaggtaaagctgtgcatccttggaacaagacagccagaaaaatgttcatctcatctcatctcatctaatctctagtgataaattttcttggaacaattgtgccagggaaagggaaagccgaggccaaagaaagaactgatttggcctattcactttgaataaagggaataatcagcagtgaaaagaaaaggatgtagaagagataaactgaaccccaatcagtcagtgtgtgttcttggttgcggccaatttttattatttttttccatcgcacaattcaggcaatgatcttttgcaaatcacaatccgacgtgacacgattgcgggcagtcatcgattcgggaatttaatcaatgtgctgaatttagcatggctagaattggatatgaactgaaaatttgccaaattttacccgattttcttgtgcttttttttctttttttggttcgtcagattggtttacctgctgcactgctggcagaagcgcatctcgcggccggagacgacgacgacgggagtcttggagtgcggctcgcacaccttgtgccgccggtggtagtcgcggtgcttgctcaggtcggccttgcagccgtccacggcgcacgacgggcactgcccgccgccgccgccgcccccgccgcgcggccgcttcagcgtgctcgtggacggcggcaccttcgccaccgaggcggcggcggcggcgctcgacaccggcgccttcgccgcggcggcgggctccttgagcgcgtccgcggcgccgaactcgccgagcccgccgagcttgaggtcgacagagcactccggccggcccggcgccccgcgcgacgccgccaccgcggcaatgcccggctccgccgcgctcgccgccgccgccatgttcggcacggcgttgtgctccagctcggccaggtcccaagaaacag

SEQ ID NO: 53352 - DNA, 1501 bp, Oryza sativa
actgttgaaatttgtacacttaaatagtaattcaggtgtaacatgttctgcaaacttaaatatttatttcatcagtattcttacattcaatgattttcttgttgtcttgaaccgtcttgtaattttgtcgatcattttggttctcaggacctggtattagacacccagtgcctaggcatcacaggaaaaggcctcatgttgccccaccactaccaccaccatcatcatcagaaagacaaggttctacttttctctactgaccaattgagattgcaaatcttagtattgttagcactgaaggacacaacaataatagacgcgtttgtgcctgcaatgtaacagattgcagtgggatttcctgtactgctccactcacatctactccaatcggctccccctgtggctgcgtatatcccatgcaaattcaacttgatcttgtagtagcaccatatcagttgtttccaagaattgatgagttagaaattgagattgcagcaggaacatttctgaaacagagtcaagttcggataatgggtgctgggagtagtcttcaagatcctgaaaaaactactgtcaccgttgatttggtgccactaggtcagaagtttgataggacttcagccttactgactagcaacagatttttgcaaaagaaggtgccaataaactcgtccatatttggtgattataacgtaatatatgttcattatcctggtgagtgacatatttttttgttgacatcaacttcaatagtataattcccagtattgctgtatgtaatcatagaaattttgcaggcctgccttctttggtccctagtgttccaggatccttgggcccaataagcagtagccaatacccctttagtgcaaatgtacacaatagaagacatcagaagattaactctaaaagtgttgccataattgcattatcagctgttgtgcttgtattaatgagctttggcatttgcatcatatggaaatataaaggatttgaaaagtctcgtggcactggtcgtgtttcgaattcgtcagccacaagaaaaacaggtaacttttggcagtcctggtacatatgctaccgttataatatgtcctgttatatccattttgcatttagacaccctctgttctcgaataactaatactgttgaactgttgactattggcatctcactttgatcacaaattacttttaaactatgagattacgatgaatgaaatttgtatgtttatacttgtgatgccacacactttgacaatataacatattttcaagtatttattttattttattttattttttgctaaaggaagaagtggtcaaagtttgaaaataaatagttccagtatcagttattcgagaatgcagataatgttaatttgcaagttcaattttggccctttttttgtgtgattcaacatgaatagtaaaaccttactttttgactgtgtaattcccttgctgtttgtataacatcttgtttctgtttcaggtatga

SEQ ID NO: 53353 - DNA, 1501 bp, Oryza sativa
tgattgtagtgataaattaaatatttcaataaataaattaataattaataaagctgtgatctaaacaatacaatagacgaaagctttctgagaaatcgtattagcaaataattaacggcgatgatattgtgaataataagctgaaaagaaagtttaacttttgatcgatttctttttgtcatggtcttcaggtacgttgccccggagtatgcgatgaccgggcatctcctggtgaaaagcgacgtgtacagctacggtgtcgtgctgctggagctcctctcggggaggaagccggtggacatgacgcagccgccggggtcggagaacctcgtcacctgggcgcgccccctcctcaccgaccgggacggcctccagcagctggtcgacccgtcgatgccggcggcgagctacggcttcgagaagctggccaaggcggcggccatcgcgtccatgtgcgtgcacgtcgaggcgtcgcaccggccgttcatgggcgaggtcgtgcaggccctgaagctcatctacaacggcaacaacgacgacacctgcaccagcggctcgttcggcggcggcggcggcgaggagtacgaggacgaggaggcgtcgtcgccgtggaacaaccgctcgtggagccacgacttcgccgcgacgccgccgccggcgtcgcgcaggctggcgttcccgcgggctccggcccgcccgacgacgatggactacagctcggacccggccgacggggcggcggggacgtcgtcggcgtcggcgcggcggcagcggtcgacgtcgagcctggtgctggacaagatcgagtcgctggcggcgtacgactggtccggcccgctgagggccagcagggggaggaacttctacaggctgaggggaagcatgagcgagcatggcggccatccttccgaagattgctccatggagggctactggatgtagtagctaaagctgagtgatgatgatgatgatcagatgttgtctgcagaattgcagattgccttccatttcttgtcatgttcttcagttaactgtatagttttctgctcatttgatgatgataggattttgatatgattgatgccatgctctgaacaacaatcaccacaccacccctggtctggccctcattttttccatgtagtggatgaacgcactaatcatcatatcattatggcattttgcaacattcattgcactagaatttagcattagtctaggcagtatcaaacaagacattagagcatgttgccatgtacatgaacaaatggatagcacaacaaaaaaaagtgccttaactactcaactagctagtttgttttcgtctcaatccatctgttcggcagcggaagattgagatgaaaacacactgatttttggtcgttcgttttatttaaatcatttttatgattaatatttttgttgttattaaatgataaaatatgaataatatttttatggtgacttatgttttttttattttttaaaagatttttaaaca

SEQ ID NO: 53354 - DNA, 1501 bp, Oryza sativa
ccatctaataataaaaaaataatcataaaatttttttaaataaaatgaacggtcaaacgtttgttttgaaacgagtgaagtactcgaccacactacgcagtagcaacattgcgcgtacctaattaggtatactcgctccattacatcttacaagtagctttaaccttttctactcaaactttttttgagtttgatagtatcactagaaacatttagctacatttataacatcaaatttaaattagttttattaaatttaacatttaatatattgtgataatatttttgtctttgttgctataactttgtataaatttgatcaaactttaaaaaaattgattagaaaaagttaaaataacttataatgttaaatggagagagtttgcattagcttctcagttggctactaccccgtatttcgtaagtgcattatccaaaccattaagttatatttttttaaaaaaaacttttgtacgtaattttttattaaattatgtttaatttataataattaatattcaattaatcgttgggtaataactgttcgtacgtaccaaggaaaagccatccattccgttgtatcaaaccgagcctagcagtgtttgaggaaaaagaaatgagaagatattcaaaacgagataaacaattagcacatgatattttaaacttgaaaaataattactatgaactatttaaacaagtttcctatatttttttaaatttaaaagacatattcctccatctcaaaataagtgcagccgtatgattcaaatttgaactacagcgttacacttattttcgaacgaaaggtgtatcgtttaacagttttaaaaacatgcactactgtaaccactcatctgaaacgcagccttagcgacaccacacaagccaagcctggtttagttcccaacgttttcttttcaaacttctaacttttccatcacatcaaaaattttatacacacataaactttcaacttttccgtcacatcattctaatttcaattaaacttcaaattttggcgtgaactaaacacacccgagcgatttacttcaaattttagaggatcagatccgacgaaattcaaactaatcaaatgaaagtgtaaaaatccttcatcacaagtaatgcgaataaaaatagtgaccggtcaaacaataccgcgcgtcgagtcaactcccggccccaaaacttatcaatctgtccccgcgcatgtgaactcaaacccatccgatcggttgactcgcaactgatcatgcgtagtaccccccgaatattcggacgagatgatcacatcatcacgcgtcccctagaaaaacccactccgccgccgccgtcgtcgcgtcgcacgcggcgccctaaaacagcagccgccgcgccggccgctcgccacattcacacgagcggggccggcctctctcacgagagcaaaccaacaaactagttcggcgagcgagctcggtcaatcgggataccgccaaagagtgcgtgcgagtggcaa

SEQ ID NO: 53355 - DNA, 1501 bp, Oryza sativa
gaactgctcagattttgctactgttttatcacattccagccccttactccgaatgtgtaggggtactccgtaagtgcttactgctcagcaaatactcttaagtagtactctccgtcacactcccttcatctcaaattgatcatatgtatttattcagcaagattaaaaataatttaaatcgtatcaatcaagacacaatgcacacaatctcccacaatacatgtatcgaataaaacactatgccaattatatccttgatatgcatatattctcctttgctacattaattttgttccgatgaaatccgtatttatacggttatatgataattaatttgagaaattttgaatttaatatatgatgatcaatttggacagaaggtagtagcaacttgagttattgaataataagaggatcgacgtatctacaaatgttgggaataccttctttctagctaagattgttcttgtgtatgtgttacggatccaaatggtttgacgtgtaaagtgtgcgcggttatactgcgtacagtacagttaacaagagtgctattcgctacatattggtagagacagattaattagcaagtaatccatgtcaactccacgcaagctcgacacggattcgtatcctctgacttccgtaggattaatgcatgtcaccgcgtgacattcttcctatcttaatggatgaatagtcaaagttgtcttacaaatttcatctgatgctcagtttagtccttgatgtttcaatctatccgtattactcctttaagttttcagtttagttcgaacttatcctttaaccaacaactttttgataaatgatacttatacccccatcattcacatatataagagaaaaattgcatgcttaactttttttatagataatgcatagtaaattatgtaaaacaaaaataaattatgtactataaagtgtatacgatagcaatagcttaagtttcatgtgcacatgttaaaataataggaagtacatctgcactgttgtttattcatcttggttttctattttctatacaaattaagagcaaaagggacattttccaatgaaatattaactagaaatagccatatggcatattaagtgggcccaagaatgatttcaagccaaaacaaatatttagaggagctatgtggacaaaatgaaacgtgaaggaccaaattgagccttcggtaaaacttgagggactaaattagccattcaccctaattaatccatccatttgaaatcaatggctgaggattaattgacccacaacgccttgacctgtgattctgtgaagttaaattccctaatactcaaccattggtttcaaatggacggattagatagggagatctcacgcggtgatattaatcctacgaaaagtcagaggatatgaatccgctggacacaaccacttgctaatctatgcatcaccaacagtcttgttgattggcatgttcgtccacagtccagtggcaaacgcatgatttta

SEQ ID NO: 53356 - DNA, 1501 bp, Oryza sativa
ggcagcagcagtgtcagacgcctccttggcgaccttctccttcagcgacgctgccacctgatggtccacgagcggcccgatgatatcagtcagaggaagagcctatgtttcatgaagtcataatgcgatcccggaagaaaaatgcaaaaggaccgctaagtacacttacattgatggcagcgtcacgctcggctgcccctttctcgcaaagggggacggggacgttgctcgccgttgtcgggccgctgatcatcagttggctgacgcggcgctccacggttgcactattcaagcctgtagatcgagaacagaatccgataagccgggaagaacatgcgcataagggagtcaatttaactaaaaaggaaatacctcgaggagaaacccgggtcgcgtcctctggcccataataatcaaaggcaggaagggctcgagcctgaagcggctggatccgcctaccaatgaaatcggcagcaacttcataccccgacaacccccgttctcggaggtcgtcaacgatatcgatgaaagattggagggacggggtcaaggcaggtttggtggtccaagatggaaccttgtctggctgctcctcaggaacaacgaaggcaggatccgaatcctctacctgaagatagaaccacctcccccgccatttgctgcgagatgaggggcactgaaaggggatgtatcgtgacttcaggccatcccgaagtcggaaaccaacacacccggacacctttttggattccatccagcgtaactcatagtaaaagcggaagaggtcaagaaacggctctaccccaatgtaggcctcacaaaggtgaaaaatactcaggaaggcgatggagttggggttcaaatggagcaaggaaagaccatagaaatttaagaccaaaaggagaaattcagaaggcggaggaagaaaaccgcagagaataaagtcctcaaccgcaaccatgcgacccaggacaggctggggttcagtacctcctacttccctctccgcggtcccgcgactgggaagggcgccatcctcctgcagtttcttcagtgacacactggtggaggtagacttgtcaagatccatggccaccggagatcgccggagaaaggaccgagatgagttggctagggtttttgcgggagcgaagaagacgagggacgcttggaagctggagagttttttcaacgggcagacctcaaattggatccccaaaactcccttaaatagacgcacctccgccggtgcgaatttctgggtccgttacgcgtggcagtttttcggacttcaatttaaattcactcatgaccgttgaacttcactcgatgttgtcgatcactccttgtctctccgtcctcacaccgagaacaacgacaatttcgacatgtgaagtcgcgatcagtttcaccagttcatttaagcagaagtcggggggctactgtcagggttacgagtaaggtataccctctacccttcgatatacgtcacatatcgata

SEQ ID NO: 53357 - DNA, 964 bp, Oryza sativa
cctttcctctctgaccaactattgtacatagtgcataaaaggagaaatccaataaaatataatacatgtgcaacccaacatcaggatggcctcaattcattcattgtgccttgtttatatcatctaactcatcatatccctcaattattaacatccatcattgcaaaaaatacacccatgtaaaaaaatttactgcactcctagcactgcaatcaacatacatgtgtactgcattttgttctataaatggtgcttcttgttgtagaaattgttgtagcatgtccactttgtcagttgtgtgcttcaaaatctttggtgttggcattttcagaaaataaacatgaagcaccatggccatgtgtagatataagcaaaataagggcaacaaatgattaaagatagttgtggtttgtagagtataaaggatttaaggtggggatttctaccagatcatttgaagtgtgcatctcgatttcctgagtttgttgcctggttaaaacaacaacaattaggcatgacattcatgacttgttccactttgtttattatatactttaagcccacctgtaagatctgcaacaaatgaaagcagtcactatacaacaataattaaattctgtagaacagagataacatatctcagaaaaatatagtattgtagtgccagctaattaagatgagttaattaggatgttgatggtactaataacaacgtacatggtgatgtctaagttgattctctaatgttttcatgaccaaaggctggcagtgttgtattggcaccgaaagttcttgctcttagttttgtaccattcttaggcattccaatatcttgccagttatttatctgcacaaaaggggaaagcatacaagaaaatgcagatagagaacatcaaaacgtgcacttatgctcaagaaaattatcacagaacctcatctactcacagaattagtttcacattta

SEQ ID NO: 53358 - DNA, 1501 bp, Oryza sativa
agcaagattaaataaaacaatattgtaaaacttttgctggtaaaatgagccattagtacagtaatagatgtacagtactaataacactggaataaatttttgaacgagaaccattaaaacagattatgaagtgcatgtgctattagtttggtttaattaaaagagaaagggaggagaacagttctatttttccaacatttttagagggcttctatgggtaaccatttggcataacctagggtcaaggaagctctgataccaacttgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaaggataccaaaagatggcataatagggttttattttgcaaaagcagcatttagtaaacatttgagaatttaataaaacagtgaagtattaaacaatattaaaccaacgctatacaacataccctgttgtataggcccaaccattctgaacaaccattcccggctgaacagatctaatctccaaaccaggaattaaccattccaaaccaggagctaaacaaattataaccaaataaagcatcatttactatggtgagaaatgtgagactaatcacgaaaaacattgttagacccgcccataaccgcgggcacggctattcgaatagttttactctgatcagaggtgtaccactgtacccacaagacacagccccacatcatgtcaccatgtgccttagtaccaccacggtacctcggaaaggagctgtgacattaccttgctggccttggaactcttcaaactcttctccggcgaaaacgaactctccgaaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaatcggattaaaacacttaaaccggttttaattgaattatgacgcaataaagaattatttttgaaaaggaaaaggggatttattgcgtcagcggctagggtttgcggtggaccgagcgcacaggcggcggttcatgcgaacggacggccgagatcgatccatccaaaacggacggccgagatcgatcgggtccacgacggctcacggcggacggccccga

SEQ ID NO: 53359 - DNA, 1501 bp, Oryza sativa
acaacaacaggaggtctggtgacatcgaatcacaaaacaatttcttcttcttctctctctctcttttgaaaattcacaacaatttcttcaatattgaatactcctactactactcctactgcattgcagtgaattttagtatattcagatcaagaagcacactttcagggagaaagaagaagacaaatgctgtttcctctttatggcaattgcgtgcactgatttccctcctaaattttaagcgatccgtatggaatcagaatgtttggcttgggcaaaagtgaagccgggctggcttttatcatgccagtgggtgactttggggccctttcctcatcattcctggaacatatgtgaaggctggctaccaaagacccacacaaacgcacagcacaggcattctttgtctgcatggctgccttgcgctgtgcttctttgaccaaactccaagccaaaaacaaacgcacacagcacactagtgtataatactagtagtaataccttgacaaagcacaagtgtttattacatgcatgccttgttcatccggttgatcagaggtgaagcgcgattaactaatgcacgtatcaaccgccgctaatacgtgccaatcttgctctttttgagctttctagaacacgtccaagttgagcattgtttcagtgaagcagtgtgctaaattgaatagcagtactccggttaagataattaataggcgggcttgattcgttcgttcgctcgcgggctttgctcgcatttgcgacacaagcagtgcagcccagctaagctagctgttactgttgcgaagtgactggctccttgtacagttgtcctgccgtttcaatctctgttagatacactctccccttgtctctctctctctctctctctttctctctccaatgtccatgaagtctgtggcaaaagcagccttctttcagccactctgggcagcatccagctacatcgtctaggcagcagtagcatatggtggaacagagagaggaagtcctggccatcctgtccaatggcaacttcacaattaaattcttgcatctttatgggggtgcttgtttgtgcttgtgtgctttgaacagcatggtgcttaattgcctcgataagaaaaggagagggggttaagcagctaggagtaccagtggtgttcgtggcttcatgtcatgcaagagagctcagctcacagatccctatggagtggatagctatcgtgggagaggccaagaacaaactgctctagattttgtatcgtatcctcgcgttgcattacggctactactgctgctgctgctacttatccaccgcttttttgctttggccctctcattccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtg

SEQ ID NO: 53360 - DNA, 435 bp, Oryza sativa
tttcatgttgcaaaaccttttatcctatgccttctttttgctcaattggcctaacaaccaagggataaatagaaattgccacaggatcttcttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcaga

SEQ ID NO: 53361 - DNA, 1501 bp, Oryza sativa
gctggaccttagaaggtggcgtcttcatggcgctgagaaagaccttgcagctcgagaggttgtgattctttgtcttgtgaattggacaatagacatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacgatttcgccgacctgagtccacaccagtgttgttgaagtaggaactccttggttgaggttggtgttgacactgttgtcgacaaagctggatgtcatagtagtagaaccttgagcaccaagtccacctacctggcacgccactgtcgacggggaatacccgtagaccggatatagagggtattggggtacgctggtacgaggatctacgtagtacgacatcaagcaaacaggaaacagagattatactggttcaggccccttggtaggtaatagccctaatccagttgatatgggattatatgatgaaaaccacagattacaaagggaacagtggaactcgacgataccgacaagatcgtagtcgagttgatccgactagatctcccggcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggcca

SEQ ID NO: 53362 - DNA, 1501 bp, Oryza sativa
tgttacctctagcctcacatccaccccagtgaatacgcaatctgagtctttgtgttggagatttcgtttaattacaaattaaaaagagaggactaaggtttagtctgtaacattaattaccacacttgaaacgacgccttacatctaggcactgccactgaaaggtgggttcccttttctcctcttatgcaagaattgttgaacatgttaagaataagactttgaaactaaaaacttgtaagttgggtttatcagaaaaaaatggtgaagaagggtattaatccagtagtacaaaatttaagagggtttaaggctttaagcaaagatggatctggttcattaattaatcattaaccttattctgggctggcccatacagtggatgacaatagcatctgttctttggtttggtcttcattttacagtaccacctgcaatttatcttaattcagagaattttattctgattcatggatgtgatccagctggtgcatggttgttagcagtaccgacaattctattccaggactgtggtttccacctttgcccttgcgtttgtctattgcattaggcttacttaacttttcactttggacaatctttatgtaaggctgcaagggttagttgttccttgttgagccttgcaagaaattgactgccacagctcccgatctaccctaccctttaagtaaagcccattcacttgtcaaagctgacaatttagaaggccatcacgcatttcttaaaatgattgcaatatcaccctgagatcaagtatcaggcacaaggttggtggcttgtttaatttcttcatatgtatgttcttgggagttgggaactagcatctatctaatctagtacacactagatgacttatctcagagagttgtgatataatggtcatcatgtgattgatcatcgtttcttctgcagatgtattcccctccctgcagtgctgctgcaagcagccaagggcattgtttcgcggtcggagctaaccagcttgcttcgcttgaccttgccatggacttcgacgagcctatcctttttcctgtgcataatgcaagtttgcaagaggggattcagttttacaatcctaccggcggtatgtctctctcgttacctatgttctattttcaaggataaccacagtatcctcctctctttttttttttcaattagataaccacagtttcttaatttgtgaagttcctaactattacagtttccgtgttccaactccccagatactcagctaagtagaaacatgagcattgacaagtgtttgaagggcagtaaaaggaagggctcaggcgagggcagttcatcgctacattcccaagtaacaagttaattagaagctctctttgcttagcttcatcgggtgggagcacgtttcatcgtgaaaatcgtactactgcaggaggaaaccggtgaaatgcctcagagagaactcagcatggagcatgccggagagaaggcgggtgatgctgacgctagc

SEQ ID NO: 53363 - DNA, 729 bp, Oryza sativa
tccacaactccactccagactcaactcttgaagcaatatttaggagttggagctgtaccaaacatgccttcaggagttggagctgtaccaaacatgcccgtaatagtgttaaattaaacggctaatatcattatttgtaagttttatatgaaaaattagtcgggattagtccctaagcctcacaagcaccgtctattataagaaaagaattaagaggagcagtaggacaactatttcttctatcaccaattttaaaacctaagagagggctccatcgatctctaaaaccggtgatctcgaagccaaacataagtgcataaacactagtccataaagaaagaaaccgggagaagattgaagtggcttcagtggcatctcaaaacggttatagatcaaatttcacataagcaagaagtgatcatgttaggctaagattcaatttatataattagagacaacattgtggtatcagagcagaaacttagccattatgttcccatcattccgtttagatgccatatatgcctatgtcttgatgtaaattatcagtaaatgaagcaattagcttcggattaactcaggaaaaggagtttcgggataaagcaaaattttccagcaattcaattcagcaagtttgggaagattgggataaactagaatgaaattcccaagttttcccaaactcgtgaacctacgaccgaaaatccccaagttttcaaatggaacttg

SEQ ID NO: 53364 - DNA, 1501 bp, Oryza sativa
gctctcggtgtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctcgatcccctctaaaatcatccaaaaaaaatccctcctctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcgaccctcggggccgagacgggagcggtccgacccctcggggagacaaagagaagggcggccgtatcaccctcgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtccaaaaatcgggacaagccggttcgtttttcctagagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatca

SEQ ID NO: 53365 - DNA, 1501 bp, Oryza sativa
aaaagaaaaacacattatatgttgtgtacaactttataaaagtgcaacgcctagtattggaattgatttcctaaacctcccctgcttaatctcagtagttttcccgcaaaaaagaaacattaagcttaatattttgtatacctatttgtttattacttcctccgtttcataatgtaagtcattctagcattgcacacattcatatagatgttaatgaatctaaacatatatatgtgtctagattcattaatatctatataaatgtggataatgagtcttacattacgaaacggagggagtatgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggtcgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgttgcgcctgcttccggcggaagtggaggtaggtatgggccgtcccatcagaaggtcattcggacggcaaccatacaagtctccgtctgtttatgaaaagataggataagtccccccaaaaaagagagagatggtgcatgtggtatccccttgaggtataaaaggaggaccttgcccacttagaggagggattttttttggatgattttagaggggatcgagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacaccgagagcttagaatctcacccagggcccccggccgaaccggaaaaggggggcctgcacggtctcccggtgaggagccccacgctccgtcatctggcgcgccaggtagggggttctgcgtgtgttcttctaagctctcgcactctttcgtgtgcgccaagcttttcctgttcagcccaa

SEQ ID NO: 53366 - DNA, 412 bp, Oryza sativa
acatcatggcatcccttgtgttttgtgaataaaaattcattgtttgatatgtctcctttgttatttactttacttttctatttgttgtttcagtcaaaatggaaggatttgctaactgaccttatgctagtgcctgctgggtaggactcgatagtcaacattatgttctctttcattcatttacagtttgccaaatgcctggtttcaaagagtgctagcattgtggtacattttgatttatgttatgtttacctgaatatttccaaattgaatgcagactaaatcctgagaggttgggtggtgacttcaaacaagaaattcaagttagtcatctatatctttattcacttgcttctgtatttcacctcactttatgctatctggtatccaacttcttgacatattacatttc

SEQ ID NO: 53367 - DNA, 1501 bp, Oryza sativa
cttcacaatgttctgttgaactcataataccgatgtaagttgaagaggataaatgattcttgaataaacaaatgattttgctcaaattgcaattgaaatcaggtgtattaaatccctgcagatgaaaggagaaaagcaacttgtggaaaaactacttcagacagaaataaatttgctccgatcaatcagggatggttcagctcttatgcagcacatggaagacttttactacgtcacactgctagaggtttcttaccttgcttatttttattttcaaacacacagtttgtattaaagaggaagaaaggggcagaaccatgagcacacaaacaaacctgcacacttaccttgcctaattacttgtccttgataaatattctgtttttcacatcatctctgcttttcatttcacttgttatatatcgaaagcttcctccaagtaaatttaaccaacaaaatacacttaaacttttgcagagagtgaggtcaaggtaccaaacaggtgacggtgcaaatgaagactaccatcagttaaccgcctgatcttagtacatgcttgaaactcccaaacctgggttgcctgtaagtaccactcttctaagcgcacacagcttgtacttgtcttatggatatatttggagttgttggacggtactgtagtttaggggataattcggacaaagaagaaagtttttttgggggtgtttgaggggggattggagtttgccctactgttatatgcgtaaacaaataggcggtgcttgcccaacattcttttactagcaacctagcaattatccaaaaacttcagtggcactagtgcattacccttacttggtgattggtgatcgccacaaagttggttaaccccaaaatcatttgttctgactctgtgtctgatgtccgttttgagttttcagggctactgccgttcagcttctttggctgatagatatcaagaaacattgcaaacaatggaacctgtgcaggaccagtttaggggttatggtcgaactcggaagtaagaggacgcattgcccttggtagtcagtttgtatgataaagcttcaagtaatcaggacagttatctgaggatcctcatctgcgcaaattgcaaatggacttagaatgcaaagaccttcattccccggccgtaagtggtgtgattgacacgcacatccttcctcgtgtgtggtaaattcgtgtaatcaaacataaggcttggaaaatgcccttttatcctcaagtgctttgaactgtaaattatataagctctatgatccttaggctaagcagttagtaaacgtggcaaaaaaaagtgtggaggtataccaaaagatgtaccaaaaagggtgaaataaggggaataaatgcatattttgggtcactgttttggaatcttgatcaacaaaaggatttgttcagttgtttcatctgggccaatatgcacgcaagtctcaaacgaggacaacacacaattttcaaggtacaagagcaaata

SEQ ID NO: 53368 - DNA, 1501 bp, Oryza sativa
actttagttgattattgccagtttcgttctagccaagaaagtcgagactttcattaaatttttaccctaaaagtctataaaattatatatatgcctactatcattcacctctttttttcaattatgaaaattgacccctcctagatctaattaaataggagtggacgttcggtcaggaccgaaagttcggtccgatttgtttaatattttaaaagttcggtctttcaaatctacaaaccgaatttatgtgaccggaggttcggttaaccaaaacttcccaatccgttgtttctatataatttaacatatatttattcatgtattccatagcaaaaggcacagtattgcggggctgtctggttcccagccattacttgccaataaaaattgccacacgttgtctaaggtgaggtgatcaaattcttagtcataacttactaagccacacttttttgagtcgttgacatgtgggacccaatttattagaagggaattttgtcacaactgtggctacaaacaaacacctattaaatttgcctaaccttaggtgtgacaagctgtggcaaagtgtggtttgcaaccaaacacaccctatctacaactcatactcattacacatgttttactcaatggaaggatggattaatgtgacatgtttcttgagctcctagacggtatgatttttgaaaaaaaaacttttgatatttgattttatttaaaaaatattttagttcattcgtttgtatcgttaaatagtcatcacgaaattattcaaaaaaaatataactttagtgattgctgacatgtgcattgcgtatgctatttatgcacttggtgagcgcctatcaactttctatccttttcttggtccttataagatgttgctatcactaagaatcatgatcaggaaattaaactacatgaatgctacatgaagaagtactagtaccaggaagttaaagaaaaaacgtgaatataaaatcaaaactcttatagatgtacaattgaaatcactttagctgattaatgccagtttctttctagccaaataaaaagtcaaaaattccattaatttttcaatctaaaagtctgtaaaacattactaaccgatgtaacccgtaggccgtatatcacgtcgtaccgtattgcccattactattaataaaaacgattatctaataatgtgatttagtaagataagtaacactccgtattaacaaaagacaaatctgacgagcagacaaatcatattgctaattgctgaatcaagagaaaaaaatataccaggtatgaaaatagtgaaaataaaccaaaagcagatacttagtttcgattttgatatatagttgtcgataaatttcctccaaaaaaattatcaaatgtaaatacaatagaattataatgtaattttattgcaactacaatgcaacttgtatgtaactttaacataattttaaaattttagatttacttcaagatttgtgcaagtttggaaaaaaat

SEQ ID NO: 53369 - DNA, 383 bp, Oryza sativa
tcctgcagccctgtcaaattgcaagacgcatgacaattaattataggaatattctgttggatatctttgcatggaagtagagtgctacttaaataatactgtcaacaaaaagaaaatcacaagtcggttagctctcctcaagaacatacgacttccaagctccaagtgctaacccatattagtattttcttaaagctatttgtacttgcatgtttacatatttcccttcgaacatggtcaaacagggcctgaaatttttgattattttttttaaaaaaattgttgattattaaaaggtgaactaggtagcaccgtaatgtgtatatataaacgattataacgtagtttggtaagtactccctccgtcccacaatataagggat

SEQ ID NO: 53370 - DNA, 1501 bp, Oryza sativa
aaaaaatcctccgtaaaaatgatgatttttatggaccttttattagaagaggtcgtccgaaccgtgcctctcagtcgattaatcgattttagccgcctgtttaaaaaccgttttttatagtgaaccttaactaacgcgtgcgctcatacaaacacagctacgacatacctaactgctctagaacgcaggtatacgtgccccgccattagcaagtcacacgaatagtataagcaacctaggtctctttcttttctccgataagagttagataaagattaagattttcgtgccgcgcttttcaactgtgaaaactttctatatgaaagttgctctaaaatataatattaatctattttttaagtttgtaataattaaaactcaatcaatcatacgttaataccatctcattttacgtaaaaaaatttaatctttcatcttcagaagaaaagaacaccaccgtagccatccatttcgccatatatagattgctctttcatttcccgatcggttgattaatttcgcatgcgtcgccttttgaaatactatgcaaattatggatgcatgtttgcaattgggccggcacgagttaagaagaaaaatgggcaaactagtactggtgcatacacagtgggtttgagaatgacatggacgcttctaatatttccgggccctttttacacatgggcgcccacgtggccttccaaacgcgctcaatccaatcatccaaaccgaaaaataaaaaacccaaacttttttatgcagtagtagtaattttcagaagaaagaatgaaaataaaggaaaaaggctagcagaattggcttggctcgtcaaacctttggagtgcgtccgcgtgtgcgagctgcgcccgtgtgatgtgggcgggtgggtgttcgtgtctccgcttgtctccccgcggcgccctcctcaaatattctcaactccccaaccaattcattcccccgagctgagctgagctctcattccttccttctcctttccgccggcctcgcctctcgtctcctcctctcccctaccgatacgcacgctcgcttgcttgcacctcgcgcgcgagagacgagagagagacggcgagccctggcacgcacgagaagcgaatcgaagtggcggcgacaggagcagctgctgctggtggattatccgtcgtcaacatggctcaggaggacgtcggtcacctgagcgacgccggcctggcgctgggcctgtccctcggcgggggaggaggagggacgaccgacgcggcggcggcgcaccgtggcggctgccggcggccgtcgccgtcgtcgcagtgcccgccgctggagccgtcgctgaccctgagcttgcccgacgacgcggcggccggcgcggccgcgaccgcaaccgcgaccgcgtccggcgggggcggccctgcgcacaacgtgtcgtcgctgtccgtcggcgcggcggcggcggcggccgtgaagagggagcgcgcggagaaggccgacggcgagagggtgt

SEQ ID NO: 53371 - DNA, 1501 bp, Oryza sativa
cgatcctattcatctcgaacgatctttgtagcgtcctgcccaatttgcaccttaaatatttcccctggaatctcaatcatgccaacgtttggcttattttgtttggaggatgtatggacactgagaaatggggaataaatatggaaagggataggcttaatacagaagaaagggaaatgaccaaagactatggcaaaagcaggaaagctgggaagcatcagctggtccaaagcagagcaggtctggctaccattttctccaaaacttccatgttacaactgaaagaccagatcagcaccaaaatttggtgcaacaagcagcatctgagagggtgacactctgacagggaggttcctctgcaacagagctataacatgagaaaagtgcttcttgatcttcagagaatcacacagcagtgagtaataagcattggcatagtcagaggcaacttcaagccttcaagccaagaatatacttgaattccgacaataggtcagggaaattacaatttacaaggataagcacactggcaaaaggtaatagaagtactaaagcttctgacccaatgtgtcacctattgatttacctaactatccaggagtcaagtcaagtctgaacagctaatgagctagtcactctccatttctccagcaaagcatacctataactttcagtgctccccggatggatcttggttcatgcaaaatgctaggaccggctgaaatcttcagactttcagataagctggctaaccaatttcagactacaagcatagcataggggtgatagggtcagagtaatgcgaggtagctttcactgctgaagctgaatgagcaagtcactcttcaacaaagcatacctacaattttcagtactaccaggatgtatcttggttcaggcaaatgctaggaccagctgaaatcttcagaattccagacaagttggccaaccaaattcagactacaagcagtgcatagaaggtgataggctaactgtaatgtgagatagctttcactgctgaaactatcaatctagaaaaagcaccgacctagtgaaagaaaattcaaggtaaacagttcacttagaaatttcaaattctggtcactggccagtgatatagaaatttcaaattctggtcactggccagtgatattaaaaaggtaaacatgcttctgaaacttactgctcctactaccttttcccagaatgtgacgttgttactgtcaagtatagaaatccttgtccatgtattaaaacttggagaaagcagcatggtttgactcaagattacaagtctgctctgtcttgtccaattcaaagattggaaaggagatatacagttcatgcagaaaaaatttctccagacaggcacattgaccatgtgtagctgacaaccaccactcaaagctgtcttgaatcccacaggtaaaacctactctactaaagtacgtaccaagcttttgacacaatgtgccacaacaccaagttgtccaagacttca

SEQ ID NO: 53372 - DNA, 1501 bp, Oryza sativa
tgcattagagtaaatgtttcaattggtaattgaatttgttgcacatatttaagtttttacgttgcattagagtaaatctttcgccgccgcagtacccttatgctaaaccaatgcgaacaactaaacacctacacatgtatcctcttgtctagactaaacagtctttgtgcatccaaccaaacaaaatcttcatatagtatcttttgtgaaattaatcaaacaaaatcttatagtagctaggctaaaccaatacgaacaaccaaatgcatgcacgtgtatccagcggcggagatagctcccgggcaggtcgggcggtctcctgggctccaccgctgccgtttcaattgccgtagcagtcggtcactaacaaacgttactaatcgcctaggctttacggcggtgttggctccgtcactgcgtgtatcttttgtccggtctaaacccaacctagatgagagaaatgggctagactagaaggatataagcaaccaaacacattctaaatcggtgcgaagtactggtaatactgtagtagggaccatagtgcaaatatgatcctatttagatgggccgcatactgcactgacactggataacaagtgtgggcttttacatggtccacaattcgccaggacgtacgggatttactgcagcgctctgcaccctcaccccgtctgtccacggacgactaatctgagcgagatcaaatcctctgcagctcagttaatttatctaaccaccacccaaaaccgatccacacaaaagcaaaaaaacccatgctacttgtcacgttgccgtctcatctcaccaccagcatcaacacaaaaaattactcctactacttcacctgaccaccaacagggtcactgtcgcgtttgctcgatactagcaatcctcccccgttgtcgccgccccaccaccactcacctgaatctatggtcatgtgtggcctaacccaaacccgtctcttcctgcaagcagctaccgacaacgatggcttcaacggcgacgcactgaatcgagacggccgtgcgtgtgcgcgcatagtttttttttttttttttttgtcgttccatcggttggcgtccgcagaacacgtttcccaaatcttgtactactacgtactactccatcgacgctcgccaatgcgaaaaaagattgcaatttgagtagcagcacggctgtggacagcagcggatgtgaggcgggtaggcacggaggaaaatggcagtcgacctcgtcgcctacaaatacccgctcgctctcttcctcctccccttccttccactcgtctcgccattaacaagaattctttttttccttcccccaaatccttctcgagcaacagctaggggggagtggttcgcttcgtaagaagccggctacctctgctcgatcccgcctttgcctgcggattcccaccctgattttcgccgtttgtttgtttagtttcttggggcaaattcgagacgaggggaggagagtttttttgggggggagt

SEQ ID NO: 53373 - DNA, 516 bp, Oryza sativa
atctgttagtagtttcttttaagagaatttgtcgaggaatatataggtagttttttttttccctttgagaggaactttggagaagatgtacatatatgtcacgaccacggtccacgggtactgctgacggcccaaagtgttggcccggcccatctctgctcgcttgcgacgccagagcccaccgattgcctcacgggctcacgcccgtcctgctcacgcggcagagggaggcgaattcgcaatcggaatttggattggaagcaggcgacaacaaatcgagggggacaggggcgtagataatttcgaaccgaaaaaaggagaaaaagacgggaaaaaaaaaacagacgaaccagcgagagagagatgcaacgagcttgaggcgatctcgaccgccaccatccatccatcctccgcgagaccgcgacccgccgtcgcctccagatcgtgctccgcccaggtacgcggtttcattttttttttaaatatattttcttcggttagttgttgcggcctcgc

SEQ ID NO: 53374 - DNA, 1501 bp, Oryza sativa
aagccattctaatatttctcatatttatatctagatttattaacatcaatacgaatgtgagaaatgctaaaaagacttatattgtgaaacgggagagcaataaaacttatataaatgaaaacggaaattgttttggtgttgtatcgtccatttatttcgtattccaccttatttttataatatggtaagtacaatattattaaaccccctttatctacataatatatactctctccgtttcatcatttatataatgtgaaaaatgttaaaatgacttagattctatttgatccatagtttagaggcacattaactcttcaaccaaattctttaacttgagtgcatatagtaatgtagagaatattttttatcagtctgcaatcgacgtcgatatgtttatgttcatttttttcataatttttttaaactgttttttttcttgttttgctgtttttattatgtttagagtgtccgaccacttcttttctcggggcattgccaattcaagatcaaaatatcttccgcacatgttgaaaacatctctgctcgtattattgggttcagtgcattttctggcaagtcaggtgcttcacgcatgcgtggctggcgtgcatatctctctatacctgcacacaggaatatcaacatactcacgcggcacacatgtgcgtgtctcacgccaaagccatccattggtattctcgcgaattagacgtgacactgataatctgatctccagtaacaaaacgtacgttgatcggacactacacagtacacacacgtcgaccgactgattttgtaggcatttcgagagtcggtttccgatcccgggacttcttttggtttggattagttctacacaaatctgacgacatccgatccgatccccacaatgtttggattagagccaccattttctaatgtgtagttcttacgactaattcagccgaactgcccaaacgggtacgtacgtacttcacccccaagtcttcatatgtttctgcggtttcttcttgatgaagaccacacgacgctaatttcaaacggtttcccccaaaatttgcgatgccttttttcactagcgaaatgatgatgcgtgcaagcgatccacgtacaacctgtcacgaggaggcgagcagagcagaaaaagagaaagcgaactgctactccagcaaagccgatcacgtgaggtgttacaagtgggtggtctctgtatttccggaactgacttgaccgtcacgaagcacatcaatccgtggaggagtacaaacaaaagttgccgaatgccaagtcgaacacaggtcgagcacggcgcacacaaacacacgaacttccgtccgtactaaaatataaatatttttatactttaacatgatctcagagatactaatttaattaataatatatataaaagtaagatgttttaaataaaaaaagagttacacattatgatagattgtttaataataaatctaataacatcaattttatataattaatt

SEQ ID NO: 53375 - DNA, 370 bp, Oryza sativa
caggctagcttgagttgcagcatgggggcgagccagtgtgcctggggtgaacacgcaaagtacgtgagagctggcgtgtgtcgctagctgtgttagcggtgtgcgcacacctggagctctcccgttctctcttccgtgcttcgtcgatgtatgaagtatgaacgggagacgcatcggattggattgacggatgggggatatgtgcacgtgtcacgtcgttatcgatcgatcggatcgcggacgcaacgcgaaaggagaaaacggtggccgtctctaccattttgccacatgcgtgaaactaacagtagtgatgcggggaccgcaccagagttatcggccggctagcttgcgcgacgcgacgtcgcgagga

SEQ ID NO: 53376 - DNA, 1501 bp, Oryza sativa
aaaagcacccggacggaagccccattcaattcgatcggccggacaaacaatggcaacgaactcactccgccattaactccgtttcacctttttacggagagaagagcaagttcttctgctgctgcaatgctgtgtgcgccttccttgccgatgcgccatggatggatggatgattggctgcttgattggggcagttattgcaggccaactgctctgtcgaaagagtgtccctcggaaagtggctttagaagttggagtaaaccttgcagtgcatggcatacatacagcatggagtggtattaccttggttacgaacgcccatcaagtccatttctggagtagtacacactgtccaagcttcagtgtttgtacctggaaagaaatgcacattagccatatgcgcaaggcaaggcaaggcattgagcaaagttagattcatcagttactagtttagctagttagcacatacacactactggacaatgactagcgagtgagcttagctagctgatcggcgacaagtgacaaccagctagttagcaataagagctggtgatggttagctcatctcagttcatccttaggttttcctccagtgaaggccataaatgaggtcgccaagggcgtaggtgggggagtttattaccggcgtactggcagagaaggtggttatgccgctcgccacagttcaccgacagcccaccccagcagcccatgagggccccccatcctctttccatctatctctctcttccactaatctcaccaaagagtcttcttcacttccttctctaggcttattaacagcttatttctgatctctcacatgttcagttttatctcatccctcctgctagatattactgttgctggccccaaccaccctgcatggattacaacacaagtttatcagtaccactgtggttcaaagtagtgtatgtactggactcgtggagttatgaccacaaggaaattgaccagaaagttaattacaatgactgaaggtgtgtactcacttggtcctggcagagtagaaggagagtacaccaactagatctgaaccctggtgtgctactgtaccaaaaggctaaggccactgacagaggagatacgtgacagacaagtcccagttgagttactgtccaacccccaaatctaaccctcttctaccaccacccccactcgtgcgccacagcgctctcacacgcgcgccacactcatgccatgtatgtctatatatatgtgcatctatatatcttagccacattgaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgg

SEQ ID NO: 53377 - DNA, 307 bp, Oryza sativa
ggccggccccccctccccccccccccccccccaaaaaaaaaaaaaaaaaccccaatcccccttcccccgcttgtgatttgtgaagcgaaagcgaacggagcacataaacacaattatatcctcccccgcgaatattcccatcgtctccttcctcctctcccccgcatatcctccgcctccctttcccccctctcctcctcaaccctatttcaccaccacctccaccgctgccgcggcgagaattcgatcggttcttggcagccgtagtgcagttttgtgcagttttcttctctcttgttgttgagga

SEQ ID NO: 53378 - DNA, 894 bp, Oryza sativa
cctccattgtcacaccccaatcgggcaccgccgtacaacgacacctgataggagcgtgtcgtaggaaaaacggcgcgaaccgcttcctacgaaaccgcgatcacagtaccagtcccaggacatagcgctggtacccacggtgacaaatatgaatcattgcaattcttaaattaaatagaggacttatttactttaacttaggttgcagctcaggacagcccgagaatacaaccgatgacgcggacgaggaaacaccaacaacaacagcagcagcggaaccaacgaactaacacccaacaccacaggcaacgattaggaaccaagacgaaaccctaatcttcgcttcacttcatcttctcttcaaggcggaggaaccatatatatatatatatatatatatatatatatatatatatatatatatatatatatatatatatatatatatagagagagagagagagagagagcaagggtgagtactttcgtactcagcaagccatgggaattaagtgtttaatgcaggcttcaagggaaggctgttgtttttgcaattgattttatttaaactccttttaaaacaactaaatgagtacttctcaaacgacacggatgagacagtgcgtctcgtccagtctgagtatgtgcaatgtatcagtctttgaattgattcaaggttggcacccggcaacagctttcaaacggccacccgagcctagctgatcccatcagccacagattttccaaacatcgatcccatttcacaacagcaatttcacaaaacagtagtcaaacaaaactacgctaggaatcacttcacatccgcccatgaccgtgggcacggctattcgaacagtttgttaacttctgcagatggggtacactttacccaca

SEQ ID NO: 53379 - DNA, 1501 bp, Oryza sativa
aatcaccctacctattcaataaaaataaatcctaatactacttagactaaataagtacttattaactaatttaataagctagaaacttaatttattttccgttgtaacgcacgagctctaggcttgtattgaaataaatacagttgcatatcttgtgccaacaaaaaaaaaaactgcagatcttattttgtctagagaggatctaaactgtaagatggtacactcatgcacagctaataagtataaatcaaattaggcttaattaacttttattctctctatcttataatataagacgtgcacacatttcaatattcaactttaaaaacatttgaccaataattattataatataaattaaattttatttgttaaaattaaattattggattaacatttaaatttactttaagatgattataattttgttgcaacaaaccttatatatgagaaattttaagttaaaaattagttttgaagattgtactaagtttgacaatagcttatattttgggatgaagggagtaggtcctacctactactccatttcaaataatgcaagcggttagagagagatttcttcctcttgagttaaacccgggagctgtaacgtcaaacgtgcacgcctgccactgcactaacctttgcattcataagcttgtacacatatatttcgttgctcttgcactgatatatggacgtcatctttaaattaaaccatcacgctgaagtttagaccgcatttttttaagaaaaagaatttcactggaaaaattaattaatatagcgacttctacaagatatccagtttaatccactaattacgaatacggaaaattcccagcttcgaaaccaagcttttaattgtagtttcagcattttccaacgatcaatgtacgttgctttccagttttgtgtgggtgaagctagctagtgggtaacattgaagaaagatacatgtggccacgctttcaaattcactgcgtgacggcaccggaaagctccatccccctcaacccatgttattattcagctatccactgaaaaaaaaaaatcttactccctccgtttgacaatataaatcattatagcattttctatatttatattatttgtctagattcattaacatcaatataaatgtggaaaatgttataatgacttgtattgtgaaatgaaaaaaatattagtttcgcaactttttaaagtgaagaacgacagaagaatatcacaagtgatcttaatgttttctcacttcaagtgtaaatagaaagcatcaaatacctttgtaagtaaaatttcaaatagattcttacgaaattggtgtgtttggagcatgtaaactatagcggactagcggtgttaagcctctataagcaaaaggttttttttttttattttcaaagcacactactatagtcgtagtctcgtagattctcatatatacatgcatatatgcgcgcccatccctacccgctgttgacaagtatatacgtcgtat

SEQ ID NO: 53380 - DNA, 202 bp, Oryza sativa
cctccattgtcacaccccaatcgggcaccgccgtacaacgacacctgataggagcgtgtcgtaggaaaaacggcgcgaaccgcttcctacgaaaccgcgatcacagtaccagtcccaggacatagcgctggtacccacggtgacaaatatgaatcattgcaattcttaaattaaatagaggacttatttactttaacttagg

SEQ ID NO: 53381 - DNA, 1501 bp, Oryza sativa
gttcggcgacctcagggcagggagggtgtgctaccggaggggcggcccggtgcagggcggcatgatggagaggatcccgtgtggagtttgccccaggatcgatgagtgctcgccggatggcgttatctcgccgagcacctgcgtctactacaagaagtggctgcagatggacttctaggtggtgagctctcttccgcgccgctgtttatggtgcgatcgcacgcacaattcagcttccaattgctcaattggcatttgatctatgctatggaattgccacagttcatacattgcggcatgtgatcccggataggcccatgagatagacatactagatgatatcatctgattatcttatgtttgtatttaaattagtaagatttgtttctataatcattattacttagccttttcccctgttagtctttctcatgtatttatctgcaacaagtttagaaacctgtccaacatcaatattccaaattctagggtgcgtgagagtttcatccattgttactcaatcataatatgggacctgagcacaataaagcaattgcttctttacaagcatgatctaaagcattctgctattaacaaaaagaatgatcaacatcggtgaattgaggcttagtttgtcgcgatgtaaagtttcgccattatatgaaatctgaaaaccctgatggctttaatgaatagtaacctgcacatgcaaatcttattgtatctgtgtttcccaacgtggtttggactaagcattaaataatgttaatctgtcacaactcacaggtttgttgtacatacatttgtaagtgtgttgtcccagtagttatactggttgtgaacatatagatattgtttctctgaaaccatagtgcattctccagtcctgtttgtccaccacatttaccacacagactgattttggacgaacctataattgtttaatcatgtggaatttgtgtacactagttcaaatgctcatatatgatctggatggatttcacggtgtagaatagtttactaatagcgccaatttggttacctgtgactataagaagtggtctggatgtggatggatttcacagtgagccagtggggtctattgatttgtgcaaaagacggaaccagatgttctgtgtacgcatgaacaaatcagatacttgaaaaatgacagtgctcagtatcacatttctacatcactatgtctctaactaactgctgcttaacattgtgatacattatacattgtatagccacacctatgtacaaaacagaatgaaacaaagaaaatgtttttttatgttagagcataaggaccacaaaaaccatgaatgattgcagagctctttcgtgagcttgtatgcaaattggaagaagctcatgagagatcatgaccttcatggaatggtctacacctagtgaatcttgatctttgatccaaggttcaaaccaacccaaatatctacaccaacaaattgttcagttagctccttactttttc

SEQ ID NO: 53382 - DNA, 1501 bp, Oryza sativa
tgcaagagctggatccaactccctagtctagttttccgcgcgtacgtttcttcaaactgctaaacgatgtgttttttaaaaaagtttctatacaaaatttctaaaaaaaaaatcatattgatccatttttttaaaaaaatagcaaatacttaattaatcatagtactaatggaccgctccgtttttcgtgcatactatttggttggaaaccagctcttgccaacacagctaggagatagcagagaaggagagggcaggcataacggtgagataaggggagagggaggagaggagaggggacttaagtccctcagccggcccgccactattttagggtgtgtttggttcccggtcaaggttggatgggacatggcaatccatattttattggatatggcgatccagttttttgtttggtagagtgaatatgacaatctagttttttgtttggttgtatggatagaggtggatttggtgatctattttttttgtttagttggaggagtaggatggatgagtggtgttgatgtgaaaacacgaggcttgggagatctgcttaactccagtgcaggtccaaaactcgccttcgggtatgctagcgtgccagttgatttgatcctgcaatcaacaagaaacaaagacaaagaaaccgtggttaaatccataaatgatagccgatcggctaggtgccgatgacatatcatttatctttgagctgatgtcatatatgcatcgatcgacagtcacaaatagaaaaaaaagaactaaatctactcgatcggctgtagataccaatgatatataatctttatgttgatatatacttaaatcaagtgattgggataaatcggtcgccatgccgagacagtataaatcacttagatcgaagtatatactaacaatgagactatatacgttcatagcatagccgatcagatagatctaacatgtatcggctaatactccgataccactctatattaagatatcaaagcaagtagaatataccaaacgaagagcccaatatacttaaatgcaacaagatattaacataaaaggcggatttaatatatcaataaagcatataaaacaaatatagttaaatcaggtaagatcggctgaaaccccgatactaccctaatcggcaaccaagaagcaggctagagattgagattctaatcacgactcataagatcaaactcaactgatgcagctataagtataaaaagaaggacaatatctagacaatcaagccatgggaagtttcatagagtggtagatatcatatataatttaagccaacgttgatatttaacttaatcggctgccttctattgatagatgttagcccattgtaggttagatagcaatattgccagagattatataagatatatgataactcgacgaattacataagcaagattagagtatcataaagatggaagaactaatcccgagaacgcaagccgtcataacaagttttacctcttgttgaaga

SEQ ID NO: 53383 - DNA, 1501 bp, Oryza sativa
gtggaactaatcatttattaaacttgacctctcatattttctttcttccaaaacagatctacaaatacttaaaagagaccgatgctctataatcaaagtgcattgtgtcgtaaacataaaactatgtattctaaccactactacatgaaagatttttccgtgcgggtggaatcaattttcgcgtgcgtagcttccacccgtctggaacgtggagtctgtgaaaatcccgattttttcgtgcgggtgatgcacccgcacgtgcggacgcttaagccacccgcacgagaaaataaaaaactgaaaccgaaaaaaaaatcaaaatccacccgcaaaccctaatctagccgccgtcaacaccatcgccgccgccattgtcgccgccaccaccgccgtcgtcgctgccttgcccgaggcctgtcgtcgtcgttgtcgccgccaccaccgtcatcatcgccgccttgcccgaggcccgccgatgtcgtccctgtggtcgccggcgatggatccggcctccccgcggtggcagaccatggatccggcctccccgcggcggccggcgacagatccggcctcccagcggtggcaagccacggatccggcctctccgcggcggccagcgacggatccggcctccacgcggcggccggagacggatccgctccaccgccaccaccgtagccaatgccgctgccgccgtactcgcagatgtcgccgccgcgcccgccaatgccgccgcctccgccgccctaaccgagagcgccgccatcgccgaggaggagagggacagggagagggagatgggaggaaggggaggagggagatgggaggatgggcaggatggggaggaggataaatggcagcgctcgcatgatgggaggatggggaggaggataagagggagatgggaggatgggcagcgcgtggggtaggctattttcgtgtacgggtcacttaacaggcccgcacgtgaaaataggcttattttcgtgtgtgggcctgttaagtgatccgcacacgaaaattgatttttctatgtgggcaacggcccagcacctgtccccattttcctgtgcggttgcacttatgatccacctgaaaacaaaaagggtctagtgtacgggaaaatctttcatgtgaaccatttaagattaattggtggtcaagataaaattgtagctagagctaacatttatttacaaatttttttttcttaatatacatatatttataattggtaaaagtccaaatatccccctaaactttggatgaaagtacatcaacctgaactttaaaaccatacatctaacctctaaactttataatcatcccctaaggtgattttggatggtggtttttcatattttggaagcttaaataaacaactttggataactaatgtaacatatttgcatatcatcaattgtaagtcatcaatttatacttatacaatgataccatactattattacgttggtacttgtttgtaagtgagagctaacaa

SEQ ID NO: 53384 - DNA, 1501 bp, Oryza sativa
atgctagatcgtccactctaataacatgaaaacttatggatcacttgtattgcgtttagggggactagcgtaaaaaaagattatatggcctgattttaagcactcccaaatagatagaaacagaaattaatcctattctataataacaaccggatcacatacaaccgtatccatatgctctaaaaagatcttgtgaatttttcaaaacaaatatgtaaaatccctgtacattatcttctgttataattaattattagagcaaaacaagttccttactaattaaatatacaacagtcaacctgctaatcattggcacggctagccaaatacatcacatttctagcccatgggacaactgcaggaaattacaaatacgtacaccaagtacctgcagcaagccagcaactgtagtagtatattttccttgagcacatcatagttagatgttgctatcagcaaacagtgacaccagatccatctattcattcatgtatggaaaagagagaaaacaaataaaaaaaaaggaagggcacacaagaaaaaggaggaaaattataagaagataacagaaactgccggatggagcaagagatggtgccgaccgctgacttgtcgggttagtgtggtgacacgttggatggacaccagatagggtggcgcccacaaatgatttgcaatcctggaggtgggggcgcatttgatccgctttgggaaccgatggtgacgatgataatcgccgtgcgattgtcgagtgcgcacatcggattgtctgtgcattggctcacagggtctgaattaatggatccccccctttttttgttctctttttccttcaagtcaattgccatgagatgactcatgggacctaatgagaaagtttagtttagtgcatacataattagtgcaactatactaaggttctgaaccgtgataccagacaaaaattaaaccatgattctcacctttcatctacaaaattagacatgtattggttgtggtttgtcatttgtaatatatccttgtaactatatattcaaattaagggacaaatgaaaacatcttttttaaagaatgagtgcggtaaaacctcggaattttaatccactaacatgtgggtgcgaagaataaggggatatataaaattaaaataatattaacagatttatcattaaaggtattataatatggttgtaattttaattattcgcacagatatatgattaaagaaataatgatagaatatcttcatttaatattgtgtcgatgttctaaacaagtaaaaaaagaacatagagagtaagtcagacctgtcataagtggaagaggtcttgtagaatttgcctttgtgctcatcctcatcacttacctcacaatagttgacattcgttggtgcgggagagaacatggaattgcttctgactcacttcatgaatttttccattgatttatgaaaaaaaagttctacttttgctctccttttatccttcactcatcaaaaagg

SEQ ID NO: 53385 - DNA, 1501 bp, Oryza sativa
aaagaacacagcctaatgtaacaaacttcctattgaatctaagcagtagcagaggtgcaaattgacagtgagatgcgacattgctgcgatgattgcatcttgggtctcctttgacgtgcacaccgcttgacgaaccagtgattccgtttggttgcctccacagaaacaacataaaattggaggcttgttgctgagccatagattttggtatgggcttcgccgagcttagcaggaattctccatggagttcgccattaaatttgaggagcttgagctcaacctgaacaacaaaccctacatggatactactgctaggaaacaaagaggaagaatccaaatccagccacccataaacaccgaagaactcgaatgatggcgaatgaactgttgtctacttaggccgacacatgaggttggaaatgaggaaacctgcatatcccgacggctagaacctagccagtggaagttcccatccaccgtcaccattgtactctccattagtaagtcgctggccaccataagtagctgcaacagtcgaggtcattctaagccaccaacctcaccggtcaggagatcccaacctctaaccaagtagaacggtagccacagcaggcgccgccaaccgccaccgccaaaaccttcgggcgatgtaaccgaagacgccccaattgccaaccccacgggtcaggagatcctggactacgatcaggctaaggggccgcatagtaggtgcctttgaccgccaccaccagaacttctaggacagaggcctgaactactagccgagaagacatcaagccggcgccatgagaagccaccgccgcctagaggtgatgcctctaccgcctgattcctccacagatagtatattcccacatctccaccgccaccaaccgccgctgccatccactctaacaaccatggaatctcaccagcagattcccaactcgagaagaacccaacttacataaaagacccgacgagaaagaaccaacctaactacactatactattaagggacccgacgatgacggttggacccgtcctccgaccctcgccggtggcgaaccaccgaaatcggagggggaagacgggtcaagaggcagaagaaaactatacaccgagaaaactgagatgtcagagacatatacactttgaacttcgaagcctgcaagtctgtagtgaacaaactacagaacatctcattgggcattgaccccaccaatttactatattttcctagtacgatcgaacgtgcttcacgagcttgtgtgctgttgccgttgatcttttgtgtgtgtgtgtgttttagtaactgttgtgattgatcctctgaaattctgaatctagcacgtacgcggtcagctccgcgatgtgcagcagcgcctgcctataaattggcagcccgtcaagcctcatgccacaccattgttttgcgagcttcttcccagccttgtcaagtgcacacagccacacactgaaactgaaggagcagcagcaa

SEQ ID NO: 53386 - DNA, 1501 bp, Oryza sativa
ctacccagcagaatgctgtgagttattcaaatttcatcaccctgttttccagggcaccaatgatgtgtactttgttgcaactttctagctcacagtagaatcaatcattttgcaaactgatcataatgatcattaacatgctttgtcctcctcagggaaacaatggtggcaccaaatctactgatgtattatcttgatggtttctcttagtagctagtatcctgttactggctgggccatcttactgcattcttatctaactctgagagtttgctattgttgtgctgcgttgttttgcattgtggaaatctagttctttacaggcatccttggtaatgctaataagattttcaattactagctaaattccattgctttgctacggataaaaggaaaaaatcataatattgcgttaaataaataaaagcatgtttgtgatgattatgttacccacctttttgctacaacgaatactcacctcaatttaattttatatgtggctaaatatatctagttgtgtataatattaagaagtttaagggataatgtgtaaaaactacagtaggagtaggtggggtggcagattcactgccaccaccactgtaatctttttaaaggagtatagatgacaccaaaatagatggtttcatactaactgaaatatacacaagctgaacaaacttttttcatcagctactaagatgacaaattgagacttacaaagggttatcttgaactctttcatattcatattcaaagtacctattccttgtcaagttgggtacaacttagttgaagcataatttgcctatagtgtgattcatgtgtgccatgagtgcagttttttttttcccatttaccatatgtaaatatgagaatatatccaagtcatatcatcaattaagtgtttgtcatgtttttactgtggccaatgtataagccgtactagaccaggtgttctatctctctgggagatttactgtgatcaattatatgaatgtggcaatttgccagccttttctgcagtagcagatgtgcagctttttcagtgtgcctggtagcaataatcagagtcactaactcctatggtgctagtagggggtcaaaagtactgaaagattgtattaatattgctgctagtgcttctgtgcttgccatttgcatgctgccgagtgacgacggctgttgaaagctgatattcggtgaaattttaaatgctttgccaattagtgtaaaactgttgttctctgtggtccatgtcttctacatgtccttagctgtttgcctaggtagctacagttatctgccgagtgactgagtccttgtagcacatcacaaaagagttccctgttgttgccttttatgcttgccatcacatttgaaactagttttggacacacagtttcgttgggcatacagttctgctgaggtgtttgtggggtcttctatgtaaatgtttgctgaaaccttgtaattgatcctttctttccaacttcttagg

SEQ ID NO: 53387 - DNA, 1019 bp, Oryza sativa
atgggcactggatcctggataaaaggaaagctccaaatgaaccctgctatatgtacgacttctccatccaatcggcgtatgaccgaaacggcagagcaacacactacatgacggcgtgaagcttggtatgacgtatagcatgttgctaacactgcgtacgccgtagtcgtccaaaagtcatcacatccactaaaacatagaacacatcatcatccactaacaataattacatatcaaatctcgtgcaagcatacaacatcatcatctacaatttgttgaattctacaaatcaaaatacaagcatatttaatcatcacccccacatcatttccataatattttaacatatctatttattatttttataatatttagaatatattcatacatatattccgtagcaagacacctcagtatctcacttagtggttgaaaaaaacaaggcaaaatgaataatttaacctcatgtttcccatcatataactaaatctgaaatctcctaaccgctctatatttttttacaacccagagtaatccagcattcaccgttttaccccagaatttccaccaaatgtcatataggactagcaaatccagtaaattttaaagccatccaagccagtgtaatgtaacatatgctcgacagcaattaaaaaaaaactgatacattactcctagcctcctaggatgactaatgcttgctaaaaagactatgaccaagctaaaactttcaagagtgattttgctatgaggtataagaagctaatacatttttataatgcaagatttagtacaacccagcattggtttcttaggtaacactgtaacaggaggtatagggtgtgtttagttcctgaaaaaaattgaaagtttgggaaaagttgggagtttcgaaaaatagttggaagtttatgtgtgtaggaaagtttttgatgtgatatgatgtaatggaaagttagaaattttgggtagttgaggtgaactaaacacggccataaaacaaattgttacctcccaag

SEQ ID NO: 53388 - DNA, 1501 bp, Oryza sativa
gaaaaatagtactagtaaccaaattcctgcaggcttgcaggtaaggacgacagggcaaagagtaaataagagtacatgcatgcatttttctgcacagatcaggggcacagggtcgcaggatgcgcatggtgtttaattagaacaaataaatcagctctagctagatcgcaaaatcctgtactggccatcagaattcagaactaaggatcaatgctagctgccactctgaaaagagggggaggaaaagttattctcctcatttctttcacagggaccaccatcagctgctgtgctcgagtagcagtgaacaatggagcgagagacaaagctataggcagcagcgaggagtgagctagcactgatactactgggcgtatatgatcagctcgccattgtcatcgagcatttgagctgagctgaagctgaagctgaacttaattctctcctctctcagtgctgttttggtattgaatgtaggatcaaccgatcgatgcatcaattaagctcgcacaggcgcagggccctgacgaacggacgaactaacgagtaacgatgcttatcctagcctcgctcctgtcattctgtgcgtgaactcaatgcagtacacttcaccagtacagccatcatttctgggtgcccctggctgctgtgcatatcatgtaaatgcttgcctagattagcccccctcactgacgtccatccaacgtcgacagcttagcccatgcacgtatgtagtagcccgtcctacacctagcagtagtcacccccacaagcaatcaaaagtaaaagtgaaaacaacagttcacacaaattatactcgatcgtaatagtagcactactcgccatgtcccgacctcagattgatctttccgtccgtccattcgtccatccattctaatccggcaatcgcatcaagttcgccggatggtggtggtgcagttaaatcaggcgtactagtggtggtgaatgttggcgatagaggtaaggtttaactccactggagcgggatagtagctagccgctggacccgttggttccgacagtggcgaaaaatatgccattccgcggggggcgaagagataggggaattttcagacagccgcatatatcccccgcttgggctggcgagaggcgatcgatcgatcgatcgggcgagatatattccgttccaccccccggcagacacgctctcgtctccctcccccacgcacccactcgtgcgcgcgcgcgcgtgtatatatatatataggcagaggaggccacaccctccagggcaacccaaatcaccaacaccactacactacacacaccactgcgacctgacctgaacctgatcacacacacacactctctctctttctctgtgctcagtgctcacctctctggaaggagaccaaaaggccaaagagaaacacgagcaccaaccaacacagctgagccagagcccagagcgctagagccagcgggagatagccagtcaaatgtacttgtagcgctctct

SEQ ID NO: 53389 - DNA, 1501 bp, Oryza sativa; identical to SEQ ID NO: 53376

SEQ ID NO: 53390 - DNA, 1501 bp, Oryza sativa
agaagatagcttcccacttccttttacactatgctccactatctcgctgcatccttcaatcgcaatcttttgataaaggacaaaaactacgaaaataaattccgtagtagttcttcaccaaaaggaagagatttcataaggaatcaccgagaaggaagagcaaagagtaatgaaagaaatgagattttacacttcctccggtcttcaaattcggtgtggttaaagcaagagtagtcatcatcgagccaaataactgttttttgctactctgatgctcacaaaatagctgaaagtaggggataaaatgttatataagtgttggacctacgagaaaatgcgagaatctactggaagaagccgcatgtccagaggtccccataatttatcttgcatctcttcagaaaagaaagcttcaggtccacttaatggtgaccgaagtgacttatctttaaagctagaagagtgcaccacaaataagtaacgaaacaataaaaatattatcttttttattccaaggctgaataaaaatgtgtctctaggttttggctccattcctgacgaacgcaattccatatactcaaaagataaacggcacaagtacaggagaaacgcgctggctagctagcctgcttataaacatgctaccactatccatagcatcaagaaaggaacgaatatgttgtatggctggataaaagtaaagtaagatgatttggtgagaagtttgtagcttacttgcggcagatcatcttgtcctggttgtacttgcgggcaagcgcctgaagcgacggctcgatgataccgccacggagcctgaggacgaggtggagggtggactccttctggatgttgtagtcagccagggtgcgtccgtcctccagctgcttcccggcgaagatcagccgctgctggtccggcgggattcctgccgacacaaacccccatgagctaccgccgcaaagccacagatgaaggaggaggaacaacaagaagaagagggtgtagtgggtgcgtaccctccttgtcctggatcttagccttgacattgtcgatggtgtcgctgctctccacctcgagggtgatggtcttcccagtcagggtcttcacgaagatttgcatcttggcgccctagctgctgcttcttcttcttccccggggctctctcccctttgtctctctagctccttgctgctgcggcggcggggggagaggaggctggatgttcgccgatttatacggtgcgagctagggtttggtctgaagaggaggggagcgtggagtgtaagacgggcagccgaaatggtccgcacaatccgagggaatagttggcccagctgcgcctctagttagtgggccgggcaagttcttgccgaggtagatgatgatggaataagttcccctaccatccctcaactttacgtcgagtctgtggtgtccctaatctccaatatcagaaatcttcaccccttaaatgttcaaaaccgtgtaaaataggtctcat

SEQ ID NO: 53391 - DNA, 1501 bp, Oryza sativa
ctacacatctctcggttttccctgtgatcatcctgctttcgacatgcatattgctggaaaaacaacatcgtcttcaaaagtttcgcaatcgtttgttagggcaatgtggtcattagtaactactattagacttgtagactttttctatcccttaattgctacacgccctagaccaaggaagtaatattgtaagcacttaatggctgtatgatcgcggttcaaattaaaatgttgattgcatttttaggcacttttggcaccatatatatgcgcgcatagaagatttttgcatcgctttattcttcctccacacgatgcacaaagtacgctggctgttcgaatttttgaaaagaaaaagtatcccattgcttgggcaacccttcgcgcgccgtatttaatgtgtgtgatatgcactgatccgatccgtttctctcttgttttttcgtcacccgcgtgggtacagaaaaaaaaacagaaacgaaggtgacgtaggagtacgtattgctagcatgtatcgacggcgccggtggaccgagttcatgcaccaggctagacggacacacagcctatgcccgtcgcgcaatctccggtgcccgtcgcgcaatctccggtgtaaagcaagcttgcgagcgtgccacgcaagctaaagccgatcgacctcgacgacatacatattccgtggtccccttttctttccgacccaatgcaatagcctgaagcagattgcaaattaagcagcacgagtagatgggtcatggtggctacatgcttttcgtgctactggtgtaatactcctgtgaaaaagaaattaatgtagctttattaatttatttattgctgaactaaatggattttatagttaggccttgtttagtttgccaaattttttttcctaaaaacgtcgcatcgaatctttgacacatacatggaacattaaatatagataaaaaaaataattgcacagttagggggaaatcgcgagacgaatcttttgagcctaattagtccatgattagtgctacagtaacccacatgtgctaatgaaggattaattaggcttgaaagattcgtctcgcggtttccaggcgagttatgaaattagttttttcattcgtgtctgaaaaccacttccgatatccgatcaaacatccgatgtgacacccaaaaattttcttttcgcgaacttaacaaggcaatttgtatcttgccaaacaacaaatatcgatcggatgtagatatgtactactccctccgtcttaaaatataagcatttttaaattctgacacagtctccgagattctactttgaccaacaatatcaataaaaataaaatgttttaaatataaagaattgcatattatgataatttgtttaatgataaatctagtaacatcaattttatacatatgattgattttttttcttttgctactaatagttaaagctaaaaatgtttaacttgtcactgtactagaaatacttatattttaggacggaagg

SEQ ID NO: 53392 - DNA, 1501 bp, Oryza sativa
tggcaaatgttgcatggatgggaggcgcggcataggtgttatcatcaattttcatgtccaactatacagatttttggttgagctagtgttgtcaacttgtggtgtcataatgatttcacatcaaatttcatcgatttttaaaaaagggaaataccaggaaaaaaaggaagtaaaaatatcaacgtgaattatttttagggagggaaaagcagcagcctatattggagaggtcagtctcacagagcgtcaacagcaacacaggtgaaagatgggcctcgattgggcttcgtttggtcggattacggcccattagggcaaaaaagaaatgaagaaatgtcgcacaaatctcctgaaaatttttgagctgtcgatatgaattcgtttcggagaattttggtttgtatgaaactctcgactaaataaaataaatacggataacaaaaaacaaaatgtcagaagtgggatttgaacccacgccctcgttagaggaccagaacttgagtctggcgccttagaccactcggccatcctgaccgttatgtagcgttatttccggttaattttattattcacagctaaccatctgctccaccttaacaagtcctttttccttttcttttattaaaaacaaagtaaggaaagcaaaaggcaatattacaagacagtctaagcaataatttcccacaccaataaattactccctccgttcctaaatatttcaccatgacttttttaaatatgtttaactgttcatcttattaaaaaaaattaagtaattattaattctttttctatcatttgatttattgttaaatatatttatatgtatacatatagttttacatatttcacaaaagtatttaataaaaaaagacgaacggtcaaacatgtgcttaaaaagtcaatggtgtcaaagtatttagaaacggatggagtatgattattgctcgcgtagagttatgtatgcagtggcggagtcgacatcatcgtgtgagtcttgggcgattaataacattccatgatgatggctgtgtttagttcgttggccaattttttttaacgtatacggacacatatttgaagtattaaatatagactaataacaaaacaaattacataatccacctgtaaattgcgagacgaatttattaagcctaattaatctgtcattagcaaatgtttactgtagtattatattatcaaatcatggcgcaattaggctcaaaaaattcgtctcgcaatttacatgcaaactgtgtaattggtttttttccgttcacatttaaagctccatgcatatgtccaaataattgatgtgatatttttagccaaaattttttggaatctaaacacagccgatgaatcaatttttatacacattgacgctagtaggtaatggaggcggcaacggtagagcccggaccgtcacccaacctacccgagagctgcctccctcactgcatgtatgatcatttgtactgtgagcgtctgcgtttgtatt

SEQ ID NO: 53393 - DNA, 1501 bp, Oryza sativa
aacaatatgaatatgggaaatgcgagaatgatttacattgtgaaacggagggagtaccttgtaaggtgctgatccgctcaataatacttacaatagttaatagtttagaccagtacactagtcacaggactgtacatttcaacagaaccagatctgatggacatagttcaatcttttctcccccgtatttttctgtgttttttggaatggttttttctcttagtttttttaaacggtttttattgttttttcctcccttttttgaactgctttatatgatacacctagcaagagtaagagctctaacctgttttttttttctgaaagtatagaggttgtaataaaatcataaacaaattcgaggaccttgcctttttttttcttttatttactagttggagcaaaaaccatactggctgcagaaatgagaggcaaactagatcatttaaagcaactggtagcaaagtaaaagcatcaggagagcctgcatatgttgtcctacctgccctgctgccaagcagtcactgaatcttacttcttggcctcaattaatttggaatttgatccaagatttttttttaaaaaaagtattttcatcataaccttggcctccattcacttgtaaaagaggggggaaaagcataaatcttttgcagacataacattgggtgaccgtcttatctgacctcatgtcaaaggtagcaagaagagggagacatccccccaataattcatcgtgccgtgccggataacaccagcagtaggatttacaggtgttgcaagtgaaaacaaggggaatgaaagaaggaaaacaaaaactgtcctggtgatgactgatgacctggtccacaggggtattatttccagctttccacagaattccactctgtctcatcaggttctgaatgctgggaacacagatttaaattaaatacgaaattctagttttatttggttttatttactactactacctcccatgtttctattcttttctagtgagagtggtttcttgtatgaccctttgtatcttctatgctgcaatttatgtatttcagatggactggcttggtgatgaattcatatatgcacataaaagtatcaataatttgagaccgaccgaattttcaaacaaatatgaatttcatgaatataaatttcattgtaggatttacccaaaagcgttttacactttttttttctaatagcatccaatttggacctgctcggctgggctggttatcgcagccgctataacacttgacgcacaaacgcacaatcaatcaagacatttgttatccatatagaatagagtgaagcacatgggcgatcccgaaacttgtgccagtgtgtcatctagatctccaaactactaaaatatattttttaggtctctaaacttgtttgtgtcatgtaggtccaaacgggttctaacccgctccatagcgctgatgtggcaatgccacggtaacgcctacgtgttagtgaaattcacatgtca

SEQ ID NO: 53394 - DNA, 1501 bp, Oryza sativa
tttttattaaaattttaaaacgaacactctaaaagaacctttgaaaagggcaaagttattgtaattcactgtagaagaagagagtcaaccgagtttacaagagaaacttgccgtaaaattttacagctaccaaaaagtttaggttaaaataagttcaagaggatcctttttaaataatttatattgaaaaggttattacaaatccatacgtgcaccacatgtgctgttgtggtgctgcttctgcatcctgtttccagaacagtggacgcaggccaagtgaggccaaagccatagctcaactgcactgggattttaggtcacccaaagattctgtgacaagcaactacgctccgtctgggacctggatggggtgccacattaggggtgtagtgttggcctttggggcaatgaggcatctaccgatacaaaccgatgtaccatttttcatgtagcgtttgtcatgtatgctcacagtgctacttgccacgaacaaagcactttgtgggatgaattggcacaatcaaaccatgtgtgccgttgcctgtctaacgtgccgattcctctgtcatgtttcgcacagaaacaaacaggcaacacagctgtgtgtaaaaactgtggcattgacagtaactggaatgcatcacagttaacaagccaagagcaattgattcacattgttgcttaacaatcggtaactggttaatgattatgattgatccgaacaggatggtagcaactatagccgcagtgcaggacggtggctgtgacgatcttgtgactcgcgagtacttggtagtagcagcagcagcagctagctagcactgtcgtgcactgcgctgctgcactggtggtagacagtaagatatgtgaccgtgtcacatgacctgccaaaaattttcttttggagttcactcaggaaggcagtgcaaacgagggcaagggagcgcctcttcctaggcgaaaaaaaatgacaaattcaccgagacagcactgggtgtgggctgcacatttccttggctgcttgtgtgggtctcccatgtaactccatgccttctccgcacacacttgccgctgtccgtggtgttcactggcgtggtcttgtacacgcataggacgagctccatcaattaccggagcagagccagtcacaggtcaaagaaaagacatgcatgatactgtccttctctgctgctgcaattttatctgcatatgagctgctcatcattgtagggggggaacacagaacatttgcaggaaaacagtgaaacggtaccatcgtttatggagaaaaatctgtactacattgtcactgaactgtatgtatttggtccaactttgaatcttagatcccttaactaaaaccatttacttttgatccagcagctctgaaagatgtcgcggtgcctacatggatgaggagtgacaacatcaaccttactttcttttcctatttctctgcctaatcctacatggcgtcatgtcatcgaaaaccacctaggtt

SEQ ID NO: 53395 - DNA, 1501 bp, Oryza sativa
accttggtggagtcgtcgtcccaggccagccatggacctgggttagcagccgcctgtgccaccgtcagcctgaggggacggccggcgccggcgaagcgcgcgaccggcggcggcaggagacggccacggccagcaccaccaccatggccggcgcctccaggcaggcacaggacggggcacccgaggatgaacaacgacgacatctcgatctctcgttctcgctgatgaggagatatggccgggggtggaggtgaagtgcactactgcagtgcagccttgcgatatttataatcaggagccaatgctagggttttttggcaactatgggttatgcattttgcgagagtgttagaaaaagcagtcaaactttagagagatcacctttggctttggagtttggaccaacgtaccgtgaaatgcatacggtgtatgtatgtaaattggagatcgatgtagacggtgtatatatgcatcaacaagaaaacgactttgttagtatactactactattccatattaccatttcattaactgcatgtatatgcatgtgtatttcgacatgcagtctgtctttgtccccccgcgcgcgtacagggaaaaagggaagaccagagctgcaggcgtagacgccgtcgtcgtggtggtagcagtagcagtacgcgctgcatgcatccacggcgccgcgagcgcgtggactgagttcatgaaccgcgggtagagtagacgcacagaccgtgctagcctgctaggtgtatggatctttcaagctccggtgtatgtatctttccggtagcacaggtgcacccatccacacgttctgccatgcatgaagccaaccaaccaagcacacaaattccgtgggtccccctctctccctcccctggacaattccgtggattgtttgcgtgcgaccgaacagcagcctagaagaagcagagatcgcaaacagatcgataattacatgcatttctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatca

SEQ ID NO: 53396 - DNA, 1501 bp, Oryza sativa
cgccattttcactcccttgctctcactcacaggtctaaaaaccaaagctctcatattacactcatattagcaacctactccatcattacaccaagagagaccctcaactaatccatggaagaagaggaatatgagattcctgatctcaaccttgatcctggtgtgcaagaagtgctgcaagatgaaggtgatgggatccctgaccttaacctggttcctgctgtgcaaggagaagatgccttccaatatgaagatgaagagcttcctgacaaccaatgttttggtgctcatgaagatgaacatccaggccctgccatgcaagcagttgaactctccaatggccggagtgcacaagaaatttgtcatctaaacatggagccaggtatggaatcaaaatcttaatgcaaagcaagttatgggcttattcacatttcccatcctcccttctgctgaaataacagaaacataaatgttgaaagtagcaaagtttgtatgatcaaaatttatgaccaaattcataaactaacaagcccaatattacttctttgcataacacagagctttgcagctttgctattagtgtcaatcagttgttgcttttagtcaggagttgtaaacttcagccatcagtcatatatatactcttatgtggtactatgcaaaaatgatgatcataaatggctctatgaattttatttgctcattatgataaccagccattagcccaacaacctccaaagtttataagcgtacatcatgtgttctaaatagttggaatcagcatagttaaagttttatttcataaagctggttttaatatcagaaactactaaaacaacccaaaaaatgaatagtatgaactttatatataacaccactgcaggatgacccatataggtatgggaacatgtgttttttttgtggtagatgacctaatgcaaaaaaaaaacttttgtggtcaagaatggttacttaatttataatgcacttttctgtatatttcatcatacaaagcacatgacagggtggttaaagccgcgcgaatgcactacttcattagctagtttctttgtacaaccttcaactttaaatttatcttcgtcacatgtcatgcagcaaattatggagaagatgatattgtatttgacgatgacgaattctatgttctccaagatcaatcaaattatgcaggtacatacattattttttgctcatatgtaatcagcagtgatgcagatggggatatcatatgagtagctcatgtctcaccttttctgtccatgcagacgaggaggattttgatgtttattctccttatatggatgttgtctttgatgaagatctccatacatcaagtgatgaggaaggtatgacatgcaaatgacattcattagtgtactgcaagtataaaatatattgccaactgatatgcatatatataaatattttctttgtgcagatactcaacaagacaatataaagagaaggaaatatttaccag

SEQ ID NO: 53397 - DNA, 1501 bp, Oryza sativa
accatcttgcagtctgatcgatgttcttcggtgatttgtttcttctgcggaaagttcagggagacaagcagtttagttcgatcacttgggtcagttagcatagttcctgacgatttttttgttgtggtgttcttcttatcaaattgtgaccatggatcatcacttaagtttcaatcgatcagtttcagcatacgcgagtcattttgtttcagtcattgcctgacaccaaccatcaagtgtcctgaaaaaatgaaccgttgttgttcagtctcagtcggattcagacaaaattaccaaagcatcaagtaattgggggataattcggctcattgaattcactgtgatcatgatttgagacattcttcattttacacatttttcttttttgacatagttgagttcagagtctgtttgccccatcctgtttgaagttttcggtgttttctgaagaatggtctgtgtttcagcttaaacataaaactctaggttatctcattatcttctgaagatttgttccgaaatgctcccatgaccgtggaattgtcgcattgacacttttaatcattcagtttcagcatatacgggtcatttttttcctcatggatcgaacactaagtttcaattctgtttcagcatgtccactaaaaattcagtttcaattcagttttgcacctgagcatgaattgtcctgaaaaatgaatcgttgtgattcagtctcagtctgattcagacacaattgccaaagcatcaagtgattgtggacaattcggggatctgattgaatgcatcgtaatcatgattttagtcttccattttttatatacatttcgacatagttgggatattgttcaggtctgtttgcccccatcaatttggagccttcggtatttttcagaagaactagtctgtttcagcttaaacataaaacaagaagcagtggtctcagctcttcgagtacatccatagaaggcagctggaacttaaaaatgtacccgtttcccatattttcgttgtatgctatcgtatcctacctgtaactttacggtatgcttttgcatggacttatttttcttaatcctttctctagttcaattccaatcccaccacatttgctcaagataaattaagacgcagaacagcggggagtattcagcaaattctgctgactggaccacaatggttgctatcccgagttccacgacaatagccatgtcaaagaatgcaagcttgcatcagttacaactgtcctaacattgaagtattggcctttttctctttttttttcttaaacaaaatacaaacgcagacgctcacagtacaaatgatcatacatgcagtgagggaggcagctctcgggtaggttgggtgacggtccgggctctaccgttgccgcctccattacctactagcgtcaatgtgtataaaaattgattcatcggctgtgtttagattccaaaaaattttggctaaaaatatcacatcaattatttggacatatgca

SEQ ID NO: 53398 - DNA, 1501 bp, Oryza sativa
taactctagaaaggcaagatatcaatagtctgaatatctagcgggcattagccaaaacatgatagatgtacaagataagatgaatcggattgctttaatttcagatcaatgacaatatcgccaacatgtgattattggcttcaatccattctaaagtcaccgttagggaatcctatcctaatccactcttctagtactctatttgtggtatttcaatgaaaatacattgtatctttgttttttgattcttactcaattaatctagatctgcaaagtttatgttaaagaaaatatatttatcatctaagcatagttattgattaattatcacatttttaccttttcagagtttgaatggtacaatctaattctttcaccccatatctaatactagcatcaacgtttccactgcaataaacatacatcatacacataattagagaaaatgctaggaatacacaagcaacaaattatatttcaatatccaacattctacgtgaaatcgctgtagttaaaatgtatccaatgattataatattgttcttttggctagtgcattgtgtataccatgtgaacttgacctctacttttatgtcggtccatacatacatcgttgtttcatattgttccatattctaggggatttatactatagttttgaagtaagttctctaatttataatttatagtgatgttaactcatgtccattctctagaaggaaaagattaaaaacctcaactttgcctttttattttgctaccatctacatatgatgaagggagttgtcaccaacgttcttctttttttgagctcaatatcactagaggcgtgctatactacatttctatataaaaatgaactttctacaagtaaaagcaaataggtgagtgggttttcatgatccaaggtctggcagattaagcaataagaagatgaactatagagcatgaagagtactctcgctgatgaggttgcttctttcccgttatccttctacttctctctgtcccttcggatctttgtgactaatctggccctcttcttaaccttggtggaattcacatattcaaaatctcatgagactttcttgtcgtcgatcatctagacatcgcctccacagaggagtagcttgacaacattctatctatcggtgctagtgtcgaatgatggcaacctcggttttggtgcacgtctcccagtcaagatcaatgtgctcggagcaacgatgcttcttgaccttggccttgtccctgtttttctgtttttcttggtggggcgagaggatttctcaggcttttagttgggggggagggttgattctgtttgcagaaggctttgatgggcctattagtaggagggtggaggttgggtgaccaagagtttattaatgacaatggaaatctgtggttgtggaggtggatttttgcttctgctagggtttggtagggacagattgttccttgggatgactgttgcttccgatggcaacaaggactcctt

SEQ ID NO: 53399 - DNA, 1501 bp, Oryza sativa
tttcattgaagaaaacaattagtacaaggtaatattttgcttccaaaccatcctattcaattttctccccatcttacaaagcacctctcctcatttaataatgtctaagtcatttactttccatctactgatttgtcttttgaatgataaaactacattcttttaggtacaaatggaaaatatcaaaaccagaatacataaaatccacagaagcactagttgtgtgatcaatgagtcatgggtgcgtgagcgtgactccaccttttagggttcaaattctagtgaacattacgtacaggccgatgtacttagaatagaattttagtaactaaggagatgttgttaatctgtctttttagcgtacaatagagaatgcaatcacgggtacataagagtggtgtgtatgaatgcatcttccatgtaatcgagaaaaaaaacataaaatcctcatacacatataataccctcctagcgtgtatcggcaaatttgccacggtagtttaggccaacttcaaggttgctatggtttaccttttgtttgaacatcgaaaatgtgaaagtctcaagtaaaaaggaaattgtgaaagtcgtaggagtctatcatcatagacttaggttcaatttaaaacatattgttggtattgttgatttgaattatctacttgcttatgagactaaattaaatattttaataaataaaattaagtctaaagtagaattttctttttagaaaacgtatatttttgaaacttggagcaaacaatcagtttcaataatccggtaaataatctgaaatgaacttaagccctcagttgttgaatgctggtcatgaattacattgttatgcagtaaaatctttggaactttgaacattagtaccttttaaatatttatttggatatataaaaaatcatatatgtagattggtggtgaaaagttttttttttcataacactgctagttcatcaaattttaaaataaggtgcaatataaattattcatatatgtttcatatcatatcacgctttgattttttttctagtcaaacttaaagaagtttgaccgaccaagtttaaaggaaaaacatagcgatatttttagcacaaaacaaacatattatcaatatatatttagtgctagatttagctaaatttatttgatattatagatgttagtatttttctataaaattgatcaaacttaaaaagtttaactagaaaaagggtcgagacatcttataatataaacggatggagtagtaataaaaatttgtatcttaaagactatgttaatacctaaaacaacatttttcttataatgagggggagtatgttgcacatatgaagggcatgtttagtttactactattttcaatcctacaaagtttttggcaatactaagatttggcaacattaagtagtggtaagatttgataacgctaagtgtcagggttacggataaggtataccctctatccttggatatacgttgtatactaata

SEQ ID NO: 53400 - DNA, 1501 bp, Oryza sativa
gaagtcaaagttgtgttttggagaccgtgtcgctgtccaaacgacttactttacgagtacggagggagtacctttgtttcattttgaccttttttagtcaaaacaaataaactatcaaaatacattcaatattagatgtaatgaaattaaattaatgctacaaatgttattatatttttctataaacttgattaaagtttagagaagtttgatgagaaaataaaaatgacttataatatgaaacgaattataaacggagggagtaatttttaaagtaatataataattaatatgatctaaaatagctaaaaatacacaagctatccgtgcccggtgacacatcaatgattggaattgggttaactaatgatctaaaaccttagaaagaaaatttagagaaaaaataccactaaaatacaagaaattggaaaatatagaattggcatgaactcatgggaaatgtttgcacgaggtatgtcgattcagctgctgtcctggtgttcttgtgttagataatcctacaacctgcttttttttttccctggccctctctctctctctctttttttaaacacctgggccctctctctctatctctctctctctcactctgatgattacttttcccaggcgtccttgttcttatcccctatccgcccggggatttgcagtacaaaacccaacacgctgtggctccccttttgtactgcgtccctgctgcctatgatctcattggtggccgaccgcggcatcgacggcttcgtcacggaaagaggagaggagaggctctccccgtcgcctgccaagtgcgaaagcggaggagaaagcgaagcatagcaaagagagagatcgctgccgtgccgtgacgcaaatcgaagggagggtcccgcgctggctgtcacgttgggagatcctatggtaggagtacggtggtggtggtggtgacaggatccgtccttctagggcgtcccgggagacgtcgctgttgggagtttggggacacttgtcgcctctgtggtgacccggcagattgggattgggatttggatccggtgcagtacctagtgtgactgcaacataagcagtcacattaggaccttttgatgtaaatctgagggtccaaaatctatcaagtattgttcacacgaaaaaaaaactgtaaaactagcatcaacattgtagcatcagatctagaccgttcattgaaaaaatggatggctgagatgatgtgcagttcctaacttgcagtcacagttaggacttcactaaatctcaattcatcagattgagaggtcatcgctgcttggtgtggtaaaaccgtaaaattagcagtgctaggatcctaaaacctactccttctttaaaattaaccaatctaacattagattaaaagtttctttttccagatttataatagtagatttaggtaatgtctccaatcttaaattgatttattttaagatagaagtagcacgtgtgaggtttttttttttacatcaga

SEQ ID NO: 53401 - DNA, 1501 bp, Oryza sativa
ctaaacaaagggttctcaaaatcataaagttgcaacttcttaatgatcctgattttccagtaaagcagtgacctgcctaggaatctgttggtttttatattttttactggtcatggtatagaaaccaaatctttcgtcagcatcagcttaaactagcataaactcaacttttgttcatggtcatggcctaaactttgtcataagtcagatgaaatcagatcagtacgaactagcataaactaagaaaccaaacgattgcgaattgatattccatccctagtaataatttccggttgaaaattgtgccagcatattatcattaattttgcgatatctgaaataacatactagtagcataataagtgagtaataaactagggaagttgttgactacttacaagaacagacagactggtttcattggaatgagtaaatctgtgcggcaagcaacttgatagtaactccaagaggtgccaacgggacaatgatggaagcacctcaattgaattccatgagcttttcaattcatccttcagcttttgcaagtcagaaaggtgaggtaacgaaggaaggcatgccacaagttctgtctgaatcttatgaagatcagcgtttctcagcacatcaggtaaatgctgcagactttgaagatctactacatttggaacttgtgttgcggtgtatatggtaagaacaagaaagatgaaaaatcctatcaagtgcctgagttcacaaattaaaaaacagctttagtatatcaggaaaagtaacttagcagacgtattcctgcattaatcacattgataacttttttacataaaaaaatgtcgcctaggagttgcacttgccacagtcataattttccagaatgcatacatctccatacgagcacataacttttaaataacagtaaccaaataaacgttgtatgatgccaatcaaattgcttgatctccattcgagctcgatatatatatgcaacgaatacaataaaagaaggggctgtctatatatcatgtgacaaaaaatgccacctcctattattcgaattttggaccattggatatgcttcaagatttgtgtagaccactctaaccctaactcctctcctcttcccccaattcagatcgcacgctgccgccactcctcgtcctcgcgcgatcccccaccactgccaccgccatcgccccaccgcgccgctgcccgcctcgccggctggccggaaggggtcaacggcgccggcgaggccccctcccccttccctcctctctttctcctcgaggcggcgacgacgaggtgcccccgccccgccgtcttccccgtctccggcggctccctaccgccggatccgcaaccaccgcccgccgcctcctaaccacacgcttgctttgcccccgccgccgatgccggcccaccaccctcctccatccctgcggcttcggcggcgccgccaccgcctcgccgaagtacaccgcccacggccatccctctaagctccgag

SEQ ID NO: 53402 - DNA, 1501 bp, Oryza sativa
tgattttaggatgtgagcattatgcagtgcataattaattaagtactccctccatcaacttttgatagtcatatttcatcttggcacaatgaggtgtgttcggcaccctctttttctaacccctctcgatcgttttccgtgcgcacacttttcaaaccgctaaacggtgtattttttgtaaaaaaatttttgtacaaaagttgcttaaaaaattgtaattctcacaaactctccgaaacctgcagccacagccggccacagaaaattcaccgagtcagactcggcttgccttgccacatgcccaggccagccgacgccctgcttgcatcaccaagccgagccgctgcatgctgcacagtacgcatacacacatgcatagcacaacatgcatcaccacgctactgcaattcatagtaggcacacatatatgcatgctacagtaccacgtgtactgtagcaccatatactcttactttccaatttccttcgcgaacaccgacgcttgcacgcacacctcgtgaagcccgttgcaaagatttcacccacacggtatccatccaccgtatgccatctcgtatccaacttcgtcacccggtatccttgaccgtctggacctcaactcctcactgagtctagaacttcaattctccccttttcaagaagtatgcattttgtatatttctccccctttgacaataatttcatcaagatgtaagttataaaaatctaaatacacccatagcatgacccatcaatattaataattaagaatttagcaagaaaatgttgacacatctagctttttcctaactattgaagttaccaaaaattcagtaggacacgtgttggcttcaattcaaaacaaccttaatatgagagaacgtacctaacattaatttcagcacgcggaatatatatcctttgtttcttttaaatactaagatatcttttccacgtttcatccatggaatttaatattaaatacatatatcctttttttaaaacattatcctatctgaatggatatataataattcttccatggataaaataaacaagagggtttgatatttttttcctataaaaaaattacatgataaaccttagtaacgaagcaaaccctagttgggccgcctcgagatggcagcccattccggcccaggacacgagccatcgtcatcgggggtcgtctactacttgcttcctcctccctactccgcctagtctactactctacttcgctctccgccgccgccgccgccgccgccgccgcccacctcgtctcgacgccggtgagcactctcccccgctggagatccacgcgccgctggttggattagttcgggctagggtggagcgagattggatcgttggatatttggtttttggtttttgattttttttttgttgaattgttggggggatttgactggattttcctcgtgcaggatgaggatggagggttcgtcgccgatggaggaggaggaggaggcggcgaggc

SEQ ID NO: 53403 - DNA, 1501 bp, Oryza sativa
gacatgtccagagcgagctccttgaccggccacacgctgtgcacagcggctccatacgacgcctactagtactagtacagaaaaattaaaacgccacgatctcaacgcccagctgccacacgatgcgatgcgatgcaaagtacgtaccccgtgcgtacgtaccctgcagattacccgggtcaaagggcgaatcgaagcgatcgatcgggggcattaaacacggggcaggaataacaacgacgacaagtctatccggagcgagccgggggtgggtcggtcgatggacggatggagacgcgtcgtcttcctcttcgcacagccgcctaccggccgctggctttgcctgcgccctggagtggcgtaggcatgcgacgccgctggctaggaaacggcgccggggtggctgcagcgaggcctggaaaaggcggggacgacggtagcagcgacgtacggggacgggagggggggaggacggagcacgcacgacagcgcatgcgcgtggcgtgggctgacggatgggtggacggaagtcggaagggactgacgagcggactgactgacccaacgtgcgagcgcagggaggagcgccttccgttttgcccgactacaggtaaacagggcaaccggtcgcctgctggcatgggcaccatgcatgcacggtcctgacgtgacaaagtaacgttagtactccctccatactgatcatcatatcaaaaattagaaattcgaaactaatcatcatatatcctttgtttcttgtttcacatgtagtattattacatctttatatacaaattaagtatgcatgcatgcaagtatttagagattgttaaactctcgtttcttgtgcatatggagagttaaagtgcattttcttgatttttcctaatacatactcacattaaataaaatatatatgagtagtactcagacattcatccaaaagtctaagatccattttattttttggtttttcctaaaagtttaatacctatttgtaatcttgatgtactaaattaaacggttaaagaacccaagaaatcattttaatatttattggttgcatatattaatatactacatccatcccgaaatatttttttcactcattccacacataccaatataaaaccaacaatagtaaaatgcctatattttatcaaatccaatacaattattccttgcattatcttatcccattacaactagtccttacttttacaagctacaatacaatgattgttcttaaaaataaacttattttgggataaactaaaggagctaaaaattaacttaatatgagacgaataaagtactccctccatacttataaatgaagtcgtttagaacattgtttaagtcaaaccttgggaatataaatcataaataactatcaagttgttgagtttgaaaatgtaaaaattatatgtatagatttgtcttgaaaaatacttttataaaagtatatatatatatcacttttcaataaatatttttttat

SEQ ID NO: 53404 - DNA, 1501 bp, Oryza sativa
tccttgaccctaggttatgccaaatggttacccatagaagccctctaaaaatgttggaaaaatagaactgttctcctccctttctcttttaattaaaccaaactaatagcacatgcacttcataatctgttttaatggttctcgttcaaaaatttattccagtgttattagtactgtacatctattactgtactaatggctcattttaccagcaaaagttttacaatattgttttatttaatcttgctgcaataaaataaatttaacatgttgattttataactttcttttatttcttttggaacctgatgttcaaaagtacaaaattcatttccaactgtttcaacttatcttgcaagcttggtttactttatttaattaccttttactttgatcttctaaactttattcaaattaatcccaaaacttgtgctattaattggataaatgtcttaactccctcttttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttacagtgatcagttggccgatactgagtatcgctatcatcctcgtcaaccccagggaagtgaccgtggcagctaccttgagactgaaggaattgagaatgatgctaccacaaggcatttggttgagatgctgtgggctatggatgaaagtcgtgcggagactgtgttagcggctcaagatcgtgaagatcggaatcgtggtaagatttgcaagctagaagacaaggtggatcgtttggagaaggaactagccgcattgaagggagaagcaccaccgcagaaggccaggattcgtcttaccgcaaggaagagagctctatttgtccctcgctatcaattggcgccaaaggttcgtgtggtggagaaagaagttgccccaactctagcagatcctccggtcaacatcataagtgatgatgaggaagaagaatccaagcgcaaccattccaagattgagtgggtagcaactcaagatgatgaagatgagccgaaagagccttcaatcgacctccgatgctcggaagaactagagtgacttgttaagtcgttgtcttagatcgttgtgttagtttgcttgctttaagttgcttgtgtgtgcttcgcatgtaatttacatcagtgatgggatgtaagtgcatgtgtttgtttgcttttgagtgttaggaagttggtgagtttagtggtgtgagagttttcagttttgtaataaaactcagttaagatcaataaaagttaaagtaattctctgtcctaag

SEQ ID NO: 53405 - DNA, 1013 bp, Oryza sativa
gcgccagagaggctgggccgtcccgttggatgacggcgccagccactctggcgccccaaaaaggaccatttttggataagtttttctaggggtctatttgcgaaataagtttttcaaaaggaccaaaatgtgaaaaatccagtgtgcaaatttggtccaatggcatataggggaagagcaaattttcagtggcatataagagatcgggccaattttcagtggcatataagagattctctcttaaaaattggatctcatagtttttataatttattgtcccgttgggttttgtttttataatttctataagttccgtcaaatgttatcattatactcttctacagccgtccactgtctcttctctttattgtcattggtatatgatattttaaaaatcgtatataattatcgtttaggtttatattactgaggatttttgaaagttatgtaaaaattatcagaattatactgtattaaatctgttaaattatttaaaaataattatcgattaatgtacatgtaatccattgacattgcgattcaaccatccgttggattccttggaagcggggaggcgtgaaaaccgaaggagcatgtgactgggaggacaccgggcaccgtatagtctaggcacatactgtacactactagaaaacatggatcgacacagtaacacgagcaaccgtatgcccctgaatctggcagcatatgcatccacgcacagggggtgacacggtgcatgcagagccatgagcgtctggcacgtccacacgcgcgtccgcgtcagataaacactccacatgtgaacgcgaacagcggagtagacctagcggcgacggcacattgctgtccttcatgtggtgtcttggcatatcagcctcgctcttcttcttcaccctatataaagcacttggttaagcttgtagatcacccaataattagcctgtgatccctcatccctgaacttcccagagagggagagctcagagaaaaagggcgaggcatggcatcca

SEQ ID NO: 53406 - DNA, 1501 bp, Oryza sativa
atacttgtaagacatcttacagcctcaataaagcctattttttaggtacagactacaatcaaagtgttccttttcgatgatcccttacccagatgacacctaacgttgaaacctatcctcatgtctctttacgccgtcttgacaaggcctccgaggaacctaagggaacttcggcggggacacccagagccgataaggccttgtcggatcctgtagagacgaaagaccatgtaagatctggttgtgtaagagttctcgccgtgcgtattaaccaagccgtgtaatcggaaataaactttccaacttcacggctgggggctaggatcagtgcttgttcaaccgaggcaggtcaaaggtccaagagccttatcttccgagaagaattctccgatgacaaggctggaggctagggagagtgtataactcaaacgactgatcgaagtcgcgaagtgagaagacactcatacacactacgtccagagtaagaaagcttagtaagatagatttcttttctattccacaagtatttcttacaattccatcaaaattcaaaactatattacactttttccaaagacatttgtcacaggatacggagactaccaggaaggacaacgctagtccatcgactggaaaaccttctccgccagcggcgccatcgactttgccaggccatctatctccgtaggagttctctgggaacgagaaaacccttcgcggaggaactcgagatgcagctgcgaacgatgatctcgtatgcaggccaacacgtgccccccggcatatcggcttgagcgacgacactcctgcttcaaggcctcgtcgatatgttgaccgatgccttcgagctgggcataggccccattcagccatgagatgtatccggcagccgattcctcgggatccccacggggtattcggagctctctacagactctcgacatggatgtgcagcaactcttcagatacgagttgaaccacacctcacgaccccggagtgtctctacggcctggtcctttctcacctccagcatagtcctctcgagttccgcgacctcaaacttcgtcctccaatactggatgcgacgatcctggtcagcaagcgcactctcgagatctgctcagcatggaaacgactaagtcaagctgctcttctctcccgagaacacaacaaatcaagtcgatccagacggaagggcaaaggaaatggtaacaaaggacaacaaagtactcaagatcaaaatgctaaataaagctaaggcaatgaccgcacacactagggcggttgagaccaataaaagttttacaaagcatgactaaagagtacaagagagctaagaccctactcttcaaaaagcgagaggacggactcccccagatcgccgacctcctccatcacatccttgcgcgcgtcgctaaccgccccctgatccaagatcttccacagatcgagttcagggtgcgccagcctcacacatgcaaggacgtggcacaccccggt

SEQ ID NO: 53407 - DNA, 1501 bp, Oryza sativa
tgaattatttggagtgatgatttaacatgtttacatttttaaactctaaaatttaataaattataaaattatagataagataacatgcttgtatgatgtttaaatgtaataattgttaatggatgatgatgtgatatattgttaatgtattatgatgtgacatctttgcatgttgagctttagaattagtgggttataactttatagtaagataggataagttcattattgtccctcaacttcacgttgagtcagtccgaggtccctaatctcaaataccagaaatcttcacctctcaaatgttcaaagccgtacaaaataggtcccatagcataggtcccatagcattatatatgggtggttttgctgacatggcatccgcctagtcagcaaagaaggaataaaaaaattacagagcccatatgccatttacagagcggtgccgcgccgtggagttgaggaagatcccgaccttggagaggtcggcgccatcccccacaacggagaggtgggaggagatgacggaagcggccaccagatcggaggcggtgagataggtatcttccccggagaagtacgagaaggggtctcggagaccgtgctaggtttgacggcgagggcgtaggtgccgccacgaccgccgccgctgccggcaatggaactaatcgatgggcgctggctgtggcgatgggaaccggcttgcgagaagaggacgcagagctagaggccatagcaacgtaggagaatggcatggccggcggtgaggtagttgcgaggatgaagcaggcgaagccagctggcggagcggtgagcggagcaagccgctcgccgccgcccgctgccgcgctcgcccgcagtcgctctcttctctgccgctggcgcccctgctccgctccacgcgggcgcgttgctctgcctactcgctctagactcttgtggtcttgccgccacccgcttccacatccttctctacggcgaagagaaagaaaagagaagagaaaagagaaaagagaagaaagaagggatgcataccccacatttttattcgtctcccttacatgtgggtctagattgctaactgggatgccatgtcagtgaaaacacccatatatactgatatgagacctattttacacggttttgaacatttaaggggtgaagatttctgatattggagattagggacaccacagactcgacgtaaagttgagggatggtaggggaacttattccatcatcatctacctcggcaagaacttgcccggcccactaactagaggcgcagctgggccaactattccctcggattgtgcggaccatttcggctgcccgtcttacactccacgctcccctcctcttcagaccaaaccctagctcgcaccgtataaatcggcgaacatccagcctcctctccccccgccgccgcagcagcaaggagctagagagacaaaggggagagagccccggggaagaagaagaagcagcagctagggcgccaaga

SEQ ID NO: 53408 - DNA, 1501 bp, Oryza sativa
gagatttgcaccatatcgaaaacaagccatacgagaagagctcgacaagcttctcaaagccggtttcatcagagaggtactccatccagagtggctagccaacccagtcatggtacggaaggccaacgggaagtggagaatgtgtgtcgatttcaccacctcaacaaggcgtgtcccaaggatcactttcctcttcctcgaatagaccaactggtggactcaacagccggttgcgagttgttgagcttcctcgacgcttactccggttaccaccaaataagcatggcaaaagaggacgaggataagacagcattcatcacgccgttcggggtattctgctacgttaagatgccattcggactaataaccacaggaaacactttccagcgcacggtccaaggtgcacttagtgaccagctcggaaacaatgtcgaggcttacgtcgatgacattgttgtcaagaccaagacaagcgactcattgattgacgatctgcgggaaacgttcgacaacctccgacgatatcgccttatgctcaatccagagaagtgcacgttcggagtaccatcgggcaagtgtcacaccttgaaaattcaaaatttataaattgttgtttaaaaggaatttttagaatttatttttaaaagtcttgaaaagaagatctaattttaaaaataaattccaatataaaatggggccagataaaatttcattaaatactttgcttaattctataattcctagatttttctgagatttatttgagctaaggaagtatttttaataaatggaattgcatttaaaaaataatttaaattgaaaaaggttttaaaaatcttcttttggctttgggccgaaagtcggctcaaaaacctctcttttctctctcctcggcccagccgacccagtccgcagccgcgcgcgcgcgttcggtcgctgacaggtgggtcccacctgtcaggtcgtcgtcttcctggcgtcggcctccgcccgaaaccctagccgccgccgccgccgccgttcctttccaaatccggccgcccctttccgtttccggccgaatcaatagaggggaaatgatctccgggatctcctcgaccttttctcctttggaatcttcggctaaatcggtttggaaaccgatgggttcgaggtcgattcggatcggctttgagcccgatctttccttctcgtcgccggtcgccgtgggccttcgccgccgcctccgagcccctttaaaaggaccccccgagctctcctctacccgtcgcccccttcgccttcgcctctcgtcgtcggagaagccctagcgccgtgcgccctagctcagccgtcgccgccgtcgctccagccgtgcgccgccgccgttccagccgtcgccgtcgctcgggaaggccaccgtcgggatcgccaagtcgccgccgtcctcgtccgttgcttcgccgccgtcggagaccgctggagcaccatcgccgtcgtcgaaccgaagagctccgccgct

SEQ ID NO: 53409 - DNA, 1501 bp, Oryza sativa
gattaaatattgttaagggcattaaaaatgatcgctgctaggcaccgtctagcaaactatgagcgtttgcagttctgtgtacacactacagcgtgaaaaacatggtatttgcctcggtgagccaaccactaacgtttttagtgtggatctagaggttcaacatctacaacgtccagcaaaagtaccaacataacacaaaaataatacttaaacaatgaagtgatatatttatatgtttcttttggtggaatcaattcacctgggttaaagttctagacacgggtgctagtatttagagctaattattctttcgatagctttgcgcacatgatgatttcatcaatctcagatgtacctgtgttcgtatagtgtttataaaaaatcttaaataaactcgtttattatattttgttttcatcgctatcccattatcattttgtttccgtgccgttttgtagggtttaaaatccatatgtaaataagtgatataattcagttgttaatatatactcggcatgacgctggatgataatccaacgatgatattgaagttctaagtttgatttctttaagaatattttatgttaccactttatatgtccagttagcaatcgtgaaaagagagagcgagacggaaaaagaaaaagaagaaactaaatccgctgcggattataatccgatgtacagctaagcaatcccagtagcaaagaaaactttttctagaaaaatacagaacctgtataatcaaagtggttttctaaaggtattttgagaaaactagtaaatcaaattctagtaaaattaaaatcttctgcggaattataatctgatataaagctaagcagggtcttttcaatagggtttccagaaaactagtagaccaattttaaaattaaaatctgcagcggattataatccaaaatacagctagggataaaaacggtacggatattttccgatagtaccgatacagcttctgtaaaaaaaagatatagttttcaattgtttctgaccataagatttattttttctaatttctatctgcataatattgctactaaacaaaacttttcataaataaaaaaaatcaaaacatctcaataccattctcataaaactaataaaaaaatacatcttttctaaccgttttcatccttaagctgtatttgtttctcactcctcccatccactgctctctcgttttcttcgagtactcaacaatgccttttatataaaaaaatatataaggaagttattttagaaattatattaatttatttttttaaaaaaatattaataattaattaatcacaatcatagtggatgtcttgttagaagagagaaaatagttgtaccctctaaagaaaaagaaagagagaaaatacagaatctgtcatagtgggctttttagcccaattaacctactactggcatccatgggccgaccacggccttgcaagttacaacctcctcctcggcccctcgctctcgccattggaga

SEQ ID NO: 53410 - DNA, 1501 bp, Oryza sativa
tgttgtcactcctcatccatgtaggcaccgcgacatctttcagagctgctggatcaaaagtaaatggttttagttaagggatctaagattcaaagttggaccaaatacatacagttcagtgacaatgtagtacagatttttctccataaacgatggtaccgtttcactgttttcctgcaaatgttctgtgttccccccctacaatgatgagcagctcatatgcagataaaattgcagcagcagagaaggacagtatcatgcatgtcttttctttgacctgtgactggctctgctccggtaattgatggagctcgtcctatgcgtgtacaagaccacgccagtgaacaccacggacagcggcaagtgtgtgcggagaaggcatggagttacatgggagacccacacaagcagccaaggaaatgtgcagcccacacccagtgctgtctcggtgaatttgtcattttttttcgcctaggaagaggcgctcccttgccctcgtttgcactgccttcctgagtgaactccaaaagaaaatttttggcaggtcatgtgacacggtcacatatcttactgtctaccaccagtgcagcagcgcagtgcacgacagtgctagctagctgctgctgctgctactaccaagtactcgcgagtcacaagatcgtcacagccaccgtcctgcactgcggctatagttgctaccatcctgttcggatcaatcataatcattaaccagttaccgattgttaagcaacaatgtgaatcaattgctcttggcttgttaactgtgatgcattccagttactgtcaatgccacagtttttacacacagctgtgttgcctgtttgtttctgtgcgaaacatgacagaggaatcggcacgttagacaggcaacggcacacatggtttgattgtgccaattcatcccacaaagtgctttgttcgtggcaagtagcactgtgagcatacatgacaaacgctacatgaaaaatggtacatcggtttgtatcggtagatgcctcattgccccaaaggccaacactacacccctaatgtggcaccccatccaggtcccagacggagcgtagttgcttgtcacagaatctttgggtgacctaaaatcccagtgcagttgagctatggctttggcctcacttggcctgcgtccactgttctggaaacaggatgcagaagcagcaccacaacagcacatgtggtgcacgtatggatttgtaataaccttttcaatataaattatttaaaaaggatcctcttgaacttattttaacctaaactttttggtagctgtaaaattttacggcaagtttctcttgtaaactcggttgactctcttcttctacagtgaattacaataactttgcccttttcaaaggttcttttagagtgttcgttttaaaattttaataaaaaaggttttacaaaattgtatgtattgttaggccttgccttggaacttctttgtgtttgtgcgtgtgaatcatcc

SEQ ID NO: 53411 - DNA, 1501 bp, Oryza sativa
gatcaccgacgcttctgtaattcgcgctttcaaatccagtgtcagagatcgctatactactcaagagttggcaacgaggcgcgtcacgactactcggagattattcgaaattgtcgatcgatgcgctcatgcggatgacgcactgagacgcaagaacgacaaaccgaagactggaggagagaagaaaccagccaaggatgcacctgagtcaagcaagaagaaaattcgcaagagtaggaaaaggaaagctcaatcggaagttctcgcaacagaatacgcggaccctcccaagcgcccagacccacaaggcagcgatacgaagaaagcatggtgccctatacacaagtcggacagacactctctagaagattgcctcgtcttcaaaaagtcgctcgcaaaacacatgacatcggaaaaaggcaagcgagtacacgtggttgagaaggatgctgaggcgcctactcaggaatcggactcagcatacccagattccgatcttcatgtctcacacatctttggaggttccacggcatactcctcaaagcgagaatacaagaaagtggaacgtgaagtctgttcgacgtggcagggggctgcgcccaagatgaagtggtccgagcagaagatagaattctcagaagaggaccaccccaagattgctgtcatcccagggcaatatctgatcgtagtcgaacccactattcataatatcaaggtcgcacgagtcctgatcgacggcggtagctcaatcaaccttctcttcgccagcgccttggacgcgatggggatcccacgaaacgagttgacacccaccgatcaacccttccatggaattactcctcagtcatcgtccaaaccattgggcaaaattacgttgcctgtgactttcggccaagcaaactacttccgaacggaacagatcacctttgatgtcgctgaatttgatacagcatacaatgccatcattgggagaacttcactcgcgaagttcatggccgcatctcactacgcgtatcaagtgctcaagatgccaggaccgaagggaacaatcactattcaagggaacgctaagctggcagtacaatgcgacaagtggagcctcgacatggtcgagcacacgcccagcctacccgccacagctgagccacccaagaaagtgagcaaaacaaacaagacgccgaagccggacggcgcaatcaagatcgttccactctccagtgccaaccccgacaagaccgtcaagatcggggcatcactaggcgagaaataggaactcgcgctcatcaccttcctccgcgacaatgctaacgtgttcgcttggcagccgtccgacatgccgggggtacccagggaggtgattgagcacaaactcatggtgcgacccgatgccaagccaataaagcaaaaactgcggagatttgcaccatatcgaaaacaagccatacgagaagagctcgacaagcttctcaaagccggtttcatcagagaggtactccatcca

SEQ ID NO: 53412 - DNA, 1501 bp, Oryza sativa
gtaccgaccccatcggctttatcagttatcctctgtccgatccatctctgccgatgcaaacgccaacaaatgccttcgcaaccgatgcatactctgttcttcgagtctatttcttcgccgaatccgcttcgattccaatgtcgaacctggttcatatcttaccaaatttggtcgttaacacggaggtattaaagatgtgggcgaagtgctcgcaccacagtgctccgggcgttttcggggcgacgtgctcaattccgctgatgtccacatcatccggcgctggtcctggaaattttgcaaaaacgtcctcgcttaacttgacaatctttcttaagtccctcaatgtaagtttactgtcttatgtattcttacgtaacggccatctgtgtcctagtatatcctacgtgaaggagacgaaattcctaatataggaccgcactctcagaaaatgaaaagaaagggttttttttttgaaaaagataacatccctatcccctcggttcgccgaaccctagccgccactgttccccaccctattctctcctccttccccttgcatgacggcgccacatcgtcttccctccttcctcgcttctcctcgccaacgacggtctccaatcgcgctctccccgcccccccatcttctacccctcttccgaatcaagcaggggaaagagaacccacacactcctcttctcagcttctcttaccttaagagcagtggcatgagcgagtcaacttaatctcaagagggaggcaagcaatctgtgctagggagtggatcaaagagggagaccgtcagtgggcagggaggggcgacgaagtcgcgagccgccataacggggacatggagggaagggtgctagtatgctacagagctcgcctatgtcactctttcatccttttcttgtcaaacatttgtagactaaaaaataaaaaaaacactgcattatttttacgtctaatatatacgaatctttggatcacctctagatcgaacaattatttaggcacaccatggataacaatcataaaagaaaaggcagaactcatagaagtttaaaataaaatgcaattcttcaaattttgtatattatgttaagtgcctcttgagaaaaataaaagacgagcctaaatacctgcagttaaagtaaataggacagcattgttttgcattcctatcagatgcatgataatacgttatgtatatgtgtcttagtttggccatatcacctaaaggatcctcgtttagcttatcttactagaaataagcaaatcctataccctacagttttataagtagtggacttagaatacatcgcaatatagtcatctagtttacttcaacatctaattaatggatggcttaatctggcacatactctggtaactggtaagtacagtatacttccttgattatataaaggttgttccattatgcaagaaaggaggcaaaacaaataaatacatagacttgcaattcctaaatatagttgaacaa

SEQ ID NO: 53413 - DNA, 1501 bp, Oryza sativa
tactattcattttttgggttgttttagtagtttctgatattaaaaccagctttatgaaataaaactttaactatgctgattccaactatttagaacacatgatgtacgcttataaactttggaggttgttgggctaatggctggttatcataatgagcaaataaaattcatagagccatttatgatcatcatttttgcatagtaccacataagagtatatatatgactgatggctgaagtttacaactcctgactaaaagcaacaactgattgacactaatagcaaagctgcaaagctctgtgttatgcaaagaagtaatattgggcttgttagtttatgaatttggtcataaattttgatcatacaaactttgctactttcaacatttatgtttctgttatttcagcagaagggaggatgggaaatgtgaataagcccataacttgctttgcattaagattttgattccatacctggctccatgtttagatgacaaatttcttgtgcactccggccattggagagttcaactgcttgcatggcagggcctggatgttcatcttcatgagcaccaaaacattggttgtcaggaagctcttcatcttcatattggaaggcatcttctccttgcacagcaggaaccaggttaaggtcagggatcccatcaccttcatcttgcagcacttcttgcacaccaggatcaaggttgagatcaggaatctcatattcctcttcttccatggattagttgagggtctctcttggtgtaatgatggagtaggttgctaatatgagtgtaatatgagagctttggtttttagacctgtgagtgagagcaagggagtgaaaatggcgggctggttctgagcatcaagtttaaattttgaacagctaatgcatgtgtatttgtggcgctaatgtgtagtgcgtgtgaattttgggcagcaaagaggtgagtgggatttaattgactcttgtcaacatgtgcattaatgtcattgtgtactgaggaatgcttactctttctttgtgccaatcatttgctggcaagcttgtaaacccaaatattctcactgctagtgcccagtactaagtaaatgaggggtacatgcgtcttttgctaacctccttattttggatgaacagtgcccagtcccatataatgtgggacggagggagtacaagttgtgacaaataatccaaaggctctaggatgaaacaagagaagaaaaccagaaatcctgtcctgaacagggaccaagatttgcatcttgcacttcagcagatgggaatcggaattcagacattcccagaatcccagcaatgaatgcttggatatatgtcaaccaaaactgacctagagatcagctgccttctggccacaaaataggtttgacggataagatgagcccataagctcggccaagaatatgtcgcgactcaattagtttgtttctattaatttccaggtgctacgcatccgcaggcacttccaatatg

SEQ ID NO: 53414 - DNA, 1501 bp, Oryza sativa
gttatcgtgctgggggctagatatactcaggccattcccacgaggacagggcggctacaggttcctattcgtggcgatcgacaaattcaccaagtggattgaagcgacacccacgggggaaatcaaggccgacaacgccatcaaattcatcaaagggatattctgcaaattcggattgccccaccgtatcataacagacaacggctcccagttcatcagtgccgatttccaggattactgcatcaggctgggagtcaagatctgcttcgcctcggtttctcaccctcagagcaattgacaagtcgagagggcaacggcataatactacaaggaatcaagacccgcgtctacgacaggctcatgtcacacgacaagaattgggtcgaggaacttccatcagtactatgggccgtgcgtaccacaccgacaacgtccaacaaggagacacccttcttcctcgtgtacggctcagaggcgatgctccccaccgagctacgacatcaaagtacacgagtacagaagtattccgatgaggatcaggaagagcagcgatacgacgatgtgaatctactcgaggaacatcgcgaacgagttgccgttcgagcagccagctaccaacaagcccttcgccgttaccacgagaagcgcatccgagcacgcatgctttcgatcggcgactacgtcctccgacgggttcaaagccaagcagggcgcaacaagctctcacccaaatgggaaggaccgtacacgatcacgcaagttttgcggccaggtgcattcaaaatcgcagatggcgatggtcgcgagttggcaaattcctggaacattgatcaattacgtaaattctatgtataagtcaatagtatccatacttgtaagacatcttacagcctcaataaagcctattttttaggtacagactacaatcaaagtgttccttttcgatgatcccttacccagatgacacctaacgttgaaacctatcctcatgtctctttacgccgtcttgacaaggcctccgaggaacctaagggaacttcggcggggacacccagagccgataaggccttgtcggatcctgtagagacgaaagaccatgtaagatctggttgtgtaagagttctcgccgtgcgtattaaccaagccgtgtaatcggaaataaactttccaacttcacggctgggggctaggatcagtgcttgttcaaccgaggcaggtcaaaggtccaagagccttatcttccgagaagaattctccgatgacaaggctggaggctagggagagtgtataactcaaacgactgatcgaagtcgcgaagtgagaagacactcatacacactacgtccagagtaagaaagcttagtaagatagatttcttttctattccacaagtatttcttacaattccatcaaaattcaaaactatattacactttttccaaagacatttgtcacaggatacggagactaccaggaaggacaacgctagtccatcgactgg

SEQ ID NO: 53415 - DNA, 1501 bp, Oryza sativa
agatttggatagagagatgggaggctaggcgacagcatatatatcttcataaaattaatttgttaggtcttgtctcattagaaatattctttttacaaaatttaaatattagaaatacaattattctaacggaggtaacaactacttcaaattcaaaatttatgacaaatataacaatatagtaattataaaaggtgacttcccactaaattaactatacatatactacacttaccatctcttgtctttatcataatccaaaaagttgacaagtttttatatcccatgataaccgtgttaacatggttatactactatagagagagggaatactaccgaacatccgatgacatcatggtcggctgtgatgacttgtacaatcaatgcacgtgtggctgagatgaattagcacaaattactcccttcggtttcattttaattgacgttttagacaatgatatggtctacaagatatatctttgacattatttttctattataatatatataataaataaatgcatgctttaaaagacatatatatatatatatatatatatatatatatatatatatatatatatatatatatatatgttgttctagttcctttaaactaaatatttttaaagttattgatggttaaagttataaaagtttgaccttaatcttgtttaaaacatcaattaatatggaacaagaggtagtaaaccaaaacaaaattattaatagctctaggagtctagctcatgcgtgcatgtcttccatgtcccatctctcgatcagcttgattaacaaaaggatatgattcattaagcgttttacaggcaagggtgacgtgaaggttttggggattaaatggaaggccagggactaatcaagcctaacatccggttttatagagtacagtatgtttaatcaacggaaaatttctttgtttgggccggggctttgagcgtgatgtgactaaaatgtaatcaattaacgccccattcttttatgtccatattttcttttggaagtagctatccaaaatctaagcgtaaaaatatactaattgcccaattgcgctggttataggttttgcacctattcaacagctgttgggttcgtttccatatgcttcattttattttttctgatattttcaacaaatacatcatcctttttataaatgacacaaaatatatatttttaagataaaatctattttaagccactgaatttatcctacttcaacgatttatcatcgattttgtctccctatgtaatatcccatgaactttgttggttttttttacaacatgacatttgggtggtagataattttaagaaatgactaaaatgtccttcaagtcatacaagaattgacaattgtttgaaccactaaaaagttttcaaaaaaaggtagtttttgtgtgcttaaccttcttacaaaatatagaagtttgtgtgtaaaattttctttcatgtttcgtttaaagaaactatttttatgtag

SEQ ID NO: 53416 - DNA, 1501 bp, Oryza sativa
atatccgcctgaccccaagtggtgatggtacttcttcttggcggcattttctttgtttctggccatcatcacttgcccttgttgccctgtcttgtaagcaacgaactcgtcccaatgatcccttagctttgggaatacgtcgaagctcggtgttaatcccttcaggatgtatttcttgtagagatctcccttgaagctctggaactgttttgccattttcttcagagtccactgtttcattatgttctccgtacctgcgggtagcgtgaacgtctcgagcattgtggttcacaacatctctttctctgagtcctagacaaagctgtcattatccccgcgtgcccttgttctgcgccagtacaccatgctgacaggcacgttgtccctcacaacccaaccgctgtggcgtacaaaattcttagctgcttctgtcggggcactaggtcggccgtctttgtccacctcagttatgatgtgctgaccctctatcttcttcgcggcacctcgttgtccgcgtgccctcttctgtccagcagagggatgacttccactagcctcctcctcatcgttcccctcctcgttcccctccgcatccctctccacgttcccctcctcgttcaagtactggtttggatcctcgttcccctctccttcgttccagtactggctgcttccctctacgattgtatcgtatagtatctgttcctcatcgcgatcagccatctgtgcatacaaaaaatatttgttaggtatataggatgtatttgcgtaccgtaatattaaaactctgctaatcttatattaaatctctaataatcttatattaaatggctactaatctcatattaaaattgtaataatcatatatatatgctaagtctaacaatcttatattaaatctctaacaaacttatatttaatctataataatcttatattaaaattgtaataataatatatgtatgctaagtataacaatcttatattaaatcgctactaatcttatattaaaattgtaataatcatatatatatatatatatatatatatatatatatatatatatatatatatatatgctaagtctaataatcttatattaaatggctactaatctcatattaaaattgtaataatcatatatatatatatgctaaatctaacaatcttatattaaatctctaacaatcttatatttaatctctaataatcttatattaaaattgtaatagtcatatatgctaagtctaataatcttatattaaatggctactaatctcatattaaaattgtaataatcatacatatatatgctaagtctaacaatcttatattaaatatctaacaatcttatatttaatctctaataatcttatattaaaattgtaatagtcatatatgctaagtataacaatcttatattaaatcgctactaatcttatattaaatcgataacaatcttatattaaaattgtaataatcatatatgctaagtctaaca

SEQ ID NO: 53417 - DNA, 1501 bp, Oryza sativa
aatagactcgaagaacagagtatgcatcggttgcgaaggcatttgttggcgtttgcatcggcagagatggatcggacagaggataactgataaagccgatggggtcggtacagccgattctgataaagatggcttcggggctgtttctagaatcgatcaatgtgcttcatgaggattgccacgatagagatagagctctgaacaaggcaattgtatctattaattaggatatttcgtgtaattttcttagagatatgtttgggcaaaagtctgccgcaaagacttatgatatcttagagtttgttagagataagagtcgtgtccggcaaggacatattttgtatcttgggtataaatatgacccgaactcaatgtaatcaacaacaacagttcagtaacactttcagtgcatcaccaccctttttactttcgttctatttcgacgagttcttactttcgggttgagctgcatcgattacgatcttcaactagaggtaaacttgtcatggcgccttgcgttctcgggattagtgcttccatctttatgacactctaatcttgtttatgtgattcgtcaagttatcatatacacgttgtaatctccgctagttgcgatctataacttgtcatcggttagaaagtaaccgatagagttatgttttgttattaatttagattatatcgtgtatctaccatctcttataggttttcatcatcttgcctagatcctatatttatatttacgcttaatgctgcatcggttgagttcgatctattaagtaatatctataactataatatctggcttgttttatgatcatcgagagatatagtatcggggtttcagccgatcttacctgatctagcttctttatatctcacatgcttgattgatatactagatctgccttttagattaagatcttattgcattcaagtatattaggctccttgtttgatatattctgcctgttctaatatcctagtttaaagtggtatcagagtattagccgatacatactggatctatttaatcggctatgctataaacgtctatataatcattgctttaatatatatttcgacttaagtgatttatactgtctcggcatagcgaccgatctatcccaatcacttagtttaaatatatatcgaaggaaggattatatgtcattaatatctacagccgattgagtagatttagttttattttatttattcatgactaccgatcgattccaatatgacatcggctcaaagataaatgatatgtcatcggcaactagccgatcagctatcatttatgaatttaaccacggtttttcttgtttttctttcttgttgattgtaggatcaaatcaactggcacgctcacgaacctaaaagcaagattttggacctgcacagaagttaagcagatcttccaggccagtgtgcgtttttcgcatcaacacgcttttggcacgtccggtgggactcaagttgcgacaacgtttcctca

SEQ ID NO: 53418 - DNA, 1501 bp, Oryza sativa
gaaggcgacgctgatgcatctggaggaatacgagcgtggcatccggttctgggttctttgattcggcagcctgagaaaacaagtgcggtgtatgcagagctggccaaaaggaacaaactttggtggccacaccccagcatcccagattcacaggaatcctttgttccttccttgtcaagcagcactaatcgcctattactactctactaggatgctctgtttgccagattctggactttgatgatcgactcttttcttcattctgtttcagggaacccaactagtagacattcttccaccggctgccataagtgagtgcgttgtaattgaatagtctagatagatcgtttgctagctggcttatccgtaactagaatttaaattttaaaacttaattttaaagttgattttgagaatttatcatatatatatttcaatattgtcttttaaatttactcctacaacagactcttggactaacactcccactctcagaaccgaactcgcaaagggggtctatcgattccccattgcagaagctccgttctccgatacacgtaaacattacgtcattcaaaactggtcattatactattttgggactatttagggcctgttcactttgatgccaaaaaaaaccttaccaaattttggtatagttgccaaaattttggcaaattttgacatgatttcttatatagttacctaaatttggtagcaaactaaatgtagccactttttttggcaacgttaccaaaatttggtaaggttgaaaatgacatcaaagtgaacaggctcttacaccgatttaaaaagctgagaatgtgttgtacttagttttaccgtagaaaaaaaatccaaaacgaagaaggaattttttttcctatcttgcttgttttgctgggccgatattatcttcttctatcaatcatagacggaataagttcatctgaggtctcttaacttgtcaacgtcgtgtaaaatgtggggcccaccatttttaaattaattttttggtgtaaactgatatgtgggcccacaatttttaatattttccaattacattgccacataagcgccacgtcatgtgaagaccgagtcaaaatagccacgtaggcgttacgtcagtgaaaaccgctatccaaaccaccatgggacctatattgcaccggttttaaaagttgagggacccattgtatctgtttttcggttgaaggacgaaaatcggatttgttgacaagttaagggacctcaaacgaacttattccatcacagactccgtaccccgggagtcagagttggcccataactgacactggcccgtaggccgtagtagcttatcggttaacaatctcatgggctcagttttcaacagatcctaacatccccgtactatacgagtctacgacgatgactatgctgcaaagcaaaggaaaaggccagtaaaccatatctttcgctttcgtccgtataagcacgaagaaaatgccaccaaacacgc

SEQ ID NO: 53419 - DNA, 1501 bp, Oryza sativa
tgatcccaaggatagcttcccgccattgaatcgttatggttttctgaggacgcccactttcccccttctcaggaagtggctccaacagcatataaattcatcatgcaactacccatcccacacaagttaataacttagagactagccaagtgtaatacatgtcccggtgctcaataaccgcgagcacggctattcgaatagatttggtttactcacattgcagtggatgtacactttacccgcactccgtgactgcccaacacatgagcctcgtcccaacacatgagacgcatcacgacaaagctttttgataacctcgcattggcagtacccgctccatgaactttacatcctcttgcactctaggcgtacacggtttctagcagtgagaggagttctggcgcacccgggaaagaaagactcacacatacattaagttataattatgtttaaattctctcatggcagtcctaccgatggcgacaccactgtagacacccgcctcgcggttctaccaatggctgccccaccgtagagcccctgcctcacacatcaagaaaccactatgcatggataatgcctccgctcagctatctattccgctaggtctatacccatacgagaagtgcggttgtacgagggtcgtttcatgcttaacttcatggctcggtccttaattgaccagggatggcactagcctttttccggataccacccaaatcctccatccgccccagtcgaaatcatttgtttagtttcattttcctttcacaaatcatgtcatcaatatcatggcaatgtggcgctcatgtctccacatgccgcatctcaattaccttcccaaagataattgcccaagcatatagcatttgataaatatgagtatgcataaatctagagtagcatttctaagcatttatcatagttgactagggacttttacgtaaatcatggttacaaggatttaagggtaaacaataatcaaggcatggcataatcacaagtaggatgttcatcattgcatgcaattttatttgtaaacaaaacaattttgcaattgggatcaacatgttcaaggaatagtgatgacttgccttgctctaggtcttgtgggtcttggtcttcatccggatccgcggctccctcggtctctatagttacgtgcgtaagaacaatttgaattcgattagaattcaaacaaaatccaaataatgaccgaattgagaaacgagcgcgggaggtgaattctatataggctactttattcgcgaagtggaattattcttctacctaaaatatttgtgtttcttaagaaattttgtgatttaaagtcatgtcctaagactttatctaattatctagtccttaattacatctagatcactaccgcgaattaatctcttatagagtttactaaaaataatctataataatctataagaattcatctaattgtttagttcttaaataattgatcctataattaaatgctagtatttta

SEQ ID NO: 53420 - DNA, 1501 bp, Oryza sativa
ttgcctaaccgatataaggtccctgatttctcaaaaattttagggcaagataatgtgtcaacttacgagcacgtcagccgattcttggctcagtgtggagagacatcggctgttgatgctttgagggttagattgtttcctttgtctttatctggatcaacattcacatggttctccgcattgccctataattctgttcaaggttgggccgatttagaaaaacagtttcataattacttctacagtggaacctatgagatgaagctttctgatttgacaacggttagacagaggcatgatgaaactgtacaggattatattcagagattcggagagatgaggaatagatgttacagtttggctttgaatgactctcagctagccgatctcacttttcagcgtttgatagctccaatcaaggaaaaattttcatctcagcagtttgaaagcttgtctcaccttgcacagaaggtaaccttgcataagcaaaggtttgcaaatgctaagaaaaacttcaagaagattaatcatgtgtatccttataggtatgattctgaagaggaggataactccgaggtagcagcagccgagtgggccaggagcaaaaagatcatagcatgctcatgggtgaagagttctaggaaagaagaaaggtttgattttgataccactaaggctgacaagattttcgatttgctacttcgggagaagcagattcagcttcctgctggtcatgtgattccatcggctgacgagttagggaaaaggaagtattgcaagtggcataattctaattctcatgctaccaacgattgcaaggttttcaggcagcatatccaattggctattgaaggtggaaaaatcaaattcgatgactcgaagaagccgatgaaggttgatggcaatcatttccctatcaatattgtgcacacatatgggagagcagccaatggaggaaagaatcggagttctcgattgaattcagccaagattattaataaatatcaaatgaagcatgacaagcagcaggaaaagtactatgcagaagatgatggtgggtttgatcctcattgggattgtgaattcttcaggttctgctggaatgaggggatgaggctaccattgattgaagattgccctggatgcagtggcagggcagggagttcaagccgatcttacagtagaggaagtcggctgagtcagaagagggtttctgttcatcagaggttgggcccggtgcaccaggatcattatcaggatgaagatgaaggcaggaaatcgcagtggtgtccttctggtattttcaccaaaaatcagaagagaagggttcaaagaatgaggaacagagaacatttttaggaggtacaacaagagatcaaccatcggctgaagaagacaaaacccagacaggagtggcgtgctaagagcacagttacagcagccgatgaagatgaagctgacaaggcaagaagattgatcaagggtaaggctactgcatcca

SEQ ID NO: 53421 - DNA, 1501 bp, Oryza sativa
tttcttttgcttgagagaagaaatctgtcctctcgtggtctttggtcttggtcattaagacgtccttccgcaagaaagaggggctccaacctggcatcaatgcacgtgtgatgttttgccaacctttttctctccccctatccgattgtaacatcttttccttctttcctagcatgtgtgtagatcggcttccccaaagactttaaaattcaaatcaacatcgtttcctataataaccctagtacacctgataactctcgaagagtgtttgataaactagggaattgtaatggaagacactaaaagtatagttaaatttgattaaattatattttcattgacacagttttcttttataccaaatatatttttaaaataaaattggatttcatatataattttgagctactgtttctctatataaaattgcactttttttcagtaaaaaaattgtattgtaggagtatataaatatattcaccaatttacaccattttgatttggacccaacataatctaatggtctaaatatttttctttttctctcattagtgtaggaatttctgacatctagagtaaaaaacatgtgcaattttttagctctattaataatataagtatgagattatcaagtgtgaattgaacggtgctacaataaaaagctagaattatattcaatacacaacacttgttttattttcatagatactattatattgtatttttgaccaatgtattttaaaataaaattttatttaatgtacaaaatttagcttctgttttcatagatacaactactatatcatcgaatcaacgttgttacgttctgaaccacgatcttatcgtctaaattgttttgttacctgtggttttgttttcagggctctaaagcaaacgttgtggtttacttttttttatatattttgaaaaaaagttcttttaacttttttagtaaggtgcagattgatattccctctgtttaaaaatatatatttaattttcacttatcccatacactcaataaaaaaacagaatacccactttaatcaaatctgaatgcatttactcattaattttacaaactccaataaaacaatcaattaaaaataaacagattttgagacaaattaaatactcccagatactcacaaattaaatcaattcctaagggcacccgcaatggttatcgataggctctctacaaaagatctatgtcagcatattttcctacttggaaaatattaaatagagagagaataaagctatctactaactcggagatagtctatagagaaaaatgaaacaatggattagagagctatagatacccatgtaaacatactattgaagtggtttactattaatctagtctattgctgagatgtacatgttctatagatagcaccttactttactattacgggtgctctaggttcccatactcgctgtagaccaaagagaacatgatgagtggagtatactgtgaaaactgataacaact

SEQ ID NO: 53422 - DNA, 1501 bp, Oryza sativa; identical to SEQ ID NO: 29411

SEQ ID NO: 53423 - DNA, 1501 bp, Oryza sativa
acaaaataaaaaagaagccagatctatttttttgacatctatatatccagatctaggagacaaaagtaatgtatacttgagattagttggtggacatgcatgcatgagatggaatggattacagtagtagaaaagtagcagcagctagctagccaagcagggaaagaaaaccaaatcggcatcacacaggtacagcagagagaacgaaatcaaaatgccaaaagacaactaacatatatataacatatatatagggagtggattctaatccctcgaggggatatcctctcgtataacttttttcttccaaattcgatgcaaatagttgtaaaaaaatctgaaaaaaattgacaatgtagattataatgatacctactagtccaccaaaattcatgttcaaattcgatctacacatcgagaaacaaaaaagaaaaatttagatataaacagtacgctactattcatacgctgaatttgtcttttttatatctcgacgtgtgagttgagtttggacttaagattttgtgaagttgtatatatgtgttgtatgaatgttgtcaaatttttccagaatttttcataaccatttagatggtttttgagcaaacgagggaacatcccctcgagggattagaatagtttcccatatatatacgattgttctacgagggaagaagagggacttaccgttgcaacttgtgcggcacagatcgacgaactgcgtgtgtgcgcttgcgctctccagtccacaacctcgatcgccggcaaagcaaactgtagatcgaggcagatcgatcgacggactgcgtgtgtgcgcttgcgctatctccagtccacaacctcgccggaaaagcaaactgtagatcgcgatgaatggacaagcaaaactttttcaagatgtgttcttggcttcttgcaagaatatatatatatatagtagatctaccaactgatgaaagaaatgatagatgatgcatgcataccgtctgttttgcttgcaacctctcacgagcggagagaagacccggacatctctgcaacctctcacccgcggccagctcctccagtagtgatgagatgagacatgagagagctcgccatggaccggaggtggagaacactggttgttgggggactcaagaacacaggttgctacttgctagggagcattcagtccggccatcgctagctgatgttaatgccaaggagctgcctctagccatgcagactagacttacctgaagatggaaactgcaccactgcccaaaggctgtagagaaaaaagatatggaccaaagaatactaagaatagtactgtgcagaactgcagcagttgccttcaatacagctctccctgcaacacgacatatacgcagcagccttcaactctctccccacaacttcggcgaggataaccgggtatgtaaatatggtgtaaaccttgactctacattcaaaaaacaaaattaattcaaacatgtggacgagatgatattacaca

SEQ ID NO: 53424 - DNA, 1501 bp, Oryza sativa
cgattatttttagacagacaggcttcgaactttcaactttcaagcgcaagctgccgctaggatggagggtgcaccgtgcacgtcattgtcagcttgaacctcatcagggattttgtctgatactcttaaaagtagagcgtacgtgcgtatggtcatggtcacgtcaagagaggagtatagaggagacggatccctcgtgccatcgaccagagaccgatcaagccatcgaccgatcgatcagagggaaaacctgataagcgcgtgggcggcagatgcgaaatcattggcgttcccctgtgggcgtggactttggtctgatggatcggctctccccctgcaacgcttcctctttcgcttatacacgccgatgcatgcatatgccgatcgagctgtccctcactcactcactcactgatgggcaattctgggctcttgccgcgcgcatctggtgatcgatccgcgtcgcgtgctgctgctgctgctgctacagccttttcgtgatgtttgtacgcagcggccatttactccgggtctccggccgtccggcgatggcattggttggtgtacactcctaccctggtggtagggctggtagcagcagcgggtcatctttcagtcactgtgcggtgggccctgcacgacagaggggacgaggtgggggcgagtggctggttgcccccaagcggcagcggcagcggcagcggggcatggggtggtttcattgacctccagagtggcaatcgatcgaacgagacgagtgaagcttttgctgccagtttggcgtccggatcacggccagtatgcgtccgtcccaagtggcctcacctgaccggcaaaactgatcacatcacgcgacgtaggcatgcaagcatatcccctcagcttttttcagctctcgtgtccaggactccggacgcccgctgtttcagccaaaacagcaccaacgcgtttaattttaccctgttcatggtttgacacgcagaacggctaactttaaaacttataaagtgctggttagttaagggttaggggagcaacgtgttgcatgcattgtgaaatagatggccttgctagatatgccagtactactagcttgtcacttgtggacgtgtgacccaccggcgtgaggcaggccggcggggttaggggagcggcacgcgcagcaccggtgaaagtgaaacaccttctgtacgtgcatgcatggctgcctttctgttttctctgctcccggcttcaccgtggggcctgtaaactgtgccctctcgtagtctaaggagacagggctggtcaatcaagcaaactacacattatcaaagcgaaagcgatcatcccatgcaaaggacagcaaggccgagacatactatgcacagtgcacagtcacacacagccagtggaatctagatttacatcatcaaaattactagcagtgcttgttactgccatcatgaagtgtaaaaccatccaggccggcagtctgtcggatcgggcgacgaaatgtatg

SEQ ID NO: 53425 - DNA, 1501 bp, Oryza sativa
aaagatcctttgttccaaacgagctgcttcaagccggacaatcttggagggggtctctgtctgaaccaacttttccagagcatgaagtttcgctgccggattcgtcgtcctctcaaaattccaaagaaaatttttgctggtctttgctaaaactctggtcgtctagttcatctcacccttcctacctatgggctggcacatctccaaccctgcactcaccattgggttaaatgcatgcacttggcttttgattcccaacgctaacccactacgtcactggcgtgacgaaaccaccatttcgtctcttggaataataaaaaggactctgattttggtctgcattggaattattattaccaggcttcctctcttgaccttctttttggagaggctggacaggttcatctgaacctgggggaagagagagagagagagagagggagagagaagcaaagcaaccttttgggaaaggtttggagatagatttgcagtttttgagtgggaattagtttgaaggtaaatgatgcattggattagtttctgggtgacgtggccatggagaggagaggtagaaatttattactgcctccggttttgtaatggatgacgtcgttaacttttggatatacgtttgactatctattgtatttaaaaaatagtaattattctgctgtgagttattttatcactaaaagtatttaaaatataatttgtatcttatatatttacataaattttttttaatgaggtaaatgatcaaacatgtatttaaaaattattgatatcgtctattaaaaaatgaagggagtcctactactcccccgtcgcaaaatataagaatctagaaccgaatgagatattttttagtattacgaatctgagtttttatattttgggacgaaggaagtacaatttaacagccactaatttgattatggattggaaggattagttaaaggcttcttttaccgttctgtgtacctggctacccgccttgaatgatgtgacacaaaagataggatttttttttccatggttgcagtatttgagtggcaattagtttatatgataaaagatgcatgggattagtttctggttgatgtggtcatggagaggtagaaatttcatgacaatttggtaacagccactaatttgattatggattggaaggattagtttaaggcttcttaccattctatgtacctggcttgcatgatgggactcaaagatgggttttttttttccatggatgctaatctgctagactgctaggagtactagtttaactgttgctggacgaaacgagttaaactagtttcgtcgaaagctgattttgattttgaattttagaatttgatttcaaactgataccaagggttttcttcctcactttggttgctatatcttttttccaagaaagtcaaaagggcaagtaaaggagatgcgaaatatacctaagattattcttacgaatcaaattaaaaaaaatcaaaattaactt

SEQ ID NO: 53426 - DNA, 1501 bp, Oryza sativa
tgacgtggatttaagaagtgtggaactagctggtgtgtcactccgggaggagctctctgtgaaacataacatcaatggtggctttattgttaaacgcatagctgatgattctgctcttgagcatctcggtgttagacggggtgacgtgatcttttttgagaacgagtgcgggactagtttgcctgaggtgaaatgaattctggtctcaagtaatagtttaatataaatcaatatttgtcaagaataatacaaatgtgttgtgatttctatttttaaaattctggaacagatcgaaggttatctcctttctcttggttggagatacctgcaggggatgaaaaagtcgatggttctcaaggtatggtattacacaataacaaaaatgccacttttttttttgaaaaaaattggtaaaaaataatcagcagaactgtcttccttgtgtagttggaagtacatgacattgaaggtccatgtgaggagacaattaccttacccttaaagttttctgtcgattcaggaaaggtatacttctctaaaccactgtacaattgtcctactttgcttgttttaatctctagattttaccccttaagcatcgacaaatgtgttgaatttaaggttgtccgctggaggatggcttgaagatgtacagcaagactagttagagcaaggtcaatagtatagcccaccgctgacggtaccaaatgccacgtcattttacagttagtgtaaagctaactaatacaatagattggctattgtgctaactacatagaagctattaaacaattaattttggatacacagtacgatcaagaatgtactccatctttgtagccatttgtgctgtcatgagcgtgagtagtctaccgatgaagaaaaagaaagagtttggtttttgctttcctagctcatctcccgcacagctttagattgaaatcaacaccagaaacagcaactaaaagaaaatgactggtggtttatccttttatccatctccattcacacggaagcaaaaatgagagaaaagaaaaaaaaacaagagaatagcaaagaagaaagatgggttttgcagctaggcaatggctgattcataccagagcaaaccgagcggtgggttatgtcgagtcacagattaaggagctccatccatacatcgattcgcttcagttcggaagggagggcgtcgaccccagcagcaagaactcgattttgaggtttgagaagcttgattcgtgccgagagaagatcgacccagcggcaagggcgtcggttcgcgtgcatgaggtcgatcagcgcgagctcgaaatcagctggtggagctctcgaactctcctggggtgaatcattgccggtgtagtgacgtgacgctggccaacattccggcgaggaaccaagcacatcggcgcacgccggagcggagaaggaaaaggcgaaaagcagaacataggtgggaacacaagtatgagacatgagatccgatgagtatagatagcca

SEQ ID NO: 53427 - DNA, 1501 bp, Oryza sativa
cgtgtggcagcccggggacgacgtgtccgtggtgagcgcgctgatgaacgcctccgctgccaacatcgccgcgtcgaacggcgtcgcgggcaactccaccttcgcgacggggcagcccgtgctgatcccggtgtcgcagccgccgcgttttcctccgctgacctacggtgccatcgccgccgatcccggagcgggcaagcaccgccacggcatcatcgtggcgacgagcatcgcggggtctttcgtcgcgtgcgccgtgctgtgcacggcgatcttggcgtaccggaggtaccgcaagaaggcgccggtgccaaagcacgtcagcccgaagctttcttggaccaagagcctgaacagattcgacagcaatagctccattgctcgcatgatcaatggaggggacaagctgctcaccagcgtgtcgcagttcatcgacaaaccgatcatctttagagaggaggaaatcatggaagcgacgatgaacttggacgaacagtgcaagctcggcagctcgtattaccgcgcgaaccttgaaagggaggtgttcgcggtgaagccggcgaaaggcaacgttgccggggagctgaggatgatgcagatggtgaaccacgccaacctgaccaagctggccggcatatccatcggcgcggacggcgactacgccttcctcgtgtacgagttcgccgagaagggctcgcttgacaagtggctgtaccagaagccgccgtgctcgcagccgtcgtcgagctccgtggcaactctgtcgtgggaccagaggctgggcatcgcgctggacgtcgcgaacggcttgctctacctgcacgagcacacgcagccgagcatggtgcacggcgacgtccgtgcccggaacatcctcctcaccgcgggcttcagggcgaagctgtccaacttctccctggccaagccggccgccatggtcgacgcggcggcgacgagcagcgacgtgttcgcgttcgggctgctcctcctcgagctcctctccgggaggagggcggtggaggcgcgcgtcggggtggagatcggcatgctgcggacggagatccgcaccgtgctggacgccggcggggacaagagggcggcgaagctgaggaagtggatggacccgaccctcggcggtgagtacggcgtggacgcggcgctcagcttggccggcatggcgagggcgtgcaccgaggaggacgcggcgcggcggcccaagatggccgagatcgcgttcagcctctcggtgctcggacagccgctgtccgtctccgacgcgttcgagaggctatggcagcccagctcggaggacagcatcgggattgggaacgaggtggcagctagatagatcaaaacacagcaatgggtatgtataacactgttgggtagtgtttggttgcaaggtttgggatggaatgcgatgggacgaacccacttttaaataggtttggtttaggggtgagcgggatgggttggtccctaaatagaataactcttaaat

SEQ ID NO: 53428 - DNA, 1501 bp, Oryza sativa
taaaaaaaaaagaaaaaaacttgagggtggtatactggggcactggctttgttaatttatctgggcttaggccccgtgttggggagtttctgggcactgtaagttgtcctaaaatccccttaaataaattagattctcattcagatttgattttgagttatagaatttagtaaaaactaaaagaagttataaaacttaactattatcagaagctgattaccaattaattatcctctaacagggcctagtcaccgttcgttcgagcagtgctaaacaaccgcacgtaaaacaagaaaactttttaggacatgattaattaagtattaattattataaactttaaaataaacttatttgatttttcagaatattaatttgtatatagaaagttttgcaaaacacataccatttaacacttcgggaaatattctcacaaaatacaagggagtagctaacccaaagtgctcaaaataactcagccttattcctttcaaattattcaccaaactttaaagcatattatttgctcaatgctttgaaaaatacattttctagaaaaaaatcttctaccacattgcgtagaccttgtgtttatattttaagctattttgttaagtgcatttatgaaaatattaattcatccaagtttaatctgcagtaacacttcacttaataatttatgaagttagtagcttttagttgaattcgctttaactggtagtatatatttgaaagtttggccattttatttataaaagttattatgctgcatagctttcgttcatcattgctttaaccttttaaaatttatcggtggttaaatgtaaactaataatagagagcattgataaatattgaaagcggttttgtaaaaggagagttgaaaaatgaaaggagtaaaaatcagatcgtgaactgcataaatgcaaacttgttcagtaatgaatatggtaatgtactagacagcttcctagtaaagccatgctaccactgtggtggtgctcttttcttttgaagatgaagattaagttttttacgtaaaatgagatggtattaacatatgattgattgagttttaattattataaaacttaaaaaataaattaatatgatattttagagcaactttcatataaaaagttttagcactaaacgcaccgtttagtagtttgaaaagcgtgccacgaaaatcttaattttcattcaactcttattggaaaaaagaacatgacctatgtatcaaaacaaagcatctttaaattaaaaatcatatgccgattaatcaacacaaaaacgatgcaaaaattgtgggaaattctagtgtgaaaaaaagtaaattgttgaattttttttaattgaatatcctgtgatgacgaaaccaattgagaagttggatttaaagatttttatttttcagaatggtaatggagaaatgtgcaagatcatacacgaattaccgattctctttgatgttctaatgtccgaggttatactctctcca

SEQ ID NO: 53429 - DNA, 1381 bp, Oryza sativa
atgtaggatcagtggcggaggcagcgtgggggctgggggggtctcccctaccccctaataaatcattagagcccctattaagaccccttaaaatttaaatccatatatctattgtaagggggctaaaatagattttatctaataatgttataaggcccaaaggctgagaaaccccactataattttatcctggctccgccactgtgtaggatcaggatatattggcatgtagcctcgtaggctgaggcaatttttgagatgataaatgttagattatataaacttctctaccttacctctatttggtattgccaatttttttataagactagagaaaatgcatgtgcgacgcaacgggtgaaggctattctaatcttataattattataaggtttagttcaggtaaaactcaccgttagaattcgcttggatatattattttagaaaatcatgagttgttattaggagtccaatcgtctcaagttagcatgcgagttttttttaagagatttctatgcgactcctttggtatttctaaaatcgaacgaacttaaaaaccgactcatatacggatgacgtaccaaagttctggcaaaaacatcttcagtttttataatagtagagatataaatgggagaagttgttctgatatcgtgcaaaaaataattgtgtgaattaatgtgccatttggaaaattgagccaatgtggaattaatatatgtgtatatatgggtattacccaaattttggtaaaattgtttggcatatgtatatactccctctccgttttatattagaagtcattttgatattttactactaaatttatagaaaaaattatcaacatctaaaataccaaattttagattcattaaatctataatatgtttgttttgggttgaaaatgctactaatttttatataatcttattagtttgactaagaaaaaaaatcaaagctaaacttttattcagaaacagagggagtacaactttagcaaatgtttgacattgacatgctttgatagaggaatagcagaacattttttttaccagcaccaatagtttcgaaaataaaccattaacaccttatcgatcggaaacttcaaacacaacaacctcaaactatattatactcgttagcatattccccctttgattaattctgtaagaagcaatgacgaagaagtatgtaattgatgatcattccaacccatagattattctcatacggaacaaatgactcggtaaaaacataattaaatcggtgaaacggtgtacatgtgtgtggctaggtaagagacaccaggtcctaaaaggtattagcatggactaaaaatatattttattaggataatgtcatcaaattgttcccctgcagg

SEQ ID NO: 53430 - DNA, 1215 bp, Oryza sativa
acccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctttaggatcgtcttttttttaaatggctttggacaaccaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggtccgctagtccgctgctgtttatttttgattgtcaggccttaagtgcctttgtaataatgtaaatatcatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaattatttgcgaaagttcctttttctccttcccctaatgctatttgcaaaaggtttactccgttcttccttcttcggattttcaactagtactagatgattagttttgtgaagaagaaggtgccgtcaattgtctgtcgaagctccagaagactgttggatccgtcagcgcagcaaaggaagcagtgaagccagatgtgaagcaagagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcctaatcaacctgcagaataagcaaaacaaacaacacatcaacaaaaagagttagttcctttaaggtcttgtccctagttctggtctattctttccttgtatgctccccctctcaacctctaccttgtgacagatggataacactggtaacaaaggctatgggaa

SEQ ID NO: 53431 - DNA, 1501 bp, Oryza sativa
atacagtatattttttcttttttatacgtacgtatataagttttgcatacttctctatctctactatttaaaaaattcaaaacatttcctttgtccgtccctacttgaaaaatcacatcttttatctatctaaaaattggaaaaaaaatcatattcctatataatcctatttcgtacgtatggtttttccgtttttcttttttcttcgtttcttttctttttttttctttccctttttttggttttttatttcttaatactatgcatgtatacaaactttatatacacgtatacaaactttatatactgtatatttttttctttttcatacgtacgtatataagttttgcatacttctctatctttactatttaaaaaattcaaaacatttcctttgtccgtccctacttaaaaaatcacatcttttatctatctgattccctaagaaaatggcaaaaaatggttagtgaaaaataaaaaaacgaatgagaaaaaaagtacaaaggtaggaaaaaaaatgcggcaaaaaaaactctgcttctattagtttctgtggtccctatatatatctctcctctagctctaatctaatctaatgtaatctaactacttaaaagagaagttttcatcatacaactaaaaaaagaagttttcatcgtacaactaaaaaaagaagttttcatcgtacaactaacaagaaaaaaaatacgcgagaaaataaaaacggttaaaaaagcgtgagaaaaaaaagcaaaaaaacgcgtgagaaaaaaatgtctgaaaaaagcgctaaaaaggtttccgtcatccctaaaaaataaaaaaatacatgcgaggaaaaatctattagaaaaagcaagcatgccatttctaaaaaaattgtttgaaaaaacctctcatgaaaaaaacaccatttatgaaaaacaagctgctctaaaaaaacggtcagaaaaaacgctaaattgatagacgcttgggtcggattgctcgattttttttcatcatctattatcagatataggtaatattcctgataacacatcatatagaaattatatttaaaagataaacatatttttaattgttatttagagaagagtgcacagtgactctattttgtgtagacttgaccatgcgagagaacgttggatttgattgatcctattattggttacaataatgagatcgaaagagtatgttagattatatgtatgttgtcacgtgaataatccaattattttaggtaaagcaagcattgatgatgtatgttgtcatcgtcgaggttggaccattacatcgaagatgttccaattttctaattgtcttagctacaaacgatccatacaaatattgtcattgacatggctatgtatgaaaaacgtatattgtcattagaatttttttcacccgttgcatcgcacgggtattttatctagttattataaaaatttaacatgtttttgccgaacttttttttacgccgtcaaaatttgtcttcgat

SEQ ID NO: 53432 - DNA, 1501 bp, Oryza sativa; identical to SEQ ID NO: 53426

SEQ ID NO: 53433 - DNA, 656 bp, Oryza sativa
atgatttatcagtataatttacttcgtgtcatccctccgtcttatactaaaagacatttgggtctgatctatgtcaaacttattaaagtttgatcaaatttatagaaagaaataacatctacaacaccaaattagttttattaaattcatcattgaatatgtttttatagtgtatttgtattatgttgaaaatgttgatatcttttctataaattttgtcaaacttaaaaaaattgactataggaccaacccaaaacgacttataatataaaaatggggagtaaaaataatataaaagaagaaaggcgtagtcaacaacagatttagaagaatgttcaccagagtactgaatttacaaagcacttgaaattgatttagatactatcatatcaaatctatccaattggcgcctttcaatgagaagagagagagagagagaggagtttgcaataatatgaggagaggagataaggatgatgacttaaaaaaagggaaaattggaaccatgccattattattttgcaaaatttgagatatgccatcctaacccacgtgtcattaactcatgtgggtcctacatgtcattgagataccgatgtcatatctcaaactttgcaaaattataatggcatggttccaaattaccctaaaaaaaa

SEQ ID NO: 53434 - DNA, 1501 bp, Oryza sativa
gagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttgcacttccgttatgatgtgtcgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatgtcgcgaccgggaaaattgccttttcccgaatgctagtgtattaatccccgtcccaggaaaagccggggtacaccatacaaacatgatataaaagacacatctttattacatcgatgatatttacattattacaaaggcacttaaggcctgacaatcaaaaataaacagcagcggactagcggacctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagggggtacaaggggataataatataggggttaagttttgcagtaaacagcatttaaaagtcacttggttgtccaaagccatttaaaaaaaagacgatcctaaagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatacacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggaga

SEQ ID NO: 53435 - DNA, 1501 bp, Oryza sativa
ttaccaattacttaaacttactttttaggcacaatgacggtttacttctacctttgtcttattgataatatatatgtgccaaaattcccattatcacttgtagagaaaccatctttggtcggtcgacccaaatccacagtagtcccggttccattaaaaaccggaattaaaaataatttttagtcccggtttataagaggaagatctttagtcccggttgttgttaccaaccgggactaaaaatcatctttagtcctgattggtaactccaaccgggactaaagttcatctttagtcccggttgattccatgtcagaccgtatcagggctcgaggatctttagtcccggttataacactacaccatgacactagattaccaacagacatctgtcggtaaagataaacaattattgatagactatttgttggtaaaggcttttggtaaattatatgtcagcaatactatgtaataagacatgttatatgttagcaattccaaatatttattgggtcaaaataactgtcagcaatattattaagagtggaaaccaattatatgtcaggaaaacttaatgataacctatctgtcagcaatgtttcgtccgttggatgttgatcccacggttaggatagagcgaggtgatcggtgcgcagtaaaataaaaaaagaagcgcaaaaaaatccgcgcaaaaaaaaaaaccacgccgaaaagaaaatccaccccaaaaaggaaaaccctaggctcgcaccgcgcgccgccatttctcccccttccaccgcgcaccgcctcctccgccaaatccaccgccgcggcgcgcggcctcctcctccgccgcggcgtgccgccacctcgctcctctctccccatccaccgcgctgccggagtcgacctcgcgcccgcccaggtttgtacgggctagggtttggggggcgcccgtccagatctgggggattgacttgggtgttggggttggtgttggttgcaggtggtggtgtgtgccgggtagaggaggaggaggaagcgagggcgtcggacttgtgcgtgcgcaggtccaggggcaggacgacattcgacgcggtcgccgacgaggtctcctagttcactctgcttgttgttgctgaatgggtagtgattatcaatactgatggactgcatttctcttgcagtttttccccttttgcctttgatttcttcggccctttcctttcaagttttgatacaaagaattcagaaactcatactatatgatgggtagtttcctctgtttagtcctgtatcttggaactcatactttatgatcaaagaattcagaaaaggatcatgtaactatccagtctagtatggactgtagttgtttctaactgctttccatagaaacttttgcaccctttgtggtataaagaattagaacaaatcataagattcttaagctgctaaggttaagtatcatgaccttcactagtaaatcataagattcctcctagttcactctgcttga

SEQ ID NO: 53436 - DNA, 1501 bp, Oryza sativa
taatactaaaaaatatctcattcggttctagattcttatattttgcgacgggggagtagtaggactcccttcattttttaatagacgatatcaataatttttaaatacatgtttgatcatttacctcattaaaaaaaatttatgtaaatatataagatacaaattatattttaaatacttttagtgataaaataactcacagcagaataattactattttttaaatacaatagatagtcaaacgtatatccaaaagttaacgacgtcatccattacaaaaccggaggcagtaataaatttctacctctcctctccatggccacgtcacccagaaactaatccaatgcatcatttaccttcaaactaattcccactcaaaaactgcaaatctatctccaaacctttcccaaaaggttgctttgcttctctctccctctctctctctctctctcttcccccaggttcagatgaacctgtccagcctctccaaaaagaaggtcaagagaggaagcctggtaataataattccaatgcagaccaaaatcagagtcctttttattattccaagagacgaaatggtggtttcgtcacgccagtgacgtagtgggttagcgttgggaatcaaaagccaagtgcatgcatttaacccaatggtgagtgcagggttggagatgtgccagcccataggtaggaagggtgagatgaactagacgaccagagttttagcaaagaccagcaaaaattttctttggaattttgagaggacgacgaatccggcagcgaaacttcatgctctggaaaagttggttcagacagagaccccctccaagattgtccggcttgaagcagctcgtttggaacaaaggatctttcgaatgatggctcctttgaaatataggaatttcacgtggaatttccaggtctttatctttcaaacattgggtcgtttggaatacacgaatttcatgtgtattttatgggggttctaatcttttgaacggctcatttaggatgcatagaatttgtaggagtttcacatgaaggctgtgttttcacgtcagaattgaaagtttggttgaaattggaacgatgtgatggaaaagttggaagtttatgtgtatagggaagttttgatgtgatgaaaaagttagaagtttgaagaaatattttggaactaaacacggtggaattttgcacggatttcattctcagaagggtttgaagagtaaggcggtcagcttcagtaaaattctcaaccaggtgccactgtaagaaaatccaggaaactaattaagcatcactggaagatcttgatctcagtgaaaccaagcagccgcttcaaatccatcaggaaaacaaagcaggcacaacaacacaggcaaaaccgtaagtttcgagctccacttcaaacagagaatcgacttgcatactgtcatactgatacagcacaattgcacaaacaagtgatgacatgattagaactcaaatcacacatcaaagt

SEQ ID NO: 53437 - DNA, 1501 bp, Oryza sativa
gtagatacaggaggatcaaacgttttaaagtgatacaaataactagcattagtcatcggatctataccctgtattggaacaattgcgttggtctgaccggcccaaggcccggtctgaccggcatcatgatgtgcggtcggaccggctggccggtctgaccgccggggtaatacccggtctgaccggccggctggccggtctgaccgacggctatgttacggtctgaccggtcgtcaggctcggtcggaccgaccatgaacgccgtcccgtcagtttaactacccattggatctataggagattgatcaacagtggtataggctttatcctttaatgtgtaatcatccataaaagagcctagcctactccttaaaaatccatcaaccttatccttaaacattacatctaatctatctttaaaattaaccatagataaatctattgtagatgcaatttgttgttggatagattgtgatacctcgtcattacttaccatgtcgggagcgagcttgggacgtggcccgggcttgatgatcacgccttgacgagtcctagtagtagctctcatcaatgcctcccgtgtgagctcgttgatgtactcctccatagttttacgatcttctccttcgaagtcatccaatgtgaccagcatcacattagatggctccgcctccgtcttggatgatggcttcgtcatggcgaagtcgaagttgagttgacgatgaacggatctcctccccagcggagtcgccaaaaatcgtgttggcaactttttgtgacaagtcgacaagcacgatcgcaacacctaaacgccttgcggtgatatgaagtcgccaaccacctcgatctagccaaagggccaaatcaagatgggttttgtaaaaagaaaagctaaaccggctagcgaagccgatttagagatcaaaatcagcctctaggccgatttagatcgatatgaggataactacccgtctcgtgggcaaaacggaaggttttcatgacaaacctacaaagaggtgtcgcactctcgcagcggcggcggacggtttatggcgcaaaccgacaaagatggactaaaactagggtaaaatagaaaacatagtaaaagaacaattcaagtagattgtattcgggggttttacaatgaaccggccttctcccttgaataggggttggtcttaccctctacaggcccttctccacatccaactcgggatagaaaccaaaggaaacacgaacctgccttcccgagtaagaaaacacgtcactttccaaactttggcaattttcccctatttcgtccataggtgccaaatttgggtataaacactctccttctagttgcttctcattttcttaaaattttaccaccttatctcccaggttgccttgatagaagaatgcttgggatcctttgtaatctgggtttgtaaaaaacctgtattgctttttctctactctccttaatgaaattggcagagctcctgccgttgacccctca

SEQ ID NO: 53438 - DNA, 1501 bp, Oryza sativa; identical to SEQ ID NO: 53423

SEQ ID NO: 53439 - DNA, 1501 bp, Oryza sativa
gaggcaaggtacaccaaaagttgatacaattcagagtttaacaagcggaagcgtaaatataattattacacgggcaacaacggcccagcacacaaagacaacgaaaaacagcggaagactagggcgacgaccacaggcacttgacggcaggcacgagctagacaccaaagccttcatcttcaagaagctcctcttcttgacttgggaaaaattgagcaagactgagtacaaccaccgtactcaacaagacacacccacaaatgcagaataaatgcaagggagtacaagggaataataatatagggattaagttttgcagtaaacagcatttaaaagacatttagttgctcagggctattttgtaaacacgatcttagaactacacaatattattaatcaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagccataaacaagagtaccgacccactcctgcctacggccgggatacccgggacaggcaggcagaactgagccctgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaatactagggcgacgaccacaggcacttgacggcaggcacgagctagacaccaaagccttcatcttcaaggagctcctcttctggacttgggaaaaattgagcaagactgagtacaaccaccgtactcaacaagacacacccacaaatgcagaataaatgcaagggagtacaagggaataataatatagggattaagttttgcagtaaacagcatttaaaagacatttagttgctcagggctattttgtaaacacgatcttagaactacacaatattattaatcaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatct

SEQ ID NO: 53440 - DNA, 1501 bp, Oryza sativa
ttacggtgtgctgcaatgtataggggccctcgtaaaaataaattggttatgtagtagtgaacgaacgatcaaacgtcgtgattgaaattcgaacggctgcttgtatatataagaaacgaaataaataaacaattggaatcaagatgttggtacatgaatcgtaggtctaggcatcagtaatacggccatgtatatcacctggagctagtagacatttatttattttcagtttgccaaacacacagtagtaccgtgagttctaagatcacatctaaaatttataaattttttatccatcgtttaattgttatatactccatccgtccataaaaaattaaactagtacacatccagtattacgaatctggatatatctctattcagatttattatactagaatatgtcacatcccgttctagatttattttttttaacgggaggagtagtattttaaaattttgatataataatatgttaaactggttaacggtgtgattttatgaactttaaaaccacaatacctatatagctacatgtcacgtactaaaatccctataattttatacaacttagataataataggtgtgattttataaaatttgttaaaaaaaaataaaaggaatccgatatgagtgggacgaagatatacgagcttgttaactttgttgatatttatatccttaccattttttttaattattacaaaccaaacatactcttaccaatactaccttactaaattaaattaataatctagaagtttctaatcttaaaaattctactaaattgtcagggttacgggtcaggcataccctctacccctcgatatacgtcatgtatcgacatggcatatccacgtgtacacgaatagatcttttggcatctaaggaaactcttcgtgaaatcaatggacggggagagaccttctcggacaagaattgggttacctacgtatcgtgtcaggtctggtatgttcgagtcctactcggagagcacccaacctgcggtataaaagggaccccccggggagggcatagatcatcgaatctcagagtcaacataacccacacagcctatgaagtcggagcctgcaaggagccaagtcgacgagagctagtcgaatcatctcgactacaatctcgccgaatcccccgagttccgtcttttcctttgtaatctgtgttttccaccatataatcccatatcaactggattagggctattacctatcaaggggcctgaaccagtataattctcgtcttttggttgcttgatgtcgtactacgtagatccttataccagcgtaccccaataccctctatatccggtctacgggtatcccccgtcgacagtggcgcgccaggtagggggacttggtattcaaggttctactactatgccatcaagcttcgtcgacaacaacgccaacaccagctccgctcaagttcttcctacctcaacaatgctggtatggactcaagtcggcgaaatcgtctacc

SEQ ID NO: 53441 - DNA, 1501 bp, Oryza sativa
ttcttttgcacaatttcgaggatgaattttagagtcgatttgggacgcgacaatttacctttgttatgaccttattattattgctattgttattattaccttgttcaccctagaataaacaaaaccccaactagtggacattatattcatggttccactagtatgaatttaggtagatgcttcgctgtttaataggacaacattaggtggtttttataactttagactttgggaattctcatatcttttggacactatggaattgttggtttatgttggaattggacacacacctccccctctattcaaaacccccaaaatggttttaggctgggctcgaggtgcgtggttgggctttgttagtcgtacctcgggtactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtgtatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctttaggatcgtcttttttttaaatggctttggacaaccaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggtccgctagtccgctgctgtttatttttgattgtcaggccttaagtgcctttgtaataatgtaaatatcatcgatgtaataaagatgtgtcttttatatcatgtttgtatggtgtaccccggcttttcctgggacggggattaatacactagcattcgggaaaaggcaattttcccggtcgcgacatgtttcttgtatcaacaga

SEQ ID NO: 53442 - DNA, 1501 bp, Oryza sativa
cctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtattccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacagggctcagttctgcctgcctgtcccgggtatcccggccgtaggcaggagtgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtcaagaagaggagcttcttgaagatgaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgaca

SEQ ID NO: 53443 - DNA, 1501 bp, Oryza sativa
ttatattatatctactctatacaataaatcgactcaagatattagaaaaactattttcatcacctccattttctttcactcatacccaaaagggcaacaagcgtggatctcaaccggctatgttgaaataactatggcaggagtacgcattgttgagttgaggtggtccgagtaaaaggttattgttgacaatagagctcaactgacctatttacgaatacaatcctttacaaaattatactccacacttttcttgaggagcacgactatatcaatgcgggaccatgagtcaaggcatcgaaggaaaaagccttagcggctacaatcggcttcacccagcttttagaggggtattcatatatgatttttttcttattaattggtagaagcagtatttttaaatatttatatatagatttggatacatgtgagacatggtatgaagtagagatgaacttttttttattaatgacacattgggtttatttttaggtatagatgtaattctatctattaaaatgacatccatattttaagacaatatcatttagtatgtcaactgttaacatctatggtctactccctccgtcccaaaaacaaacccacttcttctatattcaaacccagaaatgggtgtccacatccaaactcaaaagttggtcttataatgaatatggtgagatagggcttcttttagtattctttttataaacagtaaataaattgcccgcacatgtgtgcgggctttcttcctaattatatatataaatggtataacaagcttattaagaagcttctaaatagttcatcaataatgagttgtttaaattgtttagaggagtacaatacctagcaccgttacacgggctaaaacttttatactacctctgtcccaagataactataattatatgttgtttagcatatattaaggtttgagaagaaagactatggtgcccctcattaaatagtgtttatgtgagagtggaaagatggttgagggtataatagagataaatttaaatgagatgattgatggggcaattagtactctagaattacaattattttgggacaaagtttgaatcatagaaatacaattattttgggacggaggtagtacaaaatacttactaccataatgcttaaccattcaatttactcataaatattgtttggaatttctctgcgtatatttttttctttttagagattgtttgttttattttcataattaatagaccgttacaatttttataatttgcattaacattactataaaaaaatcgatgaaagattagactcgaaggaaaacgaagagtaggagaaacctcttcgttaagaaaagaaaaccaccgacgagtccattcgttttcatcttcttcttgttcttgtactaactactcctaactcccaccacctccgcctccgcgtcgccccgccgcgcgcctcctccccgcctcgccgccggcgcgcacctcctcgcggatcgcgatgcaca

SEQ ID NO: 53444 - DNA, 1501 bp, Oryza sativa
cgtcatctattaaaaacgaagggagtatatttttagaaaatcatgatctacaggaagtccgatcgtcttaagttagcatatgagtttttttaaacagatttcttatatgagtatgattccttatgtattaccaaaagcaaacgaacttaaaaaccgacccatacacaaataccgtacaaataccgtagagatatagattaaaaccaaaacataaaattaaaaccgactcaaacacagataacgaaccacggaaacatcttcaatttttataagcgactcaaatatggatgacggaccgcggaaacatatttaatttttataatagataatagattttcaaccacaccaaaatttaacaattttactatatatttatcggtaaattttcttttaaaaatttgacagatgtaattacattacatagtgtagcacaatgtaacttgtatataactttcatccgttagattttgtttcaagatttgtgcaagtgaggaaggaaaaaagtcagagcacgtatttatgagaggattcgttcccacgaccttctatttcaccgaaatagcatgttacggagagatttttttaaattacatacaagttacattgtagttacatgcaaattacagtgtaattattttacaattatactataattacatctgtcaaatgtataccctctgtcccagaaaaaagaccaatcctatctacgaatttagacacgtgtatccaggttcgtaactagaatttattttttccaggacggagtagtaggtgataccaaatttaatgatagtaaattttagcagattcaaattttgatagtattaattattgtgtttagtttcaaatgccatgtgcttctcgagcgactttttgaaaacaaagcaatcctccagagaatgtctatctgttttgtgtatggggcaccatgatttctttgtgtcgctgccttgtgggtccgggcgcttgggagggttcgcgtattctgctgcgaggacttccgcttgagctttccttttcccgtttttgcgatttttcttcttgctcgactcagatgtgtctgcggctgacttcttctctcccccagtcttcggtttgtcgttcttgcgtcttagtgcgtcatcgacgtgggcacatctttcaacgatctcgaataatcttcgagtagttgtgatgcgccttgttgccaactcctgggtagtgtagcgatctctgacaccagacttgaaggcgcgaattacagaagcgtcagtgatctcggggatggtgttcctgcactcgttaaagcgcctaacgtattccctcaaagattcacttgagttctgtgttaacgcgtgaagatcgtcttcgatcgcgtgacgcttgtatgttccttggaaattggcgacaaactgatgccacaggtctgaccacgaagaaattgagtaggggggagatgcatcagccacgaacgtgcagaacccttcaacgcggttggtaaatagtttgccaatgcattggc

SEQ ID NO: 53445 - DNA, 1501 bp, Oryza sativa
aaagatggatttttttcctagaaaaaataatcttgccaaaaatttaatattttttaaatgaaattgatccattgtatttttgttaataatatatatatatatatatatatttttgttaataatatatatatatatatatatatatatatatatatatatatatttcttgatttttctgtgaaaaatggagcatgtttgtatagtacaaggttaataccttgagtgatcttttgtaagaaaaaaaagaaaacttttccattttctttagctatgatattttttttgagattgttcttgatacataaatttattaaagcgttttacaaattgtgcaagcacaaaacccttccggttgtgttcgatagtagtggattaagagaaagtctcttttttcacgcgcacatcaccgaactactaaacggtattttttttaaaaaaaatatgtatgaaagttgctttaaaaaattatattaatctttttaagtattaaaataattaatactcaattaatcattaattaatggctaatatcattttccttatattttccatactctcatacacaccataaattccaatctaaatgagaactttagcatatgaaacatacggtcatatatagcatcatgccacatctagatttgaaaggacaacaagaactaaatggaaagtgttaagctctcaaagaggtatgcgccttcattcattacaagttttgtgtggtgatagatgatactacaatctacgttattcagttccttttgatttactacaatatttagcatcaaatatatcacaaacctacatatataaataagctataatattgcaaaactacatgtttagtcgcaaatttatctttaaaacaacatattttagagatgaaaaacaaagcatatatcttcaatgttgtggattcagtgaaaacctgtagttttggtgtattggcactcaaatctatgcttatgtgacaattctttgaaaatacggtagttctgtcaaatttaattaaaagagttttttttcagaaaaatagatgttatggttgaagctacagaaacaccagatattttgacttgacatataacccctgatgttgaggtcccaacttttttctctaaaatatcttatatgtattaatttaaattccaaacaatacggcatgctggtagatatttacttaatctttcatgtcaataaagtgtatatggaattttgaagtagatatttacttaaggaacggatttattaaaaaaatgtgaacgcctggtgttgaagcatcaacaacagatatacagtgacatctgctgcaactgtcactcactcccatatactgtacaattggttggttgttaaaacttagacagttgctgatgcactaacaatgcatgattatcacaactcataagcgcatcattgtacacatatacagatggaagttttggcttgactgcactcgcagaaaacaactacgattaataagctaaataaaggaaacaat

SEQ ID NO: 53446 - DNA, 1501 bp, Oryza sativa
agagccatagagaaaaagagaagacagtggtggcctaaaatcctagtacccattttttttactaacaactttacttaaatacatatcgatccatataatttaaatcgatttcttaaagaagtgatttcaacggttgtttatgttgttgatctgaattcgtttgcaaattcaatttcttattgcctcttatttgagattcgcgatttccagctattcaaactgccagttatttcctcttattttaaagaaattcagttgtttgccagggcggcgggccgcggcacactgctgctatgcatgctatcaatactactaatctcgcgacgcaaaactgctgccgtcatgtgacgctaatatctcgcgcgcggcgcggcgcacacgcacggtggcggtgggaggcggtcgaccgtacggaggcgcggtggcgggcggcattgagccgagcgcgcggcgcggcgcggctgctgctcagctcggcgagagctgcgcgcttgccgaggggagcgccgggggtctccgtgctcgacgaaaatgcccggtgcccccggtccacccggtaggtgttcgacgaaatgcgtgcaaggggatgggccggcgccttttccccacgctcatggcgatggcgtggctttctcggcccagccccgaggtgccacgccgaccaccatgggccgtcgtggcgcaagcgctgggacctgcagagtgctgctggcctggctgatgcatttcacagttcaagaaggcgccaggtatgctatgcgtgcctccccacccacccccagctgctcgtctctttgctgaattgcgtcttgtgctgctgtgatgcttcgttgcttgtatatactaggacttgttttatatcatttggtaactttgggagggttctctggttctttcgtggtcatagattagcaaaagaattggattcaaaaaggtttaaaccaatttatgcttttatttttcatgttagggccttaggtggaagacttaggtgccaaagtcttcgacgcaaggttgctttctagtggcaactgtgggttgttagccctgactataaaacaaacaggtcactgtccctattctaatctcgtattgcaattagtattaacttattatgcaataatgcaacttggggtttctttggactaaagagaaggggggattggcaactcgtgcaaatgtatttggcacatacaaaaaatcggcatgacttggattgcactctaaagacctatactgaaataattaaagaatcgagcaacggatcagagtggcgtgtttgttgtatttctgtaagacacttgttatagtaaactgctttcctgttactcatggagataagctagttgcctaaccaatggtagatgggagcagattaattattgtttagacagaaatgggccttcaaaccgtgtcataattgtttcatctagtggtgccaaaaaccaaaaggttgttagaaagaatcgtctgtgtgctgaagaaatggcccccacgacag

SEQ ID NO: 53447 - DNA, 1501 bp, Oryza sativa
  unsure (1)..(1501): unsure at all n locations
aaagtatggggtcgcgtcaacgagatactacttggctctaaagaagcaatagagttacagtcatttgaaagagctaccgagggacaggcgaataatttgaaagagaatatacatatttcaactttgaataccaacgatacaacatgtagtatatgtaagaaataccatggcctgctcacaagacctagtctaagtcaacactatactatgcatagaggtcaccccatcattatctatcagtatgtgatgtaaagtactaatcagatatactcccattgtttcatgttgtaagatgttttttttatcaaatatagtaatatttatattaccaaattagttttatttaattaatagttaaatatatttttataataaacttaccatgattcgaaaatattactatttttcctataaacttgaaacagtttgtctttaactaaagtcaaaacatcttataacctgaaacggagggagtatattactatctccatatcattttaagtgtagttgtaggttttggtgtccaacgtttaaccgtccatcttatttcaaaaatttatgaaaaaataaaaaaaatagtcatgtactattcatgttttatcatatagtaataacaataaaaatactaatcataaatttctcaaataaacctgtagttttcaaataaaacggatgatgaaacgttagatataaacctgtaaaactatagtctttttgaaagaggggtagtactaatagtatgtttatgcaacatttgtagttttgtactaccaacttgcctcctgcactagcctagctcacccatcccatcctcgagccaacgcaacaatctctgttagtgaaggccgaaagacagggacacctttcttgtattcctccgaaacctttacttgctcttgcaaaagaaaaagaaaaagacattttattttccatgtaccttcaccgtaattaacgtgtaccactacatgcatgcagtgacgacagtcagtagcgtgctccacgaactgcacccacacgattggtcgattcatttgaccagaacgggcaacccatcggccgcgaacagtataccaaatccagccatattaattaaatctcgctcttaattgcgaagcttactccattgaccgtggttaatgatccagtcttcaccaaaccgtttcatccattctcttttctggatttaaatctaagcgaaatcttttgaaacaccatcaaatcttggacaaaaatttgtgcgaaatctgtgaagttggtaaagttttccaggttnctttttcccccttgggggccttttttttccccccccccaaaaaactcttctttttacgcagncgcagcaagcaaaagccaaaaaaaaaaaagaaaagctagctgcacacactgacaagctcatcactccaccagccagcttgagctcgcccacttccgctcacaagaagcacaaccgcgagctaccacagcatcggatcgagggcgagcggcggcggaggcggcggaa

SEQ ID NO: 53448 - DNA, 1501 bp, Oryza sativa
tttggcgcctccacctgcatctcacgtcgctggttcgtcatggaggacgacgaactgtcggccagtgtgccccttttgtgaatgatatgatattgttgtatgataaattcttgccatccccttttgtgaatgattgctatatgagatggtgatgcggtgatggaggatgatgaactgtcagtgattgctatattgtcaatttgaggttttggcgatggtgatgcggtgacaatgtgctccaattttcttgctagggttttttttacacctgtgacgggttgcaatctatttttctttttttttgctggattatagacatcactgacggctcacaaactaatgggccgtttgagataatagttacctgtgacgggttctatacgtggcccgtcataggggctggtcaccactgacggccctttacccgtcaaaggtgaagagagtcatcactgaccactaatctctgtcgaggggctgaatccgtcagaggtgatggtttaggcccgtcacagctagcatggtccggcatagtgattggaagctatgtagagatggagtgtagctcacttactgtatgggctagttttgattattagctgcaacatgctgacatggtatttttgtcaccggtagctagcgctactattgaccttcctctaataggtgtagtcattaactcataactctagcacaacacgataagtattttcccaattagaaatagatagaataccagccagttttgcaccattgtgccacgcggccggccacaacccgcacgaaactgcaaactgttgttgtcatttagcggtatgatctcgaggcgcaaacatcatgtggcagcggtggtggccgggtgggaagatgtacggaaacgcggtggcggcattgagcagagcgcgcggctgctgctcagctcgacgggagctgcgcttgccgtggggatcgagtcccgggggctttggtgctcgatgaaatgccccggccaccggaatgcacgaaagatgttcgacgaaataagtacgagaggatgggccatcagctctcttctcatggcgaattggcgatccctcctgcgggacctcgccgaaagtgaactgtcggaatcaggagaaataggggtcaggagtgggggatcctttctcctaatgatcgaacaaagccgttttgcttctctaaccaggaataccaggtctgatgtccttttcagcgagtagttgtacaactgagatataatccttctcaatggcaagaggcaacaatatcccagcactaccatcgatttttagaagcatttttagataataaaaatggtttacatgtctccgccttctgtcataaggcacacaaaccaataatcttctcctggaaagtaagagctagagaaggctgaaagtaaagtaagatggatgtgacagattgttaggaacccaattcttccaattcaatagcaaggatccaccatacaagcaaccattgttttggggtgaaaaagagaaga

SEQ ID NO: 53449 - DNA, 706 bp, Oryza sativa
aaaaaaatgtcttgatttgcacacctcagagtcctgcagaacaaaaatgagtagaggtgccatatccatttggttaaatgttccatttggggggaattccacctttctggttctgttttgataaccaatgtggaacaaaacacatcctgttgattccattagatatattgcataatcaactctttatatttgttgattcgatatgcataggaaagaaaagtgtcatgcttttgcctacttgctacttttgtcctttgtctttgctcatgtgtgagaaattccagatatccaatatatgttgctgctccctggtccccagggtgctgtgccccctttctcatattgtgattagattgtttccattcaccggatgacaatggcagtcttggcatgtgaatgatgtcctatgcaataatggtgctttggtctctcatgggcattgattccatgcgcagtttgtgaaatattattgcacataatgttactaacttgccttgttatatggtattactggccacacaaaatggacatacaagtttctttcaagtttcaactcctaatcggccatctcaaggaacattttattgtgattatgccgtacattttctattgaagcactccatcttttgaatagagaaggaagtgattcttagctttggaaaatagtaatcatgatgccagtgatcagatttaatattttgaacta

SEQ ID NO: 53450 - DNA, 1312 bp, Oryza sativa
agattttcttttctaaaagactatataatcctatacacttgttaaattttgcaggaaaaaatgtatttggagagtctactcaactgagcgacatgtaggacaaaaaagctaaacaagtcatcaaagaaaaagaactaataggtatttatttgtgtgatatatgattaaaatcagtcttcccaaaatgcataaactcaaaattacataggcacacaactaatattacatatgtaatttcagtggaataggactgtaactacctatattttcagattttcttttctaaaagacaatatattcctatacacttgttaaattttgcaggaaaaaatgtatttggagagtctactcaactgagcaacatgcaggacaaaaaagctgaacaagtcatcaaagaaaaagaactaataggtatttatttgtgtgatatatgattaaaatcagttttcccaaaatgcataaactcaaaattacataggcacacatctaatattacatatgtaatttcactgtaattggactgtaactacctatgttttcagattttcttttctaaaaagactatattttcctatacacttgttaaattttgcaggaacaaaaaagtttggagagtcttctcaactgagcaacatgcaggacagagcagctgaacaaatcatcaaagaaaaagaactaataggtatttatttgtgtgctatatgattaaaatcagttttcccaaaatgcataaactcaaaattacataggcacacaactaatattacatatgtaatttcagtggaataggactgtaactacctatattttcagattttcttttctaaaagactatatattcctgtacacttgttaaattttgcaggaacaaaaaagtttggagagtgttcagtgttctcaactgagcaacatgcaggacagagcagctgaacaagttatcaaagaaaaagaactaataggtatttatttgtgtaatatatgattaaaatcagtcttcccaaaatgcataaactcaaaattacataggcacagatctaatattacatatgtaatttcagtggaattggactgtaactaactatattttcagatttgttaaataaaaaacttgcataaactgaaaattttatgaatattttcaggtttgtttacaccaagagttacctacagcccacaagcactacatgatgagttaacaatgctcaactcacaaacgacacaggttggtttttataaaagcattacaaaaatctatgcaattcatattaatttctattatactaacattgaaaaaattgcagccgggaaacat

SEQ ID NO: 53451 - DNA, 1501 bp, Oryza sativa
gagagcgtgacgatcatagcacgcttggtggctccatcccaatgacgacgaatccggtgcgcggagagatcaattttccctctgaaaaacattcagttgattagcaggtagctacatagctaggagccgataaatacatattttgtattgggctactaaatacactaaacaacacatatttccatttgttgttggactacacatgtctatctcggtagctttcttttatatcaccggcttttcccttaacatctgcagctagtttagcacaaaatccacggtaattcccatgtggagatgcagcatgattttctgatgtaatgctagatagggaatgcgtaaaacaacgcaattaaccacacgtggcatgctaacagcctagcacatggctcacttagtagctaagttagcagtaaatacagtagattcaggcagtaaaatctgaacatgcctccaaacttgtactaagatgtgtccatatttttgggacggatggagtaaattaccagaaggtggggatgaaacgcggacaattgagcgagacatgcccaacaccatgttcttgtcggagggggtaggcaaagcggccgcggtggagggatcatctttcttatcgcgccggagagttagcttctgaagtcgagcaactgaagaagagaaatggggagaaattaacatggttaataatgataggtatacaaaaaattgaaagtagaagaaattaacagtggtggggaggggatcgaaagctaaaaccttcgagccggacgatgcaggagctttttctgacgcggggtgtaggcggcgggtgggtcggcgggagtggccgggacgccaaggtgccatgcccctccggagcccccgtcgccggcgactcccccgccgtctcctcctcaatccttctcttcttcttgttcgaagacactcccgccgactcctccacagtccgattccccacctgttcaatcgcctttgctctggagcgagtcaacctcccggacgacgatttgggactgtcgtcgtgctcggcgatatcagaatccggcttcgatttggaccgagtcgacctcgccggcgacgatttgggaccgctcaaggccgccaccgatttcctcggtttgggggacatggccgcctcccgccgcaccaatcgccgccgctagggttttctttagatcctcaccccgctcgagtcggattccttttcttttcttttgcctcttatatactgtaggagtatttattagtaggccaaggtgtagtggtggtgggccgaattcgagtactattcatctactcctgagaataagtccactttcagtcctctcgtatactcgtatcctttaaccggattatcttgatccaactattaaagtcagtgtaatttgactcccttaactgtgtttgacttgtactcccttagctgtttttgctgatgtggcttattgacctggtccaactagccaagtcaacacgcaggactgtttgtatttgttacggt

SEQ ID NO: 53452 - DNA, 1501 bp, Oryza sativa
ttatgacacggtttgaaggcccatttctgtctaaacaataattaatctgctcccatctaccattggttaggcaactagcttatctccatgagtaacaggaaagcagtttactataacaagtgtcttacagaaatacaacaaacacgccactctgatccgttgctcgattctttaattatttcagtataggtctttagagtgcaatccaagtcatgccgattttttgtatgtgccaaatacatttgcacgagttgccaatccccccttctctttagtccaaagaaaccccaagttgcattattgcataataagttaatactaattgcaatacgagattagaatagggacagtgacctgtttgttttatagtcagggctaacaacccacagttgccactagaaagcaaccttgcgtcgaagactttggcacctaagtcttccacctaaggccctaacatgaaaaataaaagcataaattggtttaaacctttttgaatccaattcttttgctaatctatgaccacgaaagaaccagagaaccctcccaaagttaccaaatgatataaaacaagtcctagtatatacaagcaacgaagcatcacagcagcacaagacgcaattcagcaaagagacgagcagctgggggtgggtggggaggcacgcatagcatacctggcgccttcttgaactgtgaaatgcatcagccaggccagcagcactctgcaggtcccagcgcttgcgccacgacggcccatggtggtcggcgtggcacctcggggctgggccgagaaagccacgccatcgccatgagcgtggggaaaaggcgccggcccatccccttgcacgcatttcgtcgaacacctaccgggtggaccgggggcaccgggcattttcgtcgagcacggagacccccggcgctcccctcggcaagcgcgcagctctcgccgagctgagcagcagccgcgccgcgccgcgcgctcggctcaatgccgcccgccaccgcgcctccgtacggtcgaccgcctcccaccgccaccgtgcgtgtgcgccgcgccgcgcgcgagatattagcgtcacatgacggcagcagttttgcgtcgcgagattagtagtattgatagcatgcatagcagcagtgtgccgcggcccgccgccctggcaaacaactgaatttctttaaaataagaggaaataactggcagtttgaatagctggaaatcgcgaatctcaaataagaggcaataagaaattgaatttgcaaacgaattcagatcaacaacataaacaaccgttgaaatcacttctttaagaaatcgatttaaattatatggatcgatatgtatttaagtaaagttgttagtaaaaaaaatgggtactaggattttaggccaccactgtcttctctttttctctatggctcttcttttctccaacaaaattaacttttggatactcatggcacactttttaaactgcaaaacgatgcgtttcgtgcgaaaact

SEQ ID NO: 53453 - DNA, 1501 bp, Oryza sativa
ttgcggcggatctagggcgagccggcctgttcatggcgatggatcctggttgagctcgttcactgcggcggcgagttgatctagatgagcgtgtccactatgccactatggtgagaggcagatccagacaagctagtccacggtggtggtgatggttctagggtgggctaggctgctaggttttatgttgttttttaaggttttgaaatgattatcgcaagtggtcctattaaggaaccacatgtgataatcattttaatcattttcaattatcggtaggactgtcaacaagccaagctcgatacaagctcgagctgagcctataaaatattcagctcgagctcgactaccgagcttcatttttaattagaacaatgtatattttaaaagataatcttttaaaaataattaatttatggtttatcatattcatagaagaggaaaaagaataaaataaatatatgatgcaaatacaaggcatacaaataacatatttaatctattaatttattaaatagcaaccagaaatcatatattactaggctcattagaagctcgacctcgactcgacaaagctcgatcgcgagctttgggacaggctcgggctcgactcatttggagctcaagccgagctcgaatcaagcctaggacgagtcaagctcgagcagttcgcgagccttgagcttttttgacagccctaattgacgatagattctcagcatgtgggaatacaatgttttcctaggtgttttgttagaggcgaggatgccacccgcctctacaaataaattttatccacccacagaaacattttccctagtagtacttggaggcaacacatactagcattcaatttggttgaaagtcctctcctggttccctttgaattttagtttttaaattttagcgattttagttaaatgatacgtagtcacgtcccgatagttacaaattttcatctgggaagaataataggtggcatggcatataggagcagaatttaggtctgcgtggttgcattgtgtctccctcattgagcgccttcagctagatacagggctgtacctaattaatacagatatgaaataaaataccctctccttatttatatgaaaatttgcatgtgtaaatcgattaagtacatgtttgagattagtataaactgaattgaactggtaactctcatcctcaaaacaaccttattcaaagtttaattagttagaaggacttagcactttaaatcttcagccaccccaccacaaactagccatgattactgtcattttggagtttccattccattacctttgtcttttctttgttaatgacaacttttatggattgctggtggcttacgtcagcacaattggggtcatccatattctcacatccatgaactttagtatggctgtcacgcatcagtggcgcggggaatgaaaggtgagaagaaaatataaactatgacgacgcagttaacctacaaccaacgtatcttatgcag

SEQ ID NO: 53454 - DNA, 1501 bp, Oryza sativa
ggtactgaccaactctgatgttgcttgaattttgaattgttacactgacaataagggctcacatgacagtgagtagctgatggtggtagattcaatgtcactagactcaccaccattggagtcttatagaattatatagatatatgatcaagtctcttttcttagatgtcctaattaaggccttatatatagttgttattattggtgtgtggacaatcaattttaggacaggctcgaaaccatatctaaatggaatgactagtatccatttttaaaaagcaatagtcaaaataacatggtccatcgatcgagggccgaagaccgcaaaaagtcgacgatctatacaattacaaaagaacaaatgatgtgcacgatatttaattgataaattatcaattgtattatggtatgtttgtcaaagtatgatcacaagataagaaaactatattggccttacccgtgcaattgcgtgatgtgcgcgccagtttatgctggatattgacctatagagtgatttatttgattcaaagcactatagtgacattcattttttaaaacacaactagatcgtgtagcgattaactggactaatccagcattattagtcattcattatctagaaaaacattattagtcatatattttatagaaatgaccttataattcctcctcttctacagcctacggctagctatagctaaccatttcaatgtcaagatgagaagggaatttaagagcctgcaaattagaggtactctcacaacagaatatatataaggagcccacagtttaaaaaaatcaatatttacatattttgactaataattaaattaataatatatgtttagatcgtacatgtggcagcattatattcatatttgaaagtattttttatatgatattaattttagagtcgttgataatacgttatatgaaaagaaaagtcaaaggcattgttcttttcttattaacatgcatattttacctcgtgcgaaatctttttatatagaagttgttttaatatatcttataaatccattttgtctccggtgaccttaaacgggataaattaaagttttacgttggagactatgtatgcaccaaatttacacactttaaagctttatttatattttaggatggagggaggtactaaacgagaagtatgcatgagagcatgacactaactagctagaagaacactagcaagatgatgcaggtgtcattcattaattaaactaattaatcagaagttaattgagatttgtggcttgcttgacacatgtatactatactctcccagctaagctgtgtactactcctcaagatgacaccaccaccatcaccagcttttccttcttctctctcttctccggcgtccataaataccagcgccaccctcctctcctccatcatcgcagccaactccaacatcctgagctccaatctcccactccattccggccgcgcattctcccgctctcgatcgatcgatcgatca

SEQ ID NO: 53455 - DNA, 1501 bp, Oryza sativa
ttatttaaggttctgttagtcacaaatttagatccaagattacttgaaactggatatttgtagcttcttggatctatgaatttggatcctcgattatattaataacatttggagaaccattttgaccctattttggatgagataaaaaaaattaaaccaatataatctaacaaacaaactttgaatccagcgtggatatgaggcgtggagatgtgttatttgctcggtgttaaaaaaattaggctgtgttatttgcttagtgttccaacccctctccctcatgttccgcgcgcacacttttcaaactgctaaacagtgcgctttttaaaaaaatttctatacgaaagttgcttaaaaaaatcgtattttcctattttttttaaaaaataactaatacttaattaatcacgcactaacggaccgctccgtttttcgtgcggaagattacttattagcaagagagggataagaggcaaacataaatccacatagttgcagttggatatatacatatttttttaaaaaaatagagtttgatgccgaaacagctaaaaaaaccaaaattttccttttctctttgtttttttaataaagaggacactatctttgtcttgtactatgtattaatagagcatgatcatttttatcttacaaacttaggccttgtttagttggggaaaagttttgagtttgattgtcacatcggatatacagacatacatttgaagtattaaacgtagtgtaataataaaacaaattacggattccgtcaggaaactgcgagacgaatttattaaggctaattaatctgtcattagcaaatatttactgttacaccacattataaaatcatgacgcaattaggcttaaaagattcgactcacgatttacacgcaaactatataattgttttttccacattagtactctatacatatgtcaaacatttaatgtgacgggtgaaaagtttttcttttgggaactaaagagggccttaaacaaactcagccgtcaccattcgctaacccaattattggaaagggatccggctcctctaactttgcaagcgaacggcagggaattacagtaaagcccttgtttagttccaaactttttttcaaacttccaacttttccatcacattaaaatttttctacacacaaactttcaatttttttttgtcacattgttccaatttcaatcaaattttcaattttaacgcgaactagacacacccaaaatgagtctggtgctacagtgaagaacagtgtttttgcagtttttcattgtagccgcagtatagaaacagtaaaaaccaccgtgctaattcactattcactggataatgtagcgtactgtactgattaatctcgctcgttcgctccagcatatccagctttgcctttatattgccgttgctaactactccagcttaggcagatccaacatccaggcggctactcaattcaatccgcggcgagagtgaggatgggtggcagcg

SEQ ID NO: 53456 - DNA, 1501 bp, Oryza sativa
gtgttgatctcacctagccagctgagcccccagggtctcttgctccgcaaggctgtcattgtccgccttctggaggatatagcaaaccggaaggcctccaaggatcatggttactacattgctgtgagtgagctgaaggcgatatcagaagggaaagtgcgtgagctgaccggagacgttcttttcccggtgacgttcacctgcatcacgcagaagcctatgaagggcgaggtcttagttggctccgtggacaagatcctcaagcatggcattttcctcaaatctggaccgatagaaagcatctttctgtcggagaagacgatgagcgacttcaagtacattggtggggagaacgcggtgttcatgaatgaacactcgaagctggagaaggacaccgtcgtgcgcttcaaggtcatggggttccgctggatggaagccgatcgccagttccagctccttgctaccctggctggtgactatcttggaccactatgaactgcttctaatggtggctctgctgcacattttgctaccttgatgaatggatttgaaatgtgttagccttaacctgctgtctgtagtttggtgtcgtgatgactgatcatacctgtatcgtatctgtgatgctggttgttgatgtaaatggcattaggccatatgtttagcatttcagcatgatgagaattgtcatggctgatgaacctctatttcctatggctgctcaccgttctaccatgcatatatttgctgccttcctttctgagatattgcctttccagtgtagaatttgcattatttctctatgcaattacttccctgtcacaatcagctcattgtgacaagtagcataatactcccaagatcatgaggttcaacagaaaattagtcctgccaattccaagatttccatcacaaacaatcgaaaacaaaaatgtctgttcgtgattggaatacaggttggaacacgtattgcagcccatgctatcatctcatctcaaagatagatcaagattcaaaaacgtgcaaaggagcctctgaaaattgaggcccttgctgaagaatgatattgcatgaagcacatgccctgataagacattcagtgtgaaaaaaaaaacagaaaaaagaacatgctcaagttgcttgcgtcacattgcatatcagaattgctagacaggcaacacagactgctatgggaaacagcaggatccatgctgaatgatcttgcatgaaccgtgctctgataagacattcagtgtgaaaaaacaggaaaaaaaattgctcaagttcagcacagattgctaagaaaaacagcaggatccatttcatagtcaggctcagagagtgcaagcacaaagtacaactgagcgtcttcagttgacttcgtttattattacaattacactgcatggtggttcaatatgtttcagatagatggacaaagatttaagcagactatataacacatggatatttatgacaataggatcaaccatcggctgtc

SEQ ID NO: 53457 - DNA, 1501 bp, Oryza sativa
atgttgcgctccaccttgccgacgaggtcggcgccgacgtcggccgccttggtgtagatcccgccgccgacgcggccgaacagcgccatggacgaccccccgagcccgtacccggtgatcgcctcgtacagcccgccccagtcgtcgccgtagtagagcccgaacgcgttcacggcggcgaacagcaccagcagcgcgctcgacgccagcaggaaccccatggcggcgcccgacctgaacgccaccgcgaacgcccgcccgatcccgcggcgagcctccagcgccgtcctcgcgttcgcgaacgtcgccacccgcatcccgaggtagccggagaccaccgaggtggtggcgccgaggaggaacgccgccgcggtgaacgccgcgttcgccagcgccgggcggcaccgcctcgccgcgtcgtacgggcacggctccgtcgacgtggagaaccgccccacggagcccagcgagacgaagatgaccgccgcgaacgccgccatgaacgcgcccaggtacttgtactccgtcatcaggaacgacgtcgcgcccacggagatggcgtgctggatctccgcgcacctcgcctccacgccccggtagtccacgccgtcctcctcgtcgtcgacgccgtcgccgtcgccgtcgccgccgtcgctctccctctccaccttcccggcgccgccgacgccgtcgtgcggcgggacggccaccctggacaccatgtaccactggagcacggcgaagaggatgccgatcaccgccgcgagcgggatgagcacctcggccgccaccgtgccgatgagcgccatggatgaacgaagcgcaaagctaagctcgatcgagagctccaatggaggagaagacgagcgagtgattgattcttgatggagaagagatgtggagtggtggtgatcaccaagctaagcttgctctttatagaagggaagatgtctcactttgcaattacccacctgtattttaagataattacaaacaagtccttgtataagctttttggagggtgaatatgacatttttttccgcatatttgtggcttgtgagggtctaaatggaaagtttgctggtgttctctttgagcactgaacaaaccatgcattggatccagtgttcaagatcagttcgaccgtttgttatggcttggtgacagcttgtgctctccagggacaccgtagagctcatgctgtacatgtgtataaacatttttgttgtttttgcaacttattttgtcactgtcttctatctcaccaagaaaagtagcgaaaaagccgctacaaacggcaccgtctagaatcctttaccgtcggttcaaattaggtgtatctgacgcatgagcataagttatctacggtgcgtctcattgaggtttggacgcactggaaatgctgacggacaatgccattaggtaagctttggggttcacccatatgcaacaaaatttccctcatcatgcatctagctaccttcatttcgaatggtggtt

SEQ ID NO: 53458 - DNA, 1501 bp, Oryza sativa
ctattattgttcatgaacgcaagacgaagcgccaagaatgaacttcctgctgtcacgacggcgccggcgcccccgacgctctgatttgctgagacaacgtcgtcctctgctccaggtggctgcgcaggaggaaccagtcgagcacggagtccggcgcggcggcggcggcgcaccacagcagccggtgccggacgttcggcgtgcaaagcgggccgccgcggccgatccaccccaccgccgcgcgcgcgcgtaggcgcccggggtgaccgtgaacggcgagaggcgcctcgcctccgccaggttctccaccatcctcgtcgccacgaagaacggcgcctgcatgcagataagatgatcggatggatgcatcgcgtaaatttgttgtgtgtttcttcacttggtttttttggttgcaaaatttcgtcagattgctctcgtcagatcagggttacctggcattgcacatggatcccttcacttgcgtactcgaggtgaaggctccgggagaaatgagccacgtacctgcatcttgaaattaatgaacgtagtcactaattatatcaggttgtgctgacaatcacacatatatacaactcatatgaaaggattataaatctctatgcccacatatatacaaccatgtgtaattaagacgacaaatataaacaatttttaggtttgtaagaagaaggttgaggaaaaaatgactttgataacgctcattgaatggtggatggttggcagtggccgatcactgttcttttgtgcttgttcccaactaatctatatcgttttccacgcgtacacttttcaaactactaaacggtgtattttttaaaaaatatataaaaaaattacttaaaaatatcatattaatccatttttcaagttagttttagctaacacttaattaattatgcaacaataagctgtttctttttctgtgctggagggatagacttctaaccggtacaaacgaacagccataatccctacccctaattaatcattaataagtctaattagccaccagtaaagaaactgttcggacggcaccgatgcagctgtctcgctgtttctacttctttttttcagggcctgaacttgcagaatacagaacttactctaggtatactataacagatatttgtggatatttaacacagccataaattaaaatggagaaagttttttttttcgatcatatgcgcatattaattaatatatctctgcttcagtcatactactatgtttttacactagcacggtagcactccgtcaatttacattttggatttgtcacggatggttgggagtgtgatggtggttaagagcaacacgggaagaaaggtgattgatggaacaagcattacataaatccttataaacaaaaattaaatattaaaatacttacgaagagagagagagagagagacagtgagagtaagtaacctttactataaaaaagtgtagtaacatgttacgtgtgtttgttgcatgt

SEQ ID NO: 53459 - DNA, 1501 bp, Oryza sativa
ccagtaaagaaactgttcggacggcaccgatgcagctgtctcgctgtttctacttctttttttcagggcctgaacttgcagaatacagaacttactctaggtatactataacagatatttgtggatatttaacacagccataaattaaaatggagaaagttttttttttcgatcatatgcgcatattaattaatatatctctgcttcagtcatactactatgtttttacactagcacggtagcactccgtcaatttacattttggatttgtcacggatggttgggagtgtgatggtggttaagagcaacacgggaagaaaggtgattgatggaacaagcattacataaatccttataaacaaaaattaaatattaaaatacttacgaagagagagagagagagagacagtgagagtaagtaacctttactataaaaaagtgtagtaacatgttacgtgtgtttgttgcatgtacgtgccgtttggtggcggagtaaatggtgcagagggggaaggaagggatggcctgcgatgatgccgagccgatgttaacaacagcgcccctgccccgctccaccatccctggcagcaccgccgccgtcacctccgtcactgcccacaggttcacccgcatcattctcacccacgcctccacgtccgcctcgtgtaggtacgccatagccggctcccccacaccggcgttgttcattaacaccccgacatccagcccctccaccgtctccctgagctgccgcagcggctcgtcgccgtggggagtcgccacgagtgagaggtcgaacaccacggtcttggtctccaccccgtggagagacctgaccgtgttggagatctcctcgaggttggcggggtcacggccgacgagcacgaggttgaggccgcggcgagcgagctctagcgccatagcccggcccatgccggatgtcggcccagtaatgaccgcccacgcaccgtaccggctgcggaggtccttgggctgacggtgcagggagaacgcgaggtaggcgaggaggcggagggtgacggtggcgacataggcagcgccgaggaagaccagagagaggaaccaccacggtggcgccggcggcgccgattcttgccgaatcatgaagacatgaccagccatgacgattccagccacacctcacgggctctctctctctctctatatgtatggtttcctcgccatgcaccggtgttgcacgatatataacgaactgtgtgtacgtttggccgagcaacacagtgaaacagatgcaataaaatgggaaaattgtaccctgaatatttaatactgttgacttttttaaacatatttaattgttcattttattaagtaattattaattcttttcatatcatttgattcattgttaaatatactactacttaagtttttgaataatattcacaaaaaaatttaataagatgacggttaaacatgttttaaaaaataaacgatgtcaaatttttagggacggagg

SEQ ID NO: 53460 - DNA, 1501 bp, Oryza sativa
cagatcagcatgcaggtgagcttctccctccccctcccagtccccgcatatctctcccccctgttagaaggatctagaaggttcgccgatgatgggcgatgcagggccggtagatcccactcgcggcggtatgtaggctttcgtttagcgcctttggtggaaacttcgcttgggagtttcgggaattcgacaaggttgctcgctctggtagtggttgattcgatatcctgaccatgtgcaggatttggggaagagtgtgattcattgggttttttttttttttttggggggggggatttctggttgaattgtgaggggaatgtctcgttgtgtgctgtggagcttactatttcaggtgccgatcacctgatccctttctaatcatcactcgtagatcacggttagcaactccattctaacagggagtagagcttttccacctgctccgcctcataaatgtagatgcacttttccacttgcgtggagaacggtggaaggcaggtctggtgaactgttttggcctttactttctccatagggtagaaacagatcgggatagcggacataaaactattgaaatcgagtatgctctttctttttgtcaaagcggaatcacagaacagaactgacatgataagacagaatgcaacagaaacaaggtatcacgttttggttgggttcaagaggagtcatcagcttttagttaataacctcgaattgtgtttcactcagaacattttagttcctgttcgaacttcagaaaacttcttgactattatgcgaacaaggatttacacaaatcccatgactacttgggttttcagttttcactcagaaaaccttcagttccattttgagcgccagttaattttcactattccccgacaaatgatttacacaaaccccataggaaatgttagtaaaaaaaatttggtttcctcatattagatcttggatagttacttgatagtaacaaaatggcatgtgtacattcattactccgtcctataacaaaatgccttgagctaattgatgtttagaccataccatgtataacttgcctatattgcatggaattccagttttttgtaattatatgctatattatgttatgttttaccagtagccatttagaataaggattttttggtccatcctacttcaggaagactatctcagttatttgtttactgtcctactgtatgatcttaaactaaaaacttgctgaagcaatgtttatctattatgctatcttacgtctatattaagatatcagcttatcatatttcggttaacagggaggtaattcttggttaagatccaaaagacttaaaaataatattattacaccatgccatctttccagacaatagcccgaaaagatgctttgcttgcaactgttaatctatttagtgttgtcaattacaccatacagagatacttgtgaacaagccaatgatacaaggcccatgccacaaaatcaattccaagaattgtacct

SEQ ID NO: 53461 - DNA, 411 bp, Oryza sativa
aattaagtattaactataaaaaatttaaaaaatggattaatatgattttttaaagcaactttcctatagaaactttttgcaaaacacacaccgtttagcagtttgaaaagcgtgcacacggaaaacgagggagatgtgttgaggactcacggcaaagaacacagccgcatatatttaaatatacggttgcacaggacatacatagcttgaccccttttatacacaaaaggtaatatgtaaataaatgttgccgtcagacccatacacaaagtggtgtatattcaaccgttcaccgagatacctagatcggctaataccgtctggcacccctcacttaagtcgggttcgtcatccggctaattaacacaaagaagccacacatctcaaataaagaattaatctcaccaaagg

SEQ ID NO: 53462 - DNA, 1501 bp, Oryza sativa
tggtggtgctgcccatgagcaagcatatgtattgaagatatatgtgcaacttctaggaagattccatggagaagattatgcaattgatcatataattaatgatgatcatctagttagttaattatgttcttttagtgaaattagttaattatgttgatgcatccatatgtggctgcagttgagcaacagccagcaggtttggttggttggttagttaaggttaattaagaatgcaattagattaattggaccgtacaaggggataagtctaccttagaaacaaaggtcaatgtgatttgagttattagtatatagttttggtgtgaaatactactgaaatggacgtcaatttccaggtcttagtttgctttctccaatacgcgttttgttaatcaatcaattagtttattatccctcattctgctgcaaatgaactgcacatgcatgctcgattaatttttcccttttgttcttgataccttaagctagcagctgattcacaaagattgaaatgatttgaataaacaaatgaaaatcgtgaaagttctctgtagaatttcaaaagattctgcctctttcggcagaaatctgttgtagcaaaggagcaaaccgaagcagataataatacactttattgacaaactactaactgtcacaaacttgagcgcgtcaggtaagtttcagatcctaaatttgtgtaaaatattgccattatcacctagtgtcagatcagattattatctcgatgaatcaagcgaggtaagaataatcttcgattaattttccccttttctcttctgataccttaagctagctgggtcacaaagattgaaatgatttgaataaacaaatgagaatcatgaaagttctttgtagaatttcaaaagattctgcctctttcggcaaaaaactgttgtaacaaaggaagcagataatgcactttattgacaactactagctgtcacaaacttgagcgtcaggtaagtttcagatcctaaatttgtgtaaaatattgccattatcagttactgtcagatcagatcattatctcgatgaatcaagcgtggtaagaataatctttgagaaatatttgcactaactaattcctactcgtctcattggaagaaaaaaaaaaaggaacattattctgaattttacaaatgagcccctgacgacctgacgttggcctgaattttacaaatacgtgtttctgcgtttgtttcgatcgggaatttcacacaagtccctgtttatttcagagaatcctacatttttgcaaatgagaccttataaaatagtattattccatgtcagcccttttcgtatctcctactattatacgcgatcagatcaagccgttgattccaagatcgacggatggagatgcttctccggtctccaagatatttccgccgccgatgaggctatcgcgattggctcagtgaagctgcagccaccggagaagccatggcgccgccgacggcgaggtctctgctcgcct

SEQ ID NO: 53463 - DNA, 1501 bp, Oryza sativa
ggagaactgtcaatatggttgaggattgaagcgagacaaggttagccggtcaatggcaaagcgaagcgcatccgcaagatttcatttacgcagttgatttgtgatttacatagctcacaatttcattcatatataagagattggaatgagttctcctcccctgttattcttccagattttgaattggtgcactcgcaaggagacacagtcgtcatggttgagcatctatgcaatctacaacgaatatatatcaatggatatttggcatgtggtgtagacgttgtggcattgcaggccttctaaagtggcatgcaatccatggatggcatgtatgcacatatatgtccaataaatggacatgcaggaggtagtttccattttatcagatgtgaagtaaatcaaggagatggttatttttaggtaatattaaaatctaagtgtgtgaatggtattataaaataagttatttaattccataagatatataatttttttaattagtgaattctacaaaacatataaataacgtaacgtatgattaccgtacgaatctgttattaagaaaaaaaacgtaaatctcaaaaagaacacgcaaacaacatcctgaagataatgactataccgatgtggtacctatgtacttataattataccattctctatctcttagaaaattatctttttacccttactatctaagtacatgtgctaatatttaaataccttttaagtggcactttttattatggagtgttggatcattatcttttttaaatgtaaacaccgtaaaacctctctaatgtaaatcatagcgaagccaaatgggctacggagagcaaagctactacagcggtacagataacgtttcactgtgccagcgcccagcttggcacgaggagtaccatgccgtgcctgaccaagttacttttttttttccgggtttctctgtctgttttttcctcagtttttttttttggtttttctgtttttcagttcagtttttatacctacatatacaaagtttttatacatgtatattttttatacatacatatacaaactttgtattcgtgttcttttttgtttttttatgttttgaatatgtacgcatacacatataaagtttgtatacgtgtatatatacttttatacaccaaaagtataaaaaaatataatatatattgtatatatcgatatgcatacatataaatattatactagaggaggtggggtccaagaaacccacagcgcggtgggcacgcgaccacccgcgtaatagcgtcctccctattatgtgcactaagacctgtttagttccaaagtttttgtccaaattaacttccaattttcaaccacaacttttctatcacatcgtatcaatttcaaccaaacttcagcgtgacctaaacacaacctcagatttaaactcgccttttttttaagttcaactgcgctgcatgcagcatgacctgtattattgactgcattcatttcgagcagg

SEQ ID NO: 53464 - DNA, 1501 bp, Oryza sativa
tagaaaagatatattgcattttttttcttaatatcaggtcaattggatgtggatgatctttggataaggaatcttataccatgagcggtcgctctcgcaataggcacatgacgttttggactgatggtgcacgcatatattattatgtatggtgtttttactttcttgttttgtaaatacaaattgaacaacttgcacacatgttttgcttttttttcaagggacccaattggttgtcttattgttgattgagaaagaacatgtgcaagttgctaaattttgacattttatcttggagcaattaaatttaaagttctacaatttgggtggcattactatattattgatggattataaataattgaaaaggtctcttattatgcgtttggttgaaaatatggaccataattaaaactttgttgcttgttttatcaccatttttcctcttcagaaaggaagtgcacggtcaactcatcattctgcaaaactagctgcgccttttctttttgaaaaaaaaaatcttagatagaagaaatacaggttcatgactattttgaagaacaggaacagacaaattaacacttgaatactgattgacaacaagctaacaagataagaggaaccaaacaaaaaaaataaatggagaaacacatgcatggctgactgcttgtcaacgtggatcatcatcatacagatgctggccagctgtcatgcagaaagagcacaactctagacaatttctctcctttttcctcacatgaaagtaaaggccctgtggctcaacaaataatgtgaagatctctcattttcattttccttcttttccctagagaaagtagtagactgcaccaataaatatcctaacagttactcttcaattatatgttaattatatattgtttgactcttttttaattaaatttctataagtttaatcaagtttgtagaaaatataccgctattttcaatacaaagtaaacatattgccaaggtatatttaatattaaatttaatgaaactaatttggtgttacagatgttgctttttttcccaaagaactttcataagcaaaatatcaaacgacttataattttatgggggcgaagagagtatttattaagaaagcataacagctttgattataagccgtaacctttttagcaattaaaagtaatttatgtgtaatatatttacatatgtgtttttataaaatcaaaaatcataaaaataaaatataaatttaaaatttaaactttgactacgattgataagccaaagagcaaacactataacttttttaacacatatttgcatcaacaaatatcctcttattgaagaaaaataaaagtttaataagaaaaatagattaaaaaaccatccctggcatcaagataggcatgtctaaaactctggatcaaacaaatatgcttatgaatttcttgtttgagaataaaatagtgaaaagagaataaagggagaacaagcaggcgagtatttctac

SEQ ID NO: 53465 - DNA, 1501 bp, Oryza sativa
catgcaagttcagagagctgtggtggctcgctaagttaccatcctggccgctgtcgttcgattaccctaacggcgatcagccgtacgtcgtgaccacaagtcgcgcccgatgtgtgtatctcgagcgagtcaggggtggagattaggtttgtaaaaactatgtcaaaatgtaattttactttcaagtattgatatggagttatggacagtatgtaatcaacaacttaattagcactatttaatctatcgtgatagatatggaattcaatgcaagatacgcactttcatcagtagaataggaaggggcgatttggtagcatcacggtcgggatgaggaggattaagcagtgacgattggaagagataggaagaggcagtgaggtctcttcttccttagggcaagttttatagtagatgtgactattacatctaattttatgtataacatacataattattgagaggtgatatgtataataggtcacatctaccacacaatccccaatatctttaacactctcatatgtttattgaagtttatgtaggggttgccccttgcatgagaggtgactatttctctctcatccttcttctctcctccacctcactatttagtcctatgtgacatcttgggatttgtgcttggatgcccatagtacttgccactactagaaaacttattttcggcgtcgtaggggatcgattttcgcaggcaggcatgtaattcggagccaaaaccccgccggcaaaaaagatacccggggtggagggggcggtccgcctgcgaagatcaatcttcgcaggcgccgcttatatggcccgcctgaaaagatgcccctatatagtcttcttcctcctcgagctctgttcattctccccgaagtttctctctcctaaagtgacttaaatataggagggaggttttgaacttcaaatcttcgggggatttttctacggtacttagatctacttatttccacactaggtatgcaattttttaagcttttagaccttaatttgtgatggatttatgcatgcaaaattgtgaaggaagagttccatgttttttaattttatttcttttgatatgttgatattagatgtatgtctaatacatgatgcctcttgttgtagtggtttaatgtggtaacataaattctcaattttttttatttttgctatcacatctacctccttgttctagatctagatttagatcttgtcatatatagagagaataaaatttttaatgtctatttattcggtgcaatcaaaaaatagttatagtattttgtaatatgccaatgatatgattttgttagattttcctaatgtactaatttgtcatgtctgtgtaaaaaaaattgaaataaactttgattttttattaatttacacttaacctttagttaattagttttgaatagcgataagttttttcaataaaccctacaaatttggtattaattgtgcaaatattttacgtgtatttttttagaga

SEQ ID NO: 53466 - DNA, 1501 bp, Oryza sativa
tttaaaaaactattcacatataaagtactatttatattttatcatctaataataataaaattactaatcataaaattctttcaaataagacgagcggtcaaatgttggacttgaacagtgtgaggaagtacaaccaacagtgcaaggttctcagtatcctaatccgtatcctaatatcttacaatattacgatcctaccaagcgaaacgatcacgataccgatcatagtcttacctagtatcctaaatgtcataatatctcgattctactattcattaccatacattttacgaaatcttaggtagtatcccgattatataataagatggtttgaaaatatgtaaataatatgctgaagtttatataaaaatcggttaaatatatcaaaactaatgtggtttctcttgataaatatccctatttgcatggtatatattattactatattttttatatagaatagctatatgtaattaatacaaatattaattaaacttaaaaaaatctcatagtattcgatcatacgatacgatactactttgaacaaaacgatactacttagcatcccgatattgataaccttcctatagggtcgcaccatttctctaagcaactatgtgtccgtgtgcacacgcggccacgcgctgcgcacctaatgctactgttttgttagtatttatttaatttagtactgattttttttctcatcaatacaatcactacttattttaagttatctttaaccaagtaaatctatttaatttagtactgatttttttctcatcaacacaatcactacttattttaagttatctttaaccaagtaaatctagaacgtacgaattatctctttttaaaaaagatcaatagtgtacgtgaaactattgcaattacatcgatcaaaggtgtggcccattgcatattttcattggtggcagctggcagctaggccaccacagtccacccgtttcactgtgtgtgtgtgtgtgacgttaacacgctactattcccttctgcctaatcaccccactaattttattattgtgcatatataatataatatatgcactaattttattattgtgcatatataatataatatatgcgcgtgctgcgtgtcgtacagcgcatatataatactccctccgtccctaaaaatttgacatcgtttattttttaaaacatgtttaaccgtcatcttattaaatttttttgtgaatattattcaaaaacttaagtagtagtatatttaacaatgaatcaaatgatatgaaaagaattaataattacttaataaaatgaacaattaaatatgtttaaaaaagtcaacagtattaaatattcagggtacaattttcccattttattgcatctgtttcactgtgttgctcggccaaacgtacacacagttcgttatatatcgtgcaacaccggtgcatggcgaggaaaccatacatatagagagagagagagagcccgtgaggtgtggctggaatcgtca

SEQ ID NO: 53467 - DNA, 1501 bp, Oryza sativa
tgacaccgttgacttttttaaatatgtttgaccgttcgtcttattcaaaaaatttaagcaattattaattcttttcctaccatttgattcattgttaaatatacttttatgtatacatatagttttacatatttcataaaagtttttaaataagacgaacggtcaaacatgtttaaaaagatcaacggcgtcaaacatttagggaacgctttggattctgttgcttctgtaatattatggggttttgtactacctgttgcaggatgacgatgctctcgtcggagacgggagagacgacggcgcagaaggggaagctgccgggccgcagcgccgccaccatggccgcaccttcccctctcccggcgacggcgccccacgacacgaaattggcgtcgaggaactccaccaccacgtcggagcacatcgtccccgtgcagaactggtcggcgtaggggtttccgccgccgccggcgtcgtggaggtagacgaacaccagcctcccctcccgccgcgcgatccccagcgcctcggctagccggcacccgtagaagaacgggtggcggccgccgtaccgccgctcgaactcggcgaagaagagctcctccggcagcagcggcggaggaagaggagggtgaggctgggtgtcgcgggggcggcggctccggcgagccatggacctggagaggccgtccatgatgctggccggcagccgcgccaggctgcgcgcgaagtcgtggcaggagttgcgtagggtatcgccggcgccagcgctccccctggccgctgccgacgccgacgaggttggagacggcatgatcaaaatgcagcggcaaatggatcgcagcgacaggtgagcatctcagtttgtgtcttgtgtgtgttcttgggagagttggtaaagcggctgcgtgtggatggacagattgacaggttaaggaatgcgttatgctttgcttttattaaagcagagaggcaaagcgaggagaagattgggctgctttgtgctttgttctcttaagcaaataacatggaatccttcacagatgtgttaagtgataggattttagatcagtcgagaagacatgagcagtgtacaacaagctattcagtgccaatcaaaagtaatccggtgtcaacaagaagctcagttcaaaatagcatatcaaaaaaattgtatcaaagatagatgtactactacgattgaaagagatgggggcaacagagaaaaaaaaaggcccattcaagctaagaacaaagtggagataatgcagaacaaagagttactataaaagggctaatgcagaataagaaaatacagattctggattaattaactagcatatttaaatttaaaacgtaactgtttgagcaaataccacgaaatgttcaggcgctaagatacggcaataccgatacatccagcatagcaaaaatggcgaagagcacagagtcagataaagctatagagaactagggctccaggagatgggggccgaatgac

SEQ ID NO: 53468 - DNA, 1501 bp, Oryza sativa
cttggccctctccgtctcaacctcctccttcgagctcgcggtgaaaggggattttggactttatgccatcttcccaacgcctcattcccaaatgccatcctcctgaacgtcctcgctaatttgccactaggccccataaaattgttgattctatgccattttcttcccattttgatgccacatcagcagcggacgtggaatctcgatggcgaattggccgtcttgcccctggtgtgtgtggacaaaaaaaaaagcgagcagcagccgtctccaaataagccacagcaaacaaataagattctcagcgaagaaataaagcagggattttggatcttgccacgatgggcactcagacagaaccatggcttcaacaaaccctagaccatcagatctaaaaaaaacaagtgaatccggagaaaaaagtgagggaaacagatgccaaactaaaccaaaagaggggaagatggtggatctatcgatctcatgtatgtgattggtgtcacggtttggccgccgtcgccagtcggtggattcatcagctgctactcgcgtttttttagggtggcggaatgagacgacgagaaacgacacgtttttctgttcacgcgtgccaaggggtaccggtgaggtggagtcaaaattagaggataatggcatagaatcaacaattttgtggggcctagtggcatattagcgaggacgttcaggagggtggcatttgggaatgaggcgttggggaagatggcataaagtccaaaatccccagtgaaagtagctcggctaactgcgagcccgccaaggaagtggcgtaggtggcatcaacctagcggtggaggcggtataggcgacgtcaagatggcggtggaggaggcgcaagtgacagcaagctggctgtggaagcatgcgagcgacagcaaagattgcgctggagacccaaggtagcacgtgcaaagtatatagggagggttgaagatggcaaactaggggatagctgacatgtaaaaaaaaatgttgccatgaaaacctcctggttttgataattgaggggtgttcgatacctggttttgaagtttgaggtttgaagggtatttagataaatgtaatagttgagaggtgtaaaatggacttgtacgttttgtgaacctcattattttgttccaagggattctaattttccttctaattgctatgttatcttccaagccttctaaacaaggtcctaggaatgttgtatgggcctaaaaataggcccacggatactaaacatcatgctcccctaaaaagcccaccaaatgagtagtctcccattctgacccttcctcccgtcgccgacgccctaaaccccgcaagaaacaccacacctcgccgccggcgacccaccggagagcgggcaagccagcctcccgcgccgcccaccccatggcgtcccgccggtcgctccatctcctcactgcctcccgcggcatcttctccaccccgcacctcgcctccctcggctggt

SEQ ID NO: 53469 - DNA, 1501 bp, Oryza sativa
tctcgcccatattgttttgacatttcccttttgctgccttgaatttgaaggtgctgtggagcttcttgaagtgaagaccatgttttcctttgtgctgaccacatgaaatattttgattagccatgatcaagaagagcattcctctctttttttttcacttcagcagcaatgcagatcatcctgccacaaacctgacattgaaatatgtaaagcaccataactgaggtttgcatgactgagttttttttttgccaaaattgcattacatctaagccggctttgttgttaaatttgcttgtttatataagaagtcatggaaatatccatcacattctgcgtagaaagcctgaactttgttcaagcaacgcccgtagatcaattttttttttggtttatgggtacattactaagtcgagagatgcactatacatgatgtatcctgaagctggtcattccgtttgtttgggaaagtagcatgtgaatactgatgcaattcaggacccttcattgacattcctaagtcctatagaatatggaaaaattttgaaaatatattttttttcattggtgttacatcaatatacacgtttaaaagaaatttatgaaagtataccgttgttgcaaggcggtgccacgagatcgcaagattcgccatggtctcgcagattgagggcatcagaccgcgcgaccgctcgaccttgcgcggtaagtgcgctagaccgcgatagagaattcaaactagcgcgattaatacattactcattagcaattaattaattaatatcatttctataattagcattattagttataaataattgctaattaggataattagttactaatcattctaaagcggtgtcgctgtttgccccttcgagacttgggtggtggttggatccaggtactcacatacgatgacggtatatttgtgctagaaaaattacatcccggatattctgaaaaaataaatgaacagtatattttcaaatttaatttctatagaatattgcagctctacgatagcagacagaaaagacaatgccccacagaaattttaatcatgcaaaacttttctttgctccaaggtaattttaaacatacaaaacttatcttctctcaaaatatgccagctacagtgtcattcgctccttaggggggagaggatatctagttatctagataggggaatcactgaattggcagttgacccaaccagaaaccgcaaaacatgttctagacttcctagtcctatcttcacttggtaggccgatcccatgtcgtctctgatgtgaggctgttcccgtagtacacctgctttgtagattcatccaggtatgcctgccaacaatggaaaagtcagcacttccattttaacgaacgtaaatgttaaataagcaaggctatcatggcacgatactggagcagagaatacgtgaacttggtcctcaagactttcttttagtgtgtatttgaattgtcatcagaaaatcaagttgca

SEQ ID NO: 53470 - DNA, 1501 bp, Oryza sativa
cgcccccgcccgcccgcaccttgattccagatgatactagctttgcatccgcggctaacatgaactgatttgatttcaaccctgttccatctcctgatgcaggtgctatgcacgccttcccatcaggtctcaccactgccgcaagaagaagtgtggccacagcaaggaggtgagcatttctaaagttcctcttcgtatgtgaacacaccattgttcatgttcttggctttgctttggtctgaatgctggagatgaatttgtcttagatagttgtcatactcctgtactttgtattggaaatttgaaatcgtcattggttgcctccgtgtgcgcttgtcacggatttggaaatttggatagagtcgcatcagtctgaacaccaattcagttcagtggtttgcctttgaattgtgtttattctagtgattactgtgttctgcatcggttgcaatacacgctgtacagtttttttcccctcacaaatgcagagcaagccgtacaattacagtgtttgttcaactttggtcggaaactcggaatgtctgatttgttcccatttctattattctttttcagctgaggttgaagaagaagttcatcaactcgctttcgatagcgtgaggcactggaaagtgttcaccagctgaatcaatctcttggatctccgtgtgcgcagctaccatgttatgtccagtttagaagtactccgtagttgttaatctcttggaacttcgtatgcccagctaccatgttatgtccgtagtctagaagtagttgtggtacttagtacgcttgagagctctgggttgttgcttaaagaagttgtaaccctgcgaagctgcgactgggatgttgaaccctctatcatcactctgaatgaagaagttatcgttactagtagtaaatttttaatctcctcccttttattcatgctgttctggttgatctggttatttaactcgttgccacatctgccaatgtgatgaactgtttgcaatgacgaaattgcggccaactacgtatgaagcattgagcaacctgttaatcggactagtaaatctagataaactattttaaaaaagggttaatctataattatcagccgacatggtagaatctagacattccaattgaaaactggcaagcaaacactatcagaatccagcagagtccaaccgggattgactcttgtggtcacgagtccaacagaaaacgcgggcgtcaataccagtgggctaggctttaccggtgcatctaaccaccgacttcttaaggcatcgtcgtccatcatttttgccgcttttaatgaaaccaggtgctaacacatccattggtttagaggcaaatcatggcgtagcacacaagtacacagccgaatcttccatttgaaagtgtaaaatcatcaacaacgccgaaggcagtaggggttgggaacattgcactggaaatgccccataccatgttgccggtcatagtggctccaaaaccagctgctacgcct

SEQ ID NO: 53471 - DNA, 1038 bp, Oryza sativa
ttttattaaaatatttacaaaaataatttgttgttttgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgatcacaaataaaaattttgtatttaggtcccttgccgccctttgagagggcgatttttaaaaatcgcccttcttaagggcggcaggcaattaaatttgtaaattttcgaaacaaaaaattatttttgtaaatattttaataaaaaaatgtataaataaaaaaaattccacaatttaagccgtgtctgcttgggccatatacacggaccagcccaatagccagaagcctgtagctctccatgggcccgtactcgtgccacgtgtcaatcctgtggttcggtttcgtggcggttgcgtttcctcctctctcttttctttttcatcttttttttttcttacgacatttataggtttcgtagcggctgcgtttcctattttccttttctttttctatttatttttatgggatatttcgctttcgtggcggctgcgtttcctcgcccatatataagagcgggtgaccacgactgcggcgcggcgcaccactccaccaccaccaccaccactccaccgatcggcgagagcgcggggagatcgttcgacgg

SEQ ID NO: 53472 - DNA, 694 bp, Oryza sativa
ctcactgacggtaccaagaagaagatgaagcaaacgaacagtgagcagtcacgccttgcgctccctaaaatcctgatcgctcgcccgtccgtgcaaacgtcgcagcggggcatggtttcggaggcctgctctcgctggttctgtacgtgcagaaactagcgatgagaattcagtagtgcagcagcaacagagggtggagtgatgtgtttttgttccatacatccaggagctagctccttctctgattatatgcgtacagaggtaaaggagatgatgttgaaaccgattactcccattggacaacatcagttactggtaatggacgttgttaatttgccaaattaacaccatcaatcaacactaatagtcagcatttatagtgttctctaattgagccatcaatcctccgtgtcaattgaattatcaattcttgaacagaaaccttttacacatcatgtccggtaattcatcagcatttaacgtgtgccttgaatattatagatttaattgaaaataaatgtgccaaacacaaataaatccaacagaacatctcggcgagtagcccatcacaattatctataggaaaatcttcggtaatggatgatgaaattaaagattacataggtagttagggtcggctggtttaatttagttaccggccggtcattgaggagcttattaacaccaaaataga

SEQ ID NO: 53473 - DNA, 1501 bp, Oryza sativa
gaacaagaccaaagcatgacaatttatttataaattaacttctagttctaatttaatatccatatgcatcattaaggcagaattttatagtttctaacgagcccaagtccaaccataaactttatcgagaattacacacgatacacgaaaaaaactgctcttgtttggatttggtcgttttgtttataacttaaattttataagttcattgaccccataagatagatactttaagaaatattgatgtagattaactgctgtttaccactcctaagccaaatgaccagttacaattatcagcttgaataatttaaatatagctctggtagaatgtctcaaaaactcaaagtacaatgtgaattagattattcacaaaagtttgtcccactccggagatatataataaagtaccagcatatctcttgcctcgaaaagtaattgcaaagtgattttgataattttggaatttcttgatcaatagaccatcataaattttcttacccaccatgtgcttattaattcatccctatctataaggcccgtgcaagtcgatccgttgatccctatttataaactcttttgctagtctcttttctcctttcaaaatttgcaacaccatttggacttttgagcatatatatgtgccttgtgtttctacgacagctagtgcaatgggcataggaggtgccaggattgcaacagcgagttcaaggctccgccgatggagcagatccatgcatgtgtacactgcaaaattgatgggtagacttcatcatgaaatcccaatgcaaatactgtgtgctgatgggatcaaccgaagcccatgaactgcacgcacgcgacgtcgacacattgcagtgcacgcctctctttccatggagacaaatgctgcagcaagaagaacacacaattccagtttttgccgctcgacttgttgcggttgtcttcttggggtttgttcatctattttggtgttaataagctcctcaatgaccggccggtaactaaattaaaccagccgaccctaactacctatgtaatctttaatttcatcatccattaccgaagattttcctatagataattgtgatgggctactcgccgagatgttctgttggatttatttgtgtttggcacatttattttcaattaaatctataatattcaaggcacacgttaaatgctgatgaattaccggacatgatgtgtaaaaggtttctgttcaagaattgataattcaattgacacggaggattgatggctcaattagagaacactataaatgctgactattagtgttgattgatggtgttaatttggcaaattaacaacgtccattaccagtaactgatgttgtccaatgggagtaatcggtttcaacatcatctcctttacctctgtacgcatataatcagagaaggagctagctcctggatgtatggaacaaaaacacatcactccaccctctgttgctgctgcactactgaattctcatcgctag

SEQ ID NO: 53474 - DNA, 1501 bp, Oryza sativa
cgccacggcgttgggcgacgaggagaacggcggagcaggcgagcaaggcgggcagcgacctcgctctcgcgtgcggcgtcggcgtcgtcttcatcctccgcagcgagctcccaggcgacgaggctgctcatcacccggaggcgctcggcgtcgccgcgacgaggctgctcatcaccctatcagcgcacatggggcacaccatcgccgagaggctctgcaagacgcagggccagccgaggagcgccggcttgtcgccgcgggctggggatgagagccaacgccagcggaggaggcgtacgaggggcggagggccgcgctgctgcgggcggtggtcgtgggcgcgacatgtgaaaggattttttagctcgccattaaggaataaagtaagaaacgcgtactctctatataaaatgagtacgttcaccgacgtgaaaggaatttttagctcgtcattaagagcttaagaaagttacttggaattctttggtttgttgacaatcacgattcatgacaaaagaagattgagagcctacgggtgcacgccagcgcgctgctctcactgtcgtcacccgcgtggccacgtcgatggcaccgacgtcgtcgtcgacgccggcgggcagcagggcgctggcggcggagggggtgttcgagtgcaagacgtgcaacaagtcgttcccgtcgctccaggggctgggcgggcaccggacaagccacacgcggctgcaggcgaagctgctgagcgaccccgccgccgcagcggccgagagggacagggcacgcatccacgagtgcgccgcgtgcgcggggtcgagttctccatggggcaggcgctcggcggccacatgcgccggcacaggggcgagacgggcacgacgaccgtcgtgctcacggccgccgacgtcgacgactcgggcggcgccaccgtgccgcagccgccggaggccatgctggacctgaactacccgccgccagtggcagttcctccctcgccggccgctgcccgcgcccgccgctcggccgcgcccatctgctctctgccagccgcctgtggtccgtggagaggggaggagagagaggaagagagatggtgaggggagggaggaagaggctgacatgtgggacccacgtgggtcccacgctgattgggctgccacgtcagacaaaactagagtcaaagtttacactggttttataaattggggtacgtgttgtatcgggacgattttgtaactcggtgacaagttgagggacctccggtgtactttttccttaggggaatgcctaaggtctaagccattgctaaaggctaatcttcgatgtcatcaaattaaagcccatgggccatggatataggaggacttttggcccactcggccagcttccgctgcggccctgcctgcctgcctcttgaaccgcgtggcgccgccgccgccgccgggattcacaaaaccaacggagcatacggactagaatcttcgccgctcgccgccgcggggaccaa

SEQ ID NO: 53475 - DNA, 1119 bp, Oryza sativa
aaaaaaattaagtaattattaattcttttcctatcattgattcattgttaaatatatttttgtgtaggcatataattttacatatctcacaaaagtttttgaataagacgaacggtcaaacatgtgctaaaaaagtcaacggtgtcaaacatttcaaaacgaagggagtatataaattgattagcagaatacaacaacaaagacagaccataactatgtaacaatgttagcatacaaggaagtcataactacagcacaaaagaacagagacaagctgaaaagcagtaaatctcaaaattcatttcatgttaatggaaaacagtaagatgtatacaactaaatctcaaaattcatttcatattaatggaaaacagtaagatgtatacaacagcaaatatgcattgttacaactaatactattgcttcattaagtgattactaccgaggaaacccagatcactagttcagaattacagtttagcggcattgttaatttttagtcaatataaccaagagagcaagataccactattccaaaaactgctgtacacccctaatctatacagttcatttattgtagcatacaaggaagtcacaactacagcacaaaagaacagaaagacaagctgaaagcagtaaatctcaaaattcatttcatgttaacggaaaacagtaagatgtatactacaccaaatatatattgttacaactaatactattgtttaattaagtgattactaccaaagaaacccatatcactagttcagaattacggtttatcagcaatgttgattttcagtaaatgtaaccaagagaacaagataccactattccaaaaactgctgtacacccctaatctatacagttcatttattgtactacaaaatgagcaccatgtcatcaagacaacctcttattaaagtagcaagaatatttcttcagaacatgctaacagtcaagaaagatcatgtacactggtagcatgccaactcaaccatacaggcccgaactcatccaattgtcatatgtacagaacatctaaagttctgacaaaaaaaacatcacatggacagcaacatatatcacacaagtaataggaattcacaagagaaatgtgct

SEQ ID NO: 53476 - DNA, 1501 bp, Oryza sativa
tttgcatggaagctagcagaaaatgctatgtgttgttcatgagtctaatcaaagttaattaatcaaatctgatgctgtctaaggagcatattggaatgcatcaatcatatgagtgtgtgtaacttattggtgccctttgtgtgccaatgtctcatcctctgtcatgttctcaatgtatcaacgctgtaacttctcaagaatcaatgtttatgtactactactacaactacatagtttaactaactcctaaccagggctaaactgaaccaactaaacaattacggagtattactgaacaacaagaacagcgcttaattagcaatgcgcgtttcgtttcatctcacgcagcaatgacacacgcttgcaacgcaccagctgtgtttgtgatcactttgtcagtgcatcagcaaatcgagcactgcatgcatacgcatttcctgctttctggcgtggtggaggcaggaaagcaacctccaacatatcagcattcaccacccaatatattacacaatttgtgacacaggtcggtctctctgcctgcctttcggaacgggaagaggtgtcattttcctatgcccatttcgatcgtagccaaattgatctagatttgaaataaattatatatatatatatatatatatatatatatatatatatggcaacgtaatccttctgttttaaaatataagcatttcgcattcaggttccaatgggcaagaattcaagcattctaatcaatcaggtgcttatacggtgaatccagacaattcgaaatttgaccggaattcttttttcttatcctttatctttgctaaacatcataggaacatttacatttagagcgatgctggggatccacttaatttaagtggctccgacttgacgtacgactgatctaaacggcaatttacgctcagtctgtgtttagttccacactaaaattagaagtttaaaaaaataggaatgatgtgatggaaaagttgaaaatttgcgtacgtaggaaagttcgatgtgataaaaaaattagaagtttgaaaaaaaagttgaaatctaaacagggcctccgtagtgcgcgtgttcgtgctcgtgcaatcaagttggatcgagttgggagttggagttgacagttcgtcactagctcgatcgctagtcgtcgccgtgtgtgtaatgccatggtgctccttgatcggacgccggctagtagctagccagcagcgtgtgtggcgaacaacctaatctttttccttcgcacgggcggccggctgacggcgacgagccgccgacgacgaggaggacgactttgacgcccgcgtgtggtgtggaccagggcaccaacagcagtggtggtttatgcgttgccaactactgacgagatgctatataagcagcagcaatggccatcgcttcagctgcacggacaaattaagcgagggagtgagagctagctaactcaggctcagccaactgatcgcgagctgtgacgaggtgatcaccatggcgt

SEQ ID NO: 53477 - DNA, 173 bp, Oryza sativa
gcgtcaaacatttcgaaacggagggagtatatcgtttgtcccaatgttcttatcagaatgcatagcagcataacaccttgttgaaataaatacttgtattgtttgttttgtttcttgtctcttgtgttctcttgctgtttgttgtttaataaacaactgcaatttttgcttgc

SEQ ID NO: 53478 - DNA, 1501 bp, Oryza sativa
aatgagcaattcttgcaaaagctgggatatttctcagaagcacactatcatttgcatacctgagatgataggacaaagatatggcacatccatattcctgacgcatcccaatccctgcattggctcacactgaggatgaatttgagctcttcgtggttgtgaagtcttggaaaaaaaaacaatggacatgttactgacaacggtgtaatatatacagcaaattcttggcacgcaataatgaccaaagttaagaagatcgtcaatttaatgcatctgaaaaatatcaggaaacataatgtatttcagaaattaatttgggaactaacttgtaatttacataattcgaattaaatacttatatttcaaagttttgtttcttgtgttccatctcttgaatacttcacaagtgtgattgtctgttgctccctccatttcgggtctgttcagtgaagcaccaactcctaaatttagcttcagaagttgggtctggagtatagttgtgtagcaatctaaactcagctccacctccttattttattttgtgagtgtgcctcacctagctccgctcccattttagatggagctaaaactgtttggctgagctctaactctaggagaggtggagaaggagctagagttgtgccaaacagacccttcatattatgcaaaatttgctacatgacactcaaaatttgtataatttgttgttagacattgtaaaaacatgtcatgactgaaagacactctaaaacactggtaatttgctagaggacactttcggctcaattggagagagaattttttaaaaaaatacaagaatgtccctagagtcaaaagcttttgagttgagactggagtgaagatggaatatgatgtacgctaatgatgtacttggggtgatgacatctaaatttttactctaacgtcatgtttgaaacatgtggttctaggggcattcccgtctttcttaagaatttatctctccaatttagccaaatatatcctatagcaaattatcatattcaggatatctttcattaatgacacgttttttatgtctgtccacaaataacacaaattttgagtatcctgaagcaaaatttacctttatattataggtcgtcttgattttttcttagtcaattttaatttagttgaccaagtttatagaaaaatagaacaacatccaaaataccaattttatttcattaaatatattttggtaatatatttattttgtgttgaaaacgctgttataattttttaaaaaattgaatagaaaaaggtcaaaatgactaataatatgaaatgactaaaaaaggtcaaaatttggcacctgtattgccccctcctgtgtgctgtagcttcagtaaatatgagtttataattttgtggttcacatgcttatatacaaccacaaaacttagaaaaataaatgtcacctaaaaataaagatatgtttctactcactctctgacctacttgagtgtttcagtaaata

SEQ ID NO: 53479 - DNA, 1501 bp, Oryza sativa
tcttggagtagttaattaaggcgttaaatcatgtgcaaccgcacgatctctcgttccgtccatttgtggtgctgaccacaggatggttgaaggacaattgagcagtactgctcacttacatgtgagcccgagaggctatggggttcacatgtcagtgagcaatattgcatgtacaatattgcagatgacctgcatggctgcatctggttgaagggtagaaacaccacttttccactttttactcccttgtttttcatgcatatttcttcaacaactaaacattgtgtttttcttaaaaaaatttactatagaaaagttgaatttttaaaatcatattaatctatttttattcttttactaatatttaatcatgtgctaatgaactatattgttttctgtacagaaagaagaagagccccatcggttgccttaataagccaaagcaaaagataaaatttgaatttttaaacttaattttgaagttgatttaaagatttttttcaacatagtttttttttcagcatcgacttttaaatcgttaagaacacatgtataaaaagttttaccaataaattagttttttattatctaatgaaccaaaatggcttattagaaaatatgagtaaccgatgaggccggaagtatccaactaatactcttgaacacatagggcctgttcattttgatgccattttcaaccataccattttttttgtcaaagttgccaaaaaatatatacgtttagtttgttaccaaatttggtcaatacataagaaatcctgccaaaatgttggcaatattgccatcttgttaaaattttggtattgccaaaacttggtaaggtttattttggctacaatctgaacatgcctataatagtagaaggggtttatttgcaaatatccatctccaacttcacgtgggactatctgagtggattaaagtggtttagaatctaataatcgaaacccattttgaaaagggttaaattatcaaatctctcctcttgaccctccctttctttccatgggcttcgccggcgactggaccctctactgtcttgaatgcgcttcatagcttgttttcatagacttcattggcgacttgatcctagtttgttttcatgggctttacgggccactggaccctcgcttgtcttcatgggctttatgggcctcattttcttcagaattttatggccttctatacgcccactacacctaatcacgcgcaaaatctcactgccggtccggcctggcccacccgcaacgactagtcaacacgcgctgcggcctcgccggcttctaggcccacgtagaaggttcgagaacaacgaggaccgcataaaagcatctcccacccccacgatctcgccctctcaaaaccctctcctaaccctagccgccgccgcagccgcagccgcagccgcgcgtcgtctcctccgcccgcgagctcctcttcccgccggcgagagatcaggagcacgcaaggcgcgcggcca

SEQ ID NO: 53480 - DNA, 1501 bp, Oryza sativa
tgttaagataatattgcatcatataataacgtgcattgagatttttcgttctgtgctaacttccatggtaattcgtaggccacacctaaaattttttccgtcctccgccactgactatatagctaatcagctatacctcaatgcatggctcatttgtagataaataataactagcacagctaattgcaagttatcgacgtctttcttcgatctgcatcgactcacatcacaccactgtacttctaaacactactccatcacccttttcgctaaatctggttcattaattcctcttctgggagaatcataagtccctggtgcctcctaatcctaagaaaataaatagtgtctatacgcatgactcacactagagatataatttcatcaaccaaaaaagtgcaacagaaggcaaggcatgtggatgggtgaaaattttcaagccatctcacacatttatgcacagtagaggtaggtgtgcttcaatgaaaatcctaggaggttcacaaattgaacccttaccccgtctgaatttcacatatttaaaaccatctatcagaaatttcaacatattgcacaagtctatttattatactcaatactattatatcataataatgcgaagcgacgtatataaatgcgtatggtttttgtacatcccgtggctaaatcggtgccctaaagtctttatcttttgtggccgatgaatgaaccgaaaaatcaaataattgatgtttaaaacaaaacaaacacatcctagcagagcaagtgaaagtgtgaagtccaaaatagactaattgagattgcatttgcatcacgtactcacatagtgataaaaaactattattcatggtaaacctaaaaatgatcatctaagcccaaggttttgttcagtagtaagctttctatatcttctaccatctcattttccgcatgcaagtttcctaaaaataaaaaacttttggtgcatatttaaaacaatatagttattttaagtcatattaatctaatttttaagttttttactaagtattaattaattatgcattaatccatagcttcgttttatgtgcgaggaagtttcccaacatgcacaaatgaacatagcctaattaaggctctgttcttatgtcccaactcccctaccatgttttccgcgcccacgctttttaaactgctaaacggtgcgttcttttgcaaaaagtttatatatgaaagttacttaaaaatcatattgatccatttttgaaaaaaaaaatagcaaataactaattaataacgtactaatggactgcttcgtttttcgtgtcggagggataggtttccaacccaggcaaacgatcagagcctaaagacttagcactgctttaagtgacatcttccaggcagaaaattaaatgatatttacgtcacatgtgaacattttgttgtcgttgatgaataattttgttgaaacttaaatgattgatcctttatttttctcactttgtgtctgatgactagg

SEQ ID NO: 53481 - DNA, 1501 bp, Oryza sativa
acaaggtaggcggagtaaaacccgacaccaaactgcccaatcatggacacatcagcaccagcagcgagcgcctccatgaactccttggtccccgacctggcgatggtaccgaggttgttgacgaggtccgacttggtcatgccgacaccactgtcgatgatcgacagggtgttgctagccttgtcggggacaatgtggatgaacagctccggctgcgcatcgagcttgctcttgtccgtgaggctctcgaacctaatcttatccaatgcctgcagaaaccacacacacccatgtcacatcgaattcatcacccaaacacacagatctgtaaaagcatcagcacactaccacactatacagattacacgcacgggtaaacacacaaccctcgctgatttgtaacaagtttatgctagtgctcagatgtggccatattcacatttcgatgagtaaaacaaacaaataaactagcacaaactctacaaatcacgagtcaacgctcacacctcattgatttgaaacaggtctacgccctatcagtatatgatcctcagatgccgtcacgctcacagatcgacgcgtacaacaacagcaaagagcacataagcaagcaccgatttcgattcctcgacgagaggggattaatttcgggggcggcgcaaacttacatcggaggagttggagatgagctcgcggaggaagatctccttgttggagtagaaggtgttgatgatgagggacagcagctggttgatctcggcctggaaggcgaacgtctcggtctccgacgccatggcttcctcctcctgtgctcctgagatctcgggggcgtggagaggacgagaagaaacgagaggcggctagggtttggaggggtttccaagaggacgcgagatggaagaggagggagagtatttaagggatcctgtggttctagaagcatctacacgaacctagaagccggcgaggccgtagtggcccttgactaagttgctgctgggccttttctcggggaagtcacgggccttcaataatctgtgatccgctaggaataagtccacttgctgtccctcagctttacgtcgattttcagttggcattcctaaactgcagtacaataaatgatttttgcaaaaccattcaaaccagatcataaggcagcaggaggcatcgtagtcagaaaaaaaatgattctaaggttttcataggttatgtatgataccattgaccttttgagatacatttgaccattcgtcttattaaagaaaatgtaattattacttattttattgtgagttgatttatcattgaatattctttaaggatgacttaaatatttttatattttcttaaaaatattgaataagacgaatgatcaacgttgattaaaaatcaacaacgtcaagggagtagtatatgccctctgcatctctaattctagtacttgatttggcgaaatattcctacttcctttgatctcctctctcctctactttgcagg

SEQ ID NO: 53482 - DNA, 1501 bp, Oryza sativa
gaagctggcgttcactgccatctacaattttgaaggagggagaaaagatcagtaaccattttagaaacaaactattgaaaataaggaaaccaaagaagccttagcttttcgcaagtagttttgaacttagtatccttagggtcgtcctaaacgtcgggtttcgccctagggccaagcctgtgctctgataccatttgtaacgtcccgcctcccccaggccgggcccacttacatctgatagctttcataggtcatagactgccctcacagaccaacacatgtcttttctgcacactttgtcctcactcgtgtgcacccgggaagaatttcccaatcggtcacccatcccaaattgctccaggccaagcacgcttaaccctggagttctttggagattggcttccgaaaaagaagttgcaacttgttgatatgagtattctattaatcctattaagccctaggccgggatgttacaccctcacccccttaagagagatcgacgcccccgtcgatcaacctaggccaggaacgtcatctcttggccacgtccatgtgtccagtgccagcgcatgtgccatgctgtgtaaccactcccggtctacatcagccatgcgcaccatgcctgcgcaactacgacacacgcgcccgtgaaaccgcgagagtcggctctgataccatctcttgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggactcgggccaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccaca

SEQ ID NO: 53483 - DNA, 1501 bp, Oryza sativa
ttcgtttgttgttcctcatctttacatcgagtttatttggcatccctaaattgcaatactatactcttcactcttttatctttgcaagaccgttcaagtcaagttctaagataatatagatgtctgttttggctgatgtggcctcacatgtaagttgactcctcacctcttccctctcttccccatctctcttcctctcccctctcttccctcgcagcttgccggcggagagagggctggcagccgacgagcccatctgcatgaggtaccagtggaccacctcccacgaaccaccagtgcccgctcttctcctccgccatcacctgcatgtccagcatgcttaggtcgttcagcgtcgccacggtgtcgatcttgccatcttgggcaggcatgacatgctttgtgagtgcgccatggcggtggaggcctcccatcaccgccctgctcgtgtgccccatccttcatggtcgagggcttgccacgccgaggtaccaatcttcgtcgccgatagaggcatggggtttgttcagattgatgtcatttcaaaccatacaatttttttttgatagagttgttagatatgtgcatccatttagtttcttgtcaaactttggtaaatacacaagaaaacctacaaaaaatttgacaatattgccaaattaccaaaaattgataaggtttattttggctacaatctaaacaaccccatcgagccaaaggcaccggggcacgttgcgtggtgggtgatcgtccagaacttgagcggtcactcctccaacctcatgatgtagaacctgcaaagtagaggagagaggagatcaaaggaagtaggaatatttcgccaaatcaagtactagaattagagatgcagagggcatatactactcccttgacgttgttgatttttaatcaacgttgatcattcgtcttattcaatatttttaagaaaatataaaaatatttaagtcatccttaaagaatattcaatgataaatcaactcacaataaaataagtaataattacattttctttaataagacgaatggtcaaatgtatctcaaaaggtcaatggtatcatacataacctatgaaaaccttagaatcattttttttctgactacgatgcctcctgctgccttatgatctggtttgaatggttttgcaaaaatcatttattgtactgcagtttaggaatgccaactgaaaatcgacgtaaagctgagggacagcaagtggacttattcctagcggatcacagattattgaaggcccgtgacttccccgagaaaaggcccagcagcaacttagtcaagggccactacggcctcgccggcttctaggttcgtgtagatgcttctagaaccacaggatcccttaaatactctccctcctcttccatctcgcgtcctcttggaaacccctccaaaccctagccgcctctcgtttcttctcgtcctctccacgcccccgagatctcaggagcacaggaggaggaagcca

SEQ ID NO: 53484 - DNA, 337 bp, Oryza sativa
accggcgtgtatcgcgcggtcagaccggcgcagcccgcggtctgactggccgacgttgtgtcagtttcggtttcgggttgtttgtttggatatccgtgattgtttcatgaatatgacttctagatggatactatacgtatgtaatattgttgtttgctactaatgagtcaagttggggatagtttggtctcggaatatggtttctttgtttgttccatgtgtaggtgacatgagatgccgggagagtatttgcggtgatggaccgagagtcggcttggggataagacgatgtccgtggtggtcagagatcatgcaggatactaaggctagagttcaa

SEQ ID NO: 53485 - DNA, 1501 bp, Oryza sativa
ccattgggcaacactttgtctactatagaccacctttcttctacagattggcctgactattttgacccttttttcataggagttgcgtatgtttgacttttaattacaaatttgcaatacttttctcctatcctttccctcgtacacttgacaagaagactggcctgcgtgagcgtgtccaaagatcactcctcacatggttgatgatctttggagacaattcgaaactcaaaagtgtccatgatctgaaggctgaattcccattgcctcctaagcctgctatactttatgcaattatacttagctaaggaacaactctaacagggagtatggaacatatatatgcatgctcgtagtcttagagctagcaaatagtgtgaactatttatgcacagtcaggtgtgctttagtaggaattacattatgaggatcaattaaaaatttatcttggattttgtatgcacgaatttagaaactcaagccaaataattttggtgtcgaaaagagcatggtcaggccactgtggacttgtacagtaacctaattcgatgcaactttcagtcttttcagacattgtatcctacattgattttggatatttcctaagcctaaaattatttatacccgagaggaaatgcattaatttgcaaaatcttatgcacctaggtaagtaaatgaatgaacttaggactcgaattgaaagaaaagactgaggaaattgcaaacatatttgcagaaccaaagcaagtgcttatcacagctgacttcaacctgatcgtcaaaaccatttttataagaaaaaggattaaaacccgacatctatatttaaatcagatgtacatagttaacaacaactgtacaagactatttagacttacatacaaaggttcttgccaacaaagacattcaccgagcactaagcctcaaactcttcactcgagaggtcaacccaaccttaaaaccataaatatctcgaattctcgatagaacacatgtctatgcacatattatcctacattagtgccatataatagcatgaaacaatatgaatgtgcatatgtgaggctgatatattttccactgcaaaatctatgtaaatgtcaatatttcataatgcatttctttgtacgtggatgatgaaataacagaaatactacaaacttcaagctataaaaagaagcaaacaaatcgagcattttctatacatcatgtgtaaaactcgataaagttttgtcatcagattagctagttacaaattgtacaatttatttaaatgatcgatatatacggctattaaattagaactcaaagatagtttatacaaaatttgtcatgcttctcttgtttccattgggcaacgcttgtctaatgtagagtacactttctgccaggaattgtgctgcctattttgagccatttttcataggagttgcccatgttcgactttgaataacaaatttacaatgcctttctgctatcttttcccctcatcctcgacagc

SEQ ID NO: 53486 - DNA, 1501 bp, Oryza sativa
gtagagtggtggcagttgatatgacatataaaaatttttaataaaacaccaaatagaatcctaatgacgattaaaaggagagacgtcaggcaggccgtgaagcaaacaagtaaggcggttaccgggacttcaaaaagtaaaaaaaaaaaccccattgatattcatattcgatttttaaaatctcaatgacaataaaaagaagaagcagcgggcggggtatataagagtatagttgcagagccgccgacggttgacgggacttttagaaaataaaaaatgaattccaacgatagttatgttcaatttttagaatcacaatgacaataaagagtaggcggcggacgggctatagaggggcgtagtggcatcgtttgatgggacttttaaaaattgtaaaaaatgaaactacaagtctaatttttaaaggttcggaacttccaaaaagtaaaaaaaaaacccaataataatcatgttcgattttaaaatcacaacgacaataaagaagggaggcagcgggcgagccgtagaggagtacaatggcaaagccgctgacggtttggcaggacttctagaaagtacaaatgaacccaaacgataattatgtttgatttttaaaatctcaatgacaataaagagaagaaatagtggacatgccgtagaggagtataatggcaacgtttgatgggacatctaaaaattataaaaataaaacccaacgtgacaataaactctaaaaactataaaatctaatttttaaaggtttaaagaagaatgaatagaaatagtggtagatcgagtaagcaaataaagaagaagatgacataagaggtagcaactggtgtgacttttaaaaactatataattagaaagacgagaatgataaggtttggtctttcaaagtcttaaaacaatgggatagctatttaataaattttaagtaaaatcatatttaaaaaatatatgattttgtttgggtgctagccgcgtaattgcgtgggccgcccaactagttatactgtatacgttcgataatttttgaaagaaaatttgctgaagcctgaaaacctacataatgaggatatcaggatgcactttctctcatagtcatatttcatcagttcctcgtaagaacagagaactcgagaggttgcgcttcagtgccgcgaagaaaggacgagctattccaccctcccggtcggtgcgtttgcgatgaagaagacggtggttctctaccccggcctcgccgtcggccacctgaaccccatgatggagctcgccgacgtcttcctggaccacggctacgccgtcgccgtggcgctcatcgacccgtcggtcatggagaacgaagccaacctcgccgccgccgtcgcccgcgccgtctcctccaagagctccaccatctccttccacacgctcccgggcatcccggaccctccctcgctcgccttcaacgatcagttcttcaagaactacttcgacctcgtgcgacgccacaacgagc

SEQ ID NO: 53487 - DNA, 1501 bp, Oryza sativa
aaataatctttagcatatttaaaatttttgaagtatatggtcccacttctttattgattaattctttttttagggaacttctttgattatattgttgaatgacatgttttgcaggatattagtgaaaactttaaatgttagtttctataggacatagaattactacctactagctactagtaggacgtacgcaagtgtgtacagttacacttgtagtaccgattggtggatctagatcatgtgcgatgtataggcccgtagctagtaccccaaccatttcatattagttatcatataagtctttccactaagaagaaaaaactattatgcattttatataatctaagtatgtggagggaaagaatcaagaaacatgtaggctataactcctcgtatgcacaagaaacaaatgcttacctatccctaaatgtatgcatggatactcaatttacatgcatagatgcaataataatactgcatgtcaaataaagggaccaggtttatatgatgatcaatttgaaatttctatatgtttatatgatgattaattaatatggaatggagagagtatttgatgccgcacggattcatgagaatgaaacaaaaagttcaagtatactactactactacacattttatcatggataaacatgagttaaacaaaatgctaccgcgctagtgtgctttcctttcttcgctatcacggtcaactttcattgtaaatacattaaaaaaatcaattttaccccccccccaaatatatattaatctagggagtgcttcatatattgatatcctctgccatatggcacctgatgtaagtgccacataccgtaaacaatatatgcttctcaagatcactcactcccttcgtcccataaaaaaattaacctagtactgaatataatacattatagtattataaatctagatatgtctctgtctaaattctttgtattagaatgtgtcacatctaattttagatttatgtttttaagggacagaggagtacacatgaacaactatccgtaattgaaaacttttgcatcgacattcaaccggcaaagcaggtaaagaatatgcacacaaacggaccacacacttccatggctgcagaagaaccacgtacctacacacattgctgtagcctatggcatcacctcccgtccgggcagtagtaatctagaagtaataatataattaattatacgtgcaagagtggatgaagtcggcactgacgtcatcgctgccaatagtattaattatatggcctgctttagttatcaaaaaaattttcctaaaaacatcccatcaaattgttagacacatacgtgaagcattaaatatagatttaaaaaaaactaattgcacagttagggaagaaatcatgagacaaatcttttgagcctaagtgctaattacggattaattagactgaaaagattccagacgagttataaaattagtatttttattcgtgtaaaaaatccattctaatat

SEQ ID NO: 53488 - DNA, 1501 bp, Oryza sativa
tatgtgacataggatcattggttccagatgcaagacatgtttttttaaaatgattaaatgatgttatgttttgtaatataaaatattataaaactacagtaacacaaaaaaaacttgagtttctaaactgttggtgttctatgatttagtgttcgacatattatcattttagtgtgtaatgaccagttttgtgtatgtttcttcatacagatcgtctggttcatgtgaagatattttgcctggtgggaatgttgctttgttgatacttttcagtattgctgtggtcctagcattctggcactagatggtacgccgtacgcacatcagtgatgtactttgtttcttcgtatcaaacatttcatgagacaatcacaaatgttaagcctgatagaactttcagatttgctgtcatgcttttaatctccccaattttatgatcttacacatccttgtcagttgcttagtttctcatcatttaccaatgaagcttttctttaataatttgtctggcgcttgtatggtatctcaatactaaatggcacaagctttgaaatagtattgctggtagtggagtagtcagtggctcagtgcatgcaattcacacccttccgatctttttcccaaatatttttttttcttttctcttttggagaggacattgatgcaatccatttgtagtgaaactagttgttacatgctactgatgttacactgcagaaccaaccaaaattatgaagagccttttaacattagaaaaccctcacttataattttttttaatcaaacacctcacctataatttacaaaaaaatatttttgtaagtacctacaaattactttgcatgatcgagatctttgatataaacaaaataaattattgaactgcaaggagtttatatagaccttaacatcccggtcagttcaatgctactaataggtttcctgcatttctatattaaggcagctgagcacctggatattggataggtagataacatgacactgtatttgatttcaaggctggtgttagtttgattttttgtaggtctcgtggagttaaaccaaccattgtattgctcaataatgcattttcacgaaacccattctctgttccagaatggagtccaccttttacatatggcggaatgtctttttgtgtgtacggagggtcatatatgttgattgatggttcaggcaatactaccaaagaataatcaattgtgtgaaccggtatgctagtttgtgacgaataatcttacatttaatcaaaacaaaagttggccaggtcattctcgctagtaacttatcccccttaggctcctgcagaatcagtaacaaatcgtcaaatcctagaataacatttgaattaatggtgctgctgtggtcaagcttaggtccattgttccactgtcgtcttcactaagcatgaattacatgtgtagtcctttgatgtgattgcatactaatccaaaatctcatgtcctcttccatatgcctcaga

SEQ ID NO: 53489 - DNA, 1002 bp, Oryza sativa
gggctgcgccggtctgaccgcgcgatacacgccggtctgaccggcaaccactgcacggtctgaccggaccacatatccagcagtacctatagatcacctgtgaaatccaatcatctccaaaaccacttcgcaaataaattccaaatatcaaaaccaataatctctccaatgccaattgttcatcacagaataataaccaaaaacacctttgattttacaccatctctacaggacaacctttgaagggagatgacgatcgccggtgattagcatatggcggaagctgtgctccagctgtttgatccagtacaagaaagatataagagagcaattcatttcccctttagattagaattgaaggtctaatgtaattcaccacaacaaattcatagatacatacagagcataaaacatcatatataatcttagaaagcaagtaatttttaaatagatagagatcccaccatatgtaaaaacacaaaaaatcaagtgagcattggttttttttttttgcgaagggtattatttgttgttgatttgtctgctacattgatttatcctaatactttcaagtaggctagctgtccaacgagaagttatcaagaacagagtttcaaattttagagtgcccactctcagaaaacaaaaaagagagccaaagcatttcaggtggaactgatatagtgggaatttcggtcgaaaattgtgaaccgtggaagaacactgtcaaggatgatttgtatggtgaatggtcaaacaattatcttaactgaagaccctaacacaccatcatttcggtgacttgtaggatcattcctgttttctgataggaaataatcagatggttagacaagataaatgtagagaagctactcatcacctcatgtgtactccccgtttcacaatgtatgtcattctagcatttcccacattcatattaatgctaatgaatctagacatatatacatatttatgttcattagcatcaatataaatgtggaa

SEQ ID NO: 53490 - DNA, 1501 bp, Oryza sativa
ttaccgtgtttggaatcctccgttttacacttatatctctgtcagaattttatgcttttcatattactctttttttttattcctactgttcataggagagatttcaaatgttttgctcgacaggtaaacccttagatcttgtctttttcacttgacatgaggttgcgacaggacgcactgtgccagcatagtcaagattctttaccaataagaaaataccaaagtgacaaacatgaccagggcactaaaaagtaaacagtaaacaatcagtgctcatttgaaaaacaggattttcaacacacaaaatagaagaagaaaaaacagattcaagtgtcgtatctcaaatcctgttggatggaaaagcttagaaaaactataggaaaaactgtttggatggagtcgtatgaaaaatacaggaattacacaaaataacgtatgaaaaatgcaagaattagaagagatttatagatacagagtaacgtatgaaaagtataagaattagatgatacaatgtaaatttttcaagaggttggatcttatgttgaaaaactttcaaaatccttatgatttgagaaaatcctaggattttgaaatgactattcctttactccgaacaaacatgtttataaacattccacgaattaaaccctgcaaaattcctccaaaattcttttgtttcaaaagaccctctaagtaagggcatgtacaatggttgttaatagtggtctcttagcgttgctaattaggaatacttattgatatggaagaaagagaaataggagagacaaaacatcgttgttatgcatgacaacagcttaacaacgactcttaatcactataatatggaaatatggttgcatgagggtaaaaaaatggaaagaatattaacaaatgaaatattttttgagttaatgattaaagcctttatcgactcaactattataaagatatggtctctaaataatcttatattgtttaagagaccatacttgtctctaccattgaacataccctaagtaaaccggggaaactattttaattacccgggtgattagaatccatataagagcagaccgctctcatcgaactttgccgacattgggtgcgccggcgcggccttgtccgttggggtatcatctccacatacaagccactaagcccacagtttcgggccgacgaaatcattcatgcgcgtctggctgcccactccgcatattctgcgcgatatcctcgtcccgtacgtgttgcccattttgccgccacaaccgtcgcaaattcgcaaaccgccggcccggagccaaccaaccaacggaagcatcggttggctccctccactacactgtactgacttcgcccatagcaccggcaaagtcaccgatccgcttggtactgaataaattggtcacgcacgccatagtagtggactagtatggtggtagctcaccatcgccgacttgcaaaaccagctgctacgtccgcgtactttttcgctgaagatcga

SEQ ID NO: 53491 - DNA, 1501 bp, Oryza sativa
catgaatgttacgagaaactagttagagaagtttgatttagaacctcttatatataatataataggaaacggaaggagtgggcatgttccaaactcacatatataatcccagcgaagactagcagatgcgaagatcaggaataaacctttcgtggtttagctgatttgatcagacctcaccaaaatttctgaaatttttgaaattttgaataaaatttagttgtatttgaacaaatattaccaaaatttacgaaaaaaataaaaagttagaaaatttcagccaaaataataatgtattggagaggtctgaaatgaccgaaatttccaactttggccaagataacttgcccgatctcacaaaagtcaacacattcaaattaaccaaggtcatcaatggcaaatgactaatctcactaaatataattcaacacattcgaattaactgaggtcatcaatgatagattattaatctcagtaagttcctagtgataaaaaaaataatctatgactccagtacacaaataatgcttccgccgtttgttttgctggcaaccccacgagtgcttcccgtttctattgatggcggcgtggcgctagggcactaaacaccatgaacgtttgccataaatgcttcccctgttattttttttgcctcaccatgaacgtttgacatagtgtttcccctgttattcttttctgtaaggctagttcacaacatatgttcgtttgagaatttcggcaggcaaaacaagattattatagtactattagctattactgtaaacataaaacattgatgtggtgtggttgttttttttttcccaaggatgtaaacttgaatttatatatcaaagcgtaatgtcgctctattttgtgcgtgtgtttttttttcaaaaataatgtatcaattccttgtttaatgtatcaattccttttaagaaacatacataaaaccgatccaagtagctattagaactcgattccgctagttgcaacagccacgccacgcctactccgtacttactaagggaatcatgttcaaaattcggctaatcaatccacagaaatcctggcaaagatcaccagaatttctactaagtcatccagatcccaaccgtgaccgactcctgattcccggtatctacacagatcagtgcacgtcaataccgacgcagtcgttcgcctataacattggttgctttccaggcaagtcatgtgtctcatgcccatagcatacgactctctccaaaagaccaaaacccattggcccgtcccacgcatccactagaccaccacgcgccaagctgaagccggtcggcaattggcagctagcgtaccactcgatcaattccattagtaaactctcccctatataaacagcactcgcaagcatcgatctccactcaaattagccactccactccaagcaaaccgagtctcacttactctgagcttctctacacatccagtgctactccagtttaattagcatccgccacca

SEQ ID NO: 53492 - DNA, 1501 bp, Oryza sativa
gtttcacccttgatgaacataatatagctcataaactcacaacctcactctttctcaggaacaaagtccaatgttcatcagagaacatgagtacttaagttagatacatttgtgaatatagtatctgaactgtgacaatccggaaaaaaaagaaacaaagaattttgtgaacaaagtccaagcaggccatagtatctgaactgaagtacaagctgtgtcaattcacaaaattctttgtttcttttttctggtttaccatgcggtaagaattgtatgtcagacgattaactgagtgctaaacacatccctccttaatttgccattgcttgagttccttgcttttgatgatttgacacggattgttgtgcatttaaagaagacgagtgatcataccatgagagcatgagactagcagtgaaatcttgtgatttgggcagtttcttttgaccaccttgtcaccatcagacgggcaggacgatcgataccctgtagaaattttctattggactttgaaagtatctggcatgacaatttgagaaataaaattgtacgcgacaaagatgacgttacacagctttcatccatgaaggaacatgacaaacgctgcctgacgaacatagattctgtgctcatctaaaaaaaggattcagaaactagtaactggttattatatacagtatgttatataaatattaatgtgctaagccaagatgtctgcttaatgagagcagatttgatgggttaaacaaaccttgatatatggtaaaaattgatgcagaattgaggtcaagagcagcccttcgcctttcagggaagccaaagcatgtactccctcggtactagtaaagaaagtcattttgaaaagcgacacggtctccaaaacacaactttgatttttttttctataaaaatatttattgaaaagtgataaatgtatatttttatgaaagtatttttcaagacaaatatattcatataatttttatatttttaaactcaacaacttgagagttattcatgatttatattccgaaggtttgacttaaacattgccctaaacaacttcttttatgagtaaggagggagtatcgagcaatagattgcgggctacataatttggtcagccttgttcagaaaaagggaaaaaaaaacttctgttagtactttaccctatttgagttcacataataaaacaagaaaaccaatagcgtatgattaattaagttttaattattctaaacttgaaaatagatttatctgatattttaaagcaattcctatatagaaagttttcgtgcaaaatgtaccgtttagtggtttgaaaagtgtggtaacggaaaccgagataaaatatatatcttaatcagaaaagaatcgggaggattggattccaatggaatcatcatcattagacctgtgagaacagtattttctttcaagtttacctaggccgtgtttagttattctggcaaaaaaaaatttgacgtatacggacacacat

SEQ ID NO: 53493 - DNA, 1501 bp, Oryza sativa
cgacgccctgctgcccaaggaggaggcgcgcgacgacgactggctcatggggatgagcctcgacgacctccagggcctcggctcgctgctgcaggccgacgacctctccatgctcgcgccgccgccggcggcgaagacggagccgctcggcgcgccattcttctgagctctctctctctctctctctctctctctctctgtgactgcaccactgtatataaattcagagttttcagacatgttcagtattcagagttctcaggcaagttcagaattcagagatggttaaggattagtggcttatgagcagtatgatatgcaggttagtttctagtttagcagtgttactccagattggagatttgattaatgatttgattctaattaatgtagtatactgagtgttactcatcatcacagattcatcagagctgtgtcaagtgacaattctttttttttttatttcctggatcaagttcaccatgttgtgctcaagatttgtggataaatgcacatccatccttgaattggcattgcttatgttcttttcattcgatgatttaacaaggatttgatacaagttgagactagcagtgatgtccttcttcagtcaatgagctgaatttggtgctttgggccacttcttttgaccaccttgtcaccatcagataggtaggtcaaggcgatactctgaagaaattttttattagtctctgaaaatatcaggtatgatgatttgtgatattaaattctacgcgccaaagatgacgtgaacacagacttcatccatgacgatgctatgtgtgacgaacaaagtcaaatgttcatccgagcttcagacgctagtaagggtgtgtttagatccaaacttttcatccaaacttcctatttttcccatcacatcaatctgtcatacacacacaacttttcagtcacatcatcttcaatttcaaccaaaatccaaactttggcttgaactaaacacagcctaaattggttatactgtatttatttatttatggttttgtcctcaaccaattttgctaaagaaaaatattggctgctttaagatttgcagatttaatggcttaaacagactttttggtcaggttcatttgtcctttgaagaagaaagtttgtaggggatcaagtggttaagatttcagagctctctgtgtttaggggaatgtacactgtatgttgttcagacaatcagaatccagagtgtcttgtgcagaattccgagaagaaacctttagttagttacaaagtgtagtgtagcagtggtataactagtatgttggctgattaaaggattagattacgatgcagtcatatcattagaggagtgacaagtgattaccctctttatacatttctggcttaccatgtgttcttctctgttgaagtgagaaagagaggttcagtgagatggtttaatccatgacttggatataggaattgagttgagctcatctgtggggcaagaatgatgctgcaa

SEQ ID NO: 53494 - DNA, 1501 bp, Oryza sativa
ttaagtgagattttttttcaaaacaagtcagtccagggttttagtaaaactgttgagatttattcgtcagtcagttgggatctgatgggtgaaatgcattaggtcatagctcaggaacatgggttgcaaggtatttatgctttatttgttattattagtatgtatctaatttctcattattttatcgttatgtgagtccgtcttatttattcgctctcatgtaaaatgatctatgcataaaaatttcgctcttattcgattcccttatttgagtcttttattgctttatttaaatttggattgagcatgcattgatcctactcctttgtcttccctagatggccggccacccacccaaccaccgcggagaaggcatgatcgactttgtggcagagttggcatgtatgacgctggtggtaggctaccccaacgcgccagagtacacgacgattccaccgctcagtggcgagcttcctcaccgtgttcgtctggaggtccacggctacgtgggtacctgcctagctaacatggtggtggaggcatctggaggcacagcagatcacgcctgtcaggaggcagcatacctgatgatggccagactacgggagcgccacaactacatcttccacgacacggcgtactggtttcaccctcgtcgagccagcagtgatgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaagagggagaacgctcagttaaagggtcttcccgcgccaggaggagtccggatccgcaccacgccccgcaagacgacgactgcacccgtgcgcatccagcttgcgcccaggaacccacctccatcagcagctcccgcagcacctccagttccgcccgcagttcctgcaactccagctccagctcccgcgtccgctctctccttcgctccagcatcagccgccaggggcccagccagaggcaacggaggttggttgtctgctactcccagtggcagccgcgatctcagcagcagcagctccagtggctcagagtcgggcagcggcgagacttatctgccagggtccggaagtcgctcagagggacctggtgacgagcaggaggacgccttcgattccaccgaccgcaggagccgttccgagcattaggctcgttttccattagtttaccgactgtctagcttctgcttgttagtttgtgtgtttaggttgcttgtttggggttagtcgacggtcgatatcatgtgcctatgatatggctgtcttaataaggatttttgcttgctctttaagtgttttaattcagatcagaacaattgcagtttaaattcctatgtaataaagcttagttcctgagcatctgtttttcttcttttcccccgtctgcttttccctccaga

SEQ ID NO: 53495 - DNA, 1501 bp, Oryza sativa
taccacaagccagcgtgggcaacggctgggcttgtagtatagctttcctctagtcgacgcatccaggcaagggtgggcgtgatggagcggggcgggccctgcgacggcctctgtcgcttccggattcacctaggcacgagagggggctgcccgttgcccgctggggacgggggtgaaacctgaggtgtggtgtgcttggctagagggggttatgcgaagggtcctgtcacggcctctttctgatatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttaaaattggatagtttaggtggatggttgggcctgtcgcaacgtgggttagcgttggacagtggatagttgatattgtttaattattacaactgtttaaatctttcaacttctgtttataaatgctcgctttatgcaaatgaaccacttcagctcttctttgatgattccctgcatcatacccctattccggtatgacttgctgagtacagtgggtagtactcagtcttgctctatttttcccaaccccagagtttgagtatgtgtcagatggaggtgtctctgaggagtaggcttcgtccgtgccgtcgaggatgcctgtggagtggtgttcccactgcagttctagtcaaggcttagctcctgttgtctttcgtttttctgctgcatttatgtaagacttttatgatgtttgtaagacgtggatctgaatgtcaacattgtcgtttgtgtaccccggctggtcctggacgggattttaatgcacattctgcttgaaattctattcgggaatttctgggcgtgacaagttggtatcagagccaggttgaccgtaggacaagccaaatggaaaaacctaagagccctctgaatccttttcattgcatatgttctttgcaattggattttattccgggaaaattgggatctgttcttgtggttcaaggaaaaaaatcttggtcgctcgtttaagtgagattttttttcaaaacaagtcagtccagggttttagtaaaactgttgagatttattcgtcagtcagttgggatctgatgggtgaaatgcattaggtcatagctcaggaacatgggttgcaaggtatttatgctttatttgttattattagtatgtatctaatttctcattattttatcgttatgtgagtccgtcttatttattcgctctcatgtaaaatgatctatgcataaaaatttcgctcttattcgattcccttatttgagtcttttattgctttatttaaatttggattgagcatgcattgatcctactcctttgtcttccctagatggccggccacccacccaaccaccgcggagaaggcatgatcgactttgtggcagagttggcatgta

SEQ ID NO: 53496 - DNA, 1501 bp, Oryza sativa
tctccctccctgtccccaccctctctccctctccctctctctctgtttctctctctctcccgacgaactcccctcggcgccgattcccgctgctgccttttcgaatttcgccgcgccctcgcgtcgcgcacgcgctcgcccgcgcgtggccgactgctcggtcgccgccacgttagccctggctgcctgcgccgcgcagcagcccatgccgccctgccactcgctccacctgtgcgcgcgtgcgtccaagacgtggaggcagagcctcggctcccctctctcatgcgctctccctcctccctctgctcgcccaaatcggcaaggagccgagctcctttcctctcccctttttgctttttccctctcagcccggccacccgtgaccacctccactgccgccgcttggccgctagctccgagcacgactgccagccgagctcccttgaccacctaagtcggtttcctcccccaaaaccgacttcccgtgcctataaaacccaagccaagctcctcctcctctctatccctctcgtcttcgcctgccgcgccttgtcgccctgctcggctcgcaccgtcgccgttcgtcgccaagcaccagggaggccggtgcgtgcatggacgtgtgacgaggagctccgggcacctcttcttcccctttcccggccgctcccggagagcttgctcccgcgccgccgtcgctcgtcacggcgccctgtcccgaagcgatagccctccgttcctcttcctcgctcgccctcctcctcctttaactcgcgtggtagctcagttagtgtaacgctccgcttttcgtgagacgttaaaaactaattcggcaaaaatcctaattgcgaaaatttcattccttgagtgttgagtctaagttgtgccaaagatctcaatttaaatccctcccttgtctcgataccctgttatcaaagatcgtctcctcaaaatttccatcccaatgtagtcccgaagctcgattccttctattcggaatcccctcctggaaccccatccgtgaactttgtcgaatgcccgaaccctaactccgtccaaggattcaccttcgcgtcataaactctctccttggttccttcaaaccgattctcaaattcgaattcaacctcttaggttttgattcatctatctttctctctgtattggttcatcaatctaccctgttttctttctcgaacttctgacccaagtctgaatatgcaaatcgagatcacttccacccttgaactctaaatcccaagattcaatccccttcgccttgagttctccccaaaatgatttccgttccgaaataatcttgaagtccgaacccttctattcagacttctctccaaaatccttacccacatatctcgttgagtagtcaaactcaaactcccaagttacactctctttctctaaattatccatccccttttgactcgtctccgaatattgttcccttccttgactccttcctattctcccgagaccgagtatc

SEQ ID NO: 53497 - DNA, 1501 bp, Oryza sativa
cgtgttgggggggattggtctggaaatatggatatggcgtttccttgttattacgtataatagctgtagtcggatattagaagtgattgggttcacatgtactcggattgaatttaccatctatatttctactatacaactaatgcaaggtggaaggctttaactaacttgtgtttgttgtcttgttatgtctcctacctagctataactactttgcgagtgcaaataatggtttactgtggatcttggttgcagtgagcttgttataagtttcagtgcgaatttttcatatttggacacttttttaccaccatattatctctttttactctgcttctcattgcagagagacctatgttttaatatatatattttttgaacaaacagacctatgccttgatcgttcctatataagtggctatattttcatgctgaaagaaatcatcctttaggtttttttagcaggagattatgtattttgatggccgatcaatattggtgatcagctgaatagcaatgcgactgattcctctgtaccaatctaatcttaactgttgtctgaatttgggtatataccaaccaccaagaggtcatggagaaccaagtcttgtggatcgcctacttggatgttcttgattatctcaattctcaagttactgtgcatatacacaagcatatgtttttctatattatacagaagagcaatgaaaaaacatgttgtatatcttcacagttgcacctctctatttacaaatagtggaaaacatactctctccatactcgtaaaggaagtcgtttaggacaatgtttaagtcaaactttaggaatataaatcatgaataactctcaagttgttgagtttgaaaatgtaaaaattatatgaatagatttgtcttgaaaaatactttcataaaagtatacatatatcacttttcaataaatatttttatagaaagaagaagtcaaagtttcttttttttttgaaaccgtatgaagaagtcaaagttgtgttttagagaccgtgtcactgtccaaaacgacttcctttacgagtatggagggagtatgtaatatcacatagcttacagttgaagatcaataaattgctaccgacaattattgtactatatggttaactggatcagtcagacatgatgaacacccttctgtactcaatgcaaaagttgcaaacataataacaagtcgatctgagctctttatgccggttctgtctttgacatgccactatgccagagtgattttggccctgtaatctttttagcaccaagtgtccaaatgtgatttcagttttccaccgttaactattgacccagagcttgtcagatttttcctttaacatttgttttacggtatcctgtgctgtttgcaggcactatcttgtcatacccattgaacatatacctactgtcaataatctccaaagaaccaccgaagatcaccagttaggtgggtgatttgttccttctcgcttcttgcaacc

SEQ ID NO: 53498 - DNA, 1501 bp, Oryza sativa
tccaatagactctcagcttcaataaaccctccaaggggaccaagaggtgtatattttacttgcctccagctgttaaaatgaagtggtataaataatttccaaacggaaaaatgccacatttcaaatgaagggaaaggcgtatagcactgtaaattgagtacctgggcgtaaatggcaatgccaagcagtgaagatgaaggtgatcaacactattaaatggtggctggtgaaaaccaaatctgcaatacacaacaagtttacaagaacgcagagaggaataacgctcgataagtatattgtgacaatggaagtttccccatcaccgcatattagtgttactgcttatcagcaaatgagagagctttcaatcacatgtacaacaagaaatatagaacacataaataatatttctttttggcaatacctctgttcctccgaattgggagcatcccgattgagtaaatctcttcctactgccaacatgtgactaactgaaaaggacaaaacatgccaactggttggtttgacttagacaaagagtaatagggagccaaggttgcaagaagcgagaaggaacaaatcacccacctaactggtgatcttcggtggttctttggagattattgacagtaggtatatgttcaatgggtatgacaagatagtgcctgcaaacagcacaggataccgtaaaacaaatgttaaaggaaaaatctgacaagctctgggtcaatagttaacggtggaaaactgaaatcacatttggacacttggtgctaaaaagattacagggccaaaatcactctggcatagtggcatgtcaaagacagaaccggcataaagagctcagatcgacttgttattatgtttgcaacttttgcattgagtacagaagggtgttcatcatgtctgactgatccagttaaccatatagtacaataattgtcggtagcaatttattgatcttcaactgtaagctatgtgatattacatactccctccatactcgtaaaggaagtcgttttggacagtgacacggtctctaaaacacaactttgacttcttcatacggtttcaaaaaaaaaagaaactttgacttcttctttctataaaaatatttattgaaaagtgatatatgtatacttttatgaaagtatttttcaagacaaatctattcatataatttttacattttcaaactcaacaacttgagagttattcatgatttatattcctaaagtttgacttaaacattgtcctaaacgacttcctttacgagtatggagagagtatgttttccactatttgtaaatagagaggtgcaactgtgaagatatacaacatgttttttcattgctcttctgtataatatagaaaaacatatgcttgtgtatatgcacagtaacttgagaattgagataatcaagaacatccaagtaggcgatccacaagacttggttctccatgacctcttggtggttggtatatacccaaattcagacaa

SEQ ID NO: 53499 - DNA, 746 bp, Oryza sativa
tggaccgggatgatacaataaaccaagtttagggaccttgatgtgcgctttacaacttcgtggacctaagtgaaacctactgataagaagtttaagaaccgctggtgtattttagtctatatataatgtttgtatcatccctctgttggtttcttgcacctgctacatccctgtttctctcctgctacaataaatatcggctcggaatgatacacatcatcatgaaacaaatatatattggatgtgccatatcggaagttgttctttatgaaatctaatatccaaatatatagttagaaattgattttttttatactagtatgtagccgtttgtatctgcccccacaaccaagaggcaagctagcatgaaaaaagtggcagtcatggttcttttgcatcttataaagtggcaataaattggtcactctctgattgtacatttgtacgcaaacgaataataatggaatgcttctcactttcactttattcgaaagtagacgccaagtcttgcgcctttgtaaaattagttttgtcgtcactctgaatgatcaacagctcaatatcatagtgcagatgtacatacaccaaaaaggatctggcacctgttttatctcacttggtgctcttaaaactcaacagcaatgttccattgcatttgttcgtttcagtgcacgcggagacggggaaatctttcactggccgtcgcgtctctttccattttgcctctgcttcttttctgttccagt

SEQ ID NO: 53500 - DNA, 488 bp, Oryza sativa
ggtttatagagacggagtgggagcggcaaggtcggttcgaggttggccgcggttttctcggcgctcggctggtgttcatgggcgccgcgagaacgagctacggcgaggatgcaaagggtggtggaggcggtggatcgtgtggtggaaatcgaaccgcgagcacgggaggattggcgcggggcgagcgggtgcggtcaaggtgggggcggcgaggcgctgcagcggcgtcagcggctctgccttttgaacaagaagccaaggagtggaggcagggagtgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaaaacgaaagacaacaggagctaagccttgactagaactgcagtgggaacaccactccacagg

SEQ ID NO: 53501 - DNA, 1501 bp, Oryza sativa
gtaacttgggagtttgagtttgactactcaacgagatatgtgggtaaggattttggagagaagtctgaatagaagggttcggacttcaagattatttcggaacggaaatcattttggggagaactcaaggcgaaggggattgaatcttgggatttagagttcaagggtggaagtgatctcgatttgcatattcagacttgggtcagaagttcgagaaagaaaacagggtagattgatgaaccaatacagagagaaagatagatgaatcaaaacctaagaggttgaattcgaatttgagaatcggtttgaaggaaccaaggagagagtttatgacgcgaaggtgaatccttggacggagttagggttcgggcattcgacaaagttcacggatggggttccaggaggggattccgaatagaaggaatcgagcttcgggactacattgggatggaaattttgaggagacgatctttgataacagggtatcgagacaagggagggatttaaattgagatctttggcacaacttagactcaacactcaaggaatgaaattttcgcaattaggatttttgccgaattagtttttaacgtctcacgaaaagcggagcgttacactaactgagctaccacgcgagttaaaggaggaggagggcgagcgaggaagaggaacggagggctatcgcttcgggacagggcgccgtgacgagcgacggcggcgcgggagcaagctctccgggagcggccgggaaaggggaagaagaggtgcccggagctcctcgtcacacgtccatgcacgcaccggcctccctggtgcttggcgacgaacggcgacggtgcgagccgagcagggcgacaaggcgcggcaggcgaagacgagagggatagagaggaggaggagcttggcttgggttttataggcacgggaagtcggttttgggggaggaaaccgacttaggtggtcaagggagctcggctggcagtcgtgctcggagctagcggccaagcggcggcagtggaggtggtcacgggtggccgggctgagagggaaaaagcaaaaaggggagaggaaaggagctcggctccttgccgatttgggcgagcagagggaggagggagagcgcatgagagaggggagccgaggctctgcctccacgtcttggacgcacgcgcgcacaggtggagcgagtggcagggcggcatgggctgctgcgcggcgcaggcagccagggctaacgtggcggcgaccgagcagtcggccacgcgcgggcgagcgcgtgcgcgacgcgagggcgcggcgaaattcgaaaaggcagcagcgggaatcggcgccgaggggagttcgtcgggagagagagagaaacagagagagagggagagggagagagggtggggacagggagggagaggagctctgcctccattgtttggaaggacgcgacttggagcagcggacagggggtgacgccggtggtgaccacggaggtctctgcctcccggtt

SEQ ID NO: 53502 - DNA, 470 bp, Oryza sativa
atggatctgatccgtccacagatgcaacgataagcactctgcaaatggtcccctacaattgattagcacgtttttttttcgaataagattgattagcacgtctttgttctgattgacagacacctacagactgcagtttaattagtgctatccttaatctcaatagttaatttgctgatttcaatcttcctaacctaacctatggtctatggaagcaacaccctaaatgcagattaacgatcacacgttttcaagggtagttaattatgttgaggggtttcaactactaaaactttctgaagtggtttaaacagaagataaaaaggagacataatagttggatgtactccgtactagcagtccattcacctactccctccgtccaaaaaaaaaagacaaaccctgatttctgtgttcaacgtttgaccgtccgtcttatttgaaaaagttatgaaaaaaattaaaaagat

SEQ ID NO: 53503 - DNA, 1501 bp, Oryza sativa
acttctcagtacattgtgcaatcttctttgtcctgcatgcatctgtacttgcaaaatatgctaaaatatttttgtttgtctaatggatctaggtgccagacagtgaatagaaaaattacattagtcatcttacagttttgaacaagaacaattaaaaaatgccaaagcctgcaagttggttttgagaagtcagatttgcgagaaatacaacactgcacaattacaagttggactttacattaaaactagtatcttggccagacagtacacactccagggaaaaaaaagagtgcgaaaaatacacgtttgcgccatttgttcccatattacatacaccaagaaaaggcaaaacattacaaacatcaaatgtgaagaggaatttatcagtaaatgtgagataaatgctaccctatttctctcaaataaatcgaaacaaacagaatggaaattatcgtgtacacttatgtatcggtgatccgtacacgatatgcacgaggtacaaaaacttaaaactaattctacaagcacttaataatggtactaacactaaacaagcagtgcaatttactcaagaacagggagggaagaaagctaggacagaaagaaaagggcagctaatacctggccagctttcattatgcacctcttggttgagaggtgtggtcgtggtggtgcctactgacctgcaatgcaatggccgcaacagccgccaccccccatatgaatctcataatttattctcttcctttccacacaaacaccaacctttctatatagcatcccctcccctcaagtctcaacactttgccgtccagttgccctcttcttctcttctcttctccttcccctgctctgctcaggtttgcagaatctgaattctcccctgcatttgcaatgcaatttggagttgttgttaccttttgcaaatttcatagtttcatctcattgagtcattgtggttaatagcttggggctacttattgttgaatgtacttttatgcttatggtatattttgatctttttcatatgtaattcttgaatgatcttgagaaattaagattttttttagcacatgagggtatctctttttctttaagtcgaagcgaagattgttgtgtatgcttggtgtagactcttgaatgttcagctttggtagttggtccttctctttttgtctttgtgctgtgctgagatctaaaagacataagtatcttttttgttgttgaagcaaccagtttatcatgtgtcctgattttggtaggtgacactatcagactactactataatgtgaccacctaaactagatctaatgatcgtgatgtcactaagcagttcagttcaaatacagatagatctcagccaaaaaacaaacaaacattttggtttttatgatcaagaaaattcatcttgcattgatcactgtacaatgtacattgcttaaatgatctcagggatcaggatcagaggagaagagaagatggagttcaaagcagccatgt

SEQ ID NO: 53504 - DNA, 1501 bp, Oryza sativa
tttggatgctcaacatgaattttacaaggaaaatatccgcatggaagtatgactgtaaaacatctaaaggagtaaagtacaccgtactatctctgtttcatattataagtcattttatctatttttatccagtcaattttttttagatttaatcaagtttatagaaaaaatttagcaacatctataacactaagttagtttaattaaatgtaatattgaatatatttttaataatatcattgttttgtgtttaaaatattgctatatatttttaaacttgatgaaactttaaaaaataattagtagaaatggttgaaacgacgtctaatatgaaacacgggtgagtacgacgacattataagactacaatgattaaagggcatcacaatcaatgaatcaaatcaaacccattaaaaaacaaaactcaaaccaactagttactcccaaaggagaactggagatcgtacagtcgtgcaagtttctgtttttattgattaggattatacttccaagagcacggcttgacacatttttcacatatgccatatctctacactacacatgacgcctatttcattatttaaaaatatctacaccacaactatcatattcgcacgaacagagaggtatggaaattaaacgcactaatagccctctggactctggagcatgggcatctgcatacccgtttaatgccatcagcatcaaactaaggtgttgctaggcaaatcttcatataagttttaaaattttatttcagattgatttcagtggtttacttagtaattttcgttcattttcgttgcttgttaatctacctaaaattacttataaaaaatcatattcgaaaattcaaaatcaaattaggtcgtaatgcacgtcaaagtcaagtgcggtatgttaagggtctattgggttcaccgattgaaaaaacagaactgaataatatttcctccgtatcgaaataaataaaattaatattggatattacatactatagtactacaaattttagatataaagtaagtgcctacttcttctgtaaaaaaacaaacctagaattggatgtgacaaaacatagtataataagtatggacatacttgttataaaagtggctccaaaatcacatcggaaaccaaacacggaagaaaacgctataagatcaatgtgtgttttaattcttattctgtgataaacaattggcatgttttggagataatcaattttcaggtgatgatcggattcactgttattttatgtgaccggtccgaccgggtggaggttgccagtcagaccggtgctatgtgtgtggtcagaccggccaggcccgcggtctgaccggccgacgctgagtcggtttcggtttcgggttgtttctttggatatccgtgattgtttcatggttatggtttctagatggattctatacgtatgtaatactgttgtttgctactaatgagtcaagttgggaatagcttggtctcggaatatggtttctgt

SEQ ID NO: 53505 - DNA, 1112 bp, Oryza sativa
taggataataataagcatgtcgtaaagaaaataaagatctacactgcatcaaatataagtacaaacccgtgtgtaatccaagtactcgagtttcagtagacagttaaatctaacttctctacaaaccccagaagtatgttcaatttttcagtggaacatgagaattattctgaaaagtctacaggaaatgaataatttctgatttgaaagttaaacatgctaatatgctatgagtgcctttcaattcaaatcctcagagggagccttggaaatcatatgatccatttgcttttgtgtagtattccaactacatatagaaatgacaacacataacataaagagtgcggactaggtatttttttacagaaatgctacaggacagtatcccgttcggacgggatgatacccggtaggtatcaggtgatacttgtgaagtatcacgtgatacttgatacctaactgatattgtaccgtctgaacgggataccgttatatagcaaccccttttttaagaaagtgcaaataatcgcattggacagctcttaatccattttttgggggttatatgtgagaatcaacaagtgcaccctctggccagttctggactgttattttccgcctaacataaactgtccccttaatattactgattaatctatgtgaaatatatggcctgtgagaaagatactgttctgtcgaaggccccaggaccctatatttaattgttggggaataggttcattggttattgtttaataaggctataaatggttgattattgttcatatttccttatagttacttcccttatgcttggacagatttaacacaaaggcaatctttagtgcaaagcaaaagaatgatttacttgctatgttttctgccacgtagtttacttttttagcgtcttaccatgttgcttaagcattgttatgggaagtactgcaatttagaaaatactatccaaatcatgaaaacaaattgtaagctggctagctaacgtctaattataatctttaatgcaaataatatgtagcacctcaaatgagtgctgctgtttggtcatgctgaaacagaggtgtgatttcgacattaacctttgttaacctcta

SEQ ID NO: 53506 - DNA, 1501 bp, Oryza sativa
tacccggctatacagatctaactccaaaccaggagctaagcaaattattaccaggtataacatccataattattgtgagaggtgtgagactaatcacgaaaaacattgctcaacccgcccataaccgcgggcacggctattcgaatagttttactctggcaagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtggacttatctccgccacttctcagtctggtgctccgcaatgaaccatgctatacaaaaggtaaagccgttgcccacgttggcttgtggttggcacggttaatgtttcacaatagtagcttgcgaaccggtccttaattgtcatgagcacgactctcaaaaccatgtgctcacaacccaccattatcaagttttagttggcaagtaattaattaaccaatcacgattgactatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaagagagaatttaaatataggatcaacatgctcaaaggattgtgtttaggatctgtgtgacttgccttgcaatattcggtcttcaattaatcttcttgaatacttccggcgcactcgcgaaccttcgaaacgacggaaacgacaagctaacacgcaaaacgaagaaaaagactaataaaaaccaaataaacagtacataaaaaataaacaaacatgtagatcataattttagatgaattatgagacttgaacggcctcattctgacttcatatgaatttattacgaattttacaagatttaatctaattaaagcccatttaaaaagaattaaataaatttaattctatttatggataattttaatatgtagatctttattttatataacttttgcaacttgaaccacgttaaactgagttacaatgaattagttatgaattttcaaagattaaatcggattaaatcctttatatagattttaattgaattatgacgcaataatgaattatttttgaaaaggaaaagaggattattgcgtcagcgggtcgggttcatggtggaccgggtgcatggcggcggctcacggaaacgaacggccgagatcgatccaaccaaaacgaacggccgagatctatcggtccacggccagagcacgggagacgacgacga

SEQ ID NO: 53507 - DNA, 390 bp, Oryza sativa
atagaaacaatagctttaaacgggatcaacatgctcaaagggttgtttgggatctgtgtggcttgccttgctggccttggaactcttcaaagtcttctcctgcgaaatcggactctctgggaacgtcggaatctaaggagaaaagagcaaaatccccaaaacagcacattaacaagcatgaacagtacatgtggatatttttaacatgtagatctcaattttagaaaaatctagagacttgaaccaactaaatccgagctaagatgaattagttatgaattttcaaagattaaatcggattaaaacacttatatagattttaattgaattatgacgcaataatgaattatttttgaaaagggaaaggggattattgcgtcatcggctagg

SEQ ID NO: 53508 - DNA, 1501 bp, Oryza sativa
tttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcatggctgttcgaacagtttgttaacctctgcagagggggtacactttacccacacgacattactaacccggatcacccagcccgtggggatcagccacgtcgggagacctccaagctttcatggcaaggcatttccaaagccgacacaggtttaccttatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccatacacccggtacgtttcccggtccgcggttttggaaattcatttagttcgcaagcaccgacccaggtgtcgggttttccaagtcttttgtaaaactccagttttacgcaagttgttactcagattttaagtttgaaggcgaccgtcgatactggcacagggtgcacgaatatcgaggcgcaactggatgattacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcgaatataggctcaagatgtccaaaggtggcttgccttgcttgagatctggagcttgatcctcgaaatcctcgctctgcgggtcttcgggctccgaaactatacgcaaaacgggacaactcaacaaacggcgaaaataaagccctattaatgacctctaagcatgccattagatagatctcgagatttgagaaattttggaatttgaacggagtcaaacggatttacggttgggaagatattgaatttctaagattattggatttttggtctaaaggaaaaggatttaattaaatccttttttttttggaaaagaaaaagaaaagaaaaggggagagggagggaatatagacttccctcgggcggctagggcgcggcccgagagaaagggcggctcggccgagcttaa

SEQ ID NO: 53509 - DNA, 1501 bp, Oryza sativa
tagtctcatttgcgaaagcagcatttagcaaagagttaagagtagtaaaacagtagagtaattaattagaaattttaatcaacactgaacagcacacccatgctgcacaggcccaaccatcctgaacaaccatacccggctatacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgttggcttgtggttggcacggttaatgtttcacaatagtagctcgcgaaccggtccttaattgtcatgagcgcgactctcaaaaccatatgctcacaacccaccattatcaagttttagttggcaagtaattaattaaccaatcacgattgactatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacctagtgacattcgaaaataaatgcacagttgaaataaagagagaatttaaatataggatcaacatgctcaaaggattgtgtttaggatctatgtgactttccttgcaataatcggtcttcaattaatcttctgaacactcccgacgcactcacgaaccttcgcaacgatggaaacaacaagctaacacgcaaaacgaagaaaaagactaataaaaaccaaataaacagtacaaaaacaagcataaacagtacatataaagtaaagaaacatgtagatcatgattttagatgaatttagcaacttgaaccactcaaaaccgagttacgatgatttagttatgaatttccgaagattaaatcggattaaatcctttatataggttttaattgaattatgacgcaataatgaattatttttgaaaaggaaaagaggattattgcgtcagcgggtcgggttcatggtggaccgggtgcatggcggcggctcacggaaacgaacggccgagatcgatccaaccaaaacgaacggccgagatctatcggtccacggccggaccacgggagacgacgacga

SEQ ID NO: 53510 - DNA, 1501 bp, Oryza sativa
gataaaaatagatgaactataattttaaaaaaaattaaaaaaaattattgatcaggttcctgggcaccgccactcttcaatgtagctccgtccctgagcagtggtaagctgtatgagagaggagagaagaggaaaggagagacaaagtgagagcggacgatgagcattggctttgcgagaaaagtgatgagtgcagagggagtgaactactctctccttcccaaattgattattatactatatattatgcaccaagagacaagaccaaggccctgtttggttctatgggctaattattagcccccaccttttactcctgaattagccctcaatgatccaaacaggtgggctaatttgaggctaaagtgaattagccccccttaaaacattagcccctccaaggggtgctaatggggctaattttatgtggggaccataaaaagcagttctctctctccctctgtctccaccttttagccttgaattagcccatggatccaaacatactaccctagactaatgtttagcctaccaattcatgactaaacattagccctgggctaatcttctaaacaggacccaataattatttaaatcatatcaattaagacatcatgcacacattctcccataatgtatgcatcgattaaaacacaatgccaatcacaacttagcatgcgtatatttttccatgctacattaattgtattctgatgaaatatgtgtccatgcggttatataataattaatttgagaaattttgaattccattatatgatgatcaatttagaaaggagggaatacatgtgtgaaaggaagcttaagttatttaatatgatgtgaagttggtgtgccgagcattattacaatttacttattgtattcataagttactaaaagagttacatgtgagttggataaaattgaagcagctgcctactctacgagtatcgacctcactctacgagaggctggaattagaaaacgagccgagctatacaatagagaatctggtaagcaaccaaatctttccttttcacggagcagcccagccttcccttttcctccgttttctctaaggtgtatgagaaaaaagaaacatactcaactaaataataccccactgtaaaataaaataattggatgtaaaatatcctactactctatccgtttcgaattataaagcgtccttatttaaaaaaaatcaaaatcggtgacttttgactaataatcaatatctacaacaagtattacatatgttaataataagattgcattttaaaatactttcatgtaatattaactttatagttgttgatgatataatatgaaataaattaatggtcaaagtatgtcgttgaagactgtgtaaaaaatataggccttataatttatacttcctccatcccaaataaatacagctttacactattcatgtttaacgtttgaccgttcgtcttatttgatttttttttaagattagtatttttattgttattaa

SEQ ID NO: 53511 - DNA, 1501 bp, Oryza sativa
gtgtcgccggcgactcctgcgatcccaacgatggcattgggccgttgctgctgctgctgctgctcctcctccacaccctcctcatccttgctcatgagagtagcgaggccgtggaagaagaagaatggtctctctctctctctctctcgttttctctgcgattttatgattgctgctgctgctgcattggaataatactcggctttcagtgggttataaagaggggggagaaaaaaccgggcgcgagcgatcgaggtcagcagcagctgcacgggggcatgtcctcgcgcgtgccagcggcgtcgggatccggaccgcgcatcaatgcgtgcgaacgaacgaacgaacgcacgaacgaatgcgtgcgcagcgtgcgtggttgtcaaacggaggccaacagccacgttaaatatcgtagcgtgacaggcaggggcagggcaggggcaggggcaggggtggattattcgcggaatgcgcgtacgtcgtacaccgatcgataggttcgtacgcgcggggcgcatttggtagagatggatcgatcgatccgtcggtgggatgagaagattacgtttgtttgccacatgagttggggagtacgagtacgagtaccgtggaggtattatgtactgggtaccgacgctttgatttcgctgcggggggattaaagagccgggtttacatggggccacgttaataaagagagagggcgaggaggaggggaaaaaaaaacgccttgtcagagaatgaactcctccaccagtgaaccgtgaggtcccctttgtgagttcggctggaggcagcgggtgagatttgagggcttggtgagcggagctgtgtgatcttgatggggttaggcccctccaagacgatgagacaaaaaatatttatacaggttcgggccgctatgaagcgtaataccctactcctgtgcatgattgattgaatgtagaacaccagtgcttggggttgcgagacccaagcgccagttcgctcggaagtccccccctccaccactaggcctggacctccttttatacatcaaggggttaccacatgggtctaacaacctaacctagctccggtggagaagtattataatatttgcattaaatgcatgtcttgtctcttgacttgggaagctaagcacacgtcatcttgatgatggagcctgttaaatcttgccgcctgacacgggggtgcccctgtcagtcaccatttaatgggtgaagacttctgagctcctattacaccgggaaacgggagccttgcattgaccagagcgggaggaccgactccggctgggataagaggatgagaacctctcaccatcattatttgatgggatatgtcgggctgcacgtcgcctgacacacgcgatggtgcgcctgacatcttgggtcccatcattcattcgatcggtcacagaccggttgagtgcactgcataccgcattaaatgcggcgtggcgcgaccgcttgggatgccataaatgcgggtaggt

SEQ ID NO: 53512 - DNA, 1501 bp, Oryza sativa
cggcggtggtgacccccttgatctaatttttggttttggtttggatatatatgtgtacatgcatcatgatttgtgtgattgaactccgattgtgattgttatttttttccggggtttgattggattcggattgggattttgggggagggggggcgacgaagcgggacgaaaaaccagtgtgacgaccggaaaaattcgaatatttatattagttatagattaaacatagactaataataaaataaattacagatttagcctgtaaactgcaagacaaatttattaagcctaattaatccgtcattagcaaatgtttactgtagcaccacattgtcagattatggagcaattaggcttaaaagattcgtctcgcaattttatacgcaatctgtgtaattagtttttttcgtttatatttaatactccgtgcatgtgtttaaatatttgatgtgacatggcgaaaaattttgctagaggatctaaactttttcgtttatatttaatactccgtgtatgtgttcaaacatttgattgctaaggtgatttttgaaactcatacagattaagacgaagcttaagtgtttatacaaaacgagattgtattaacgtataattaattgagtttaattaagtattacaaatttaaaaaatatatttatctgatattttagaataactttcatataaaattttttttacacaaaacataccgtttagtagtttgaaaagcatgtcatgaatatccaaattttcatccaaccattccaaagcttacttcaaaatatggatcttttgaccacgccattccatccaacgtggcaatataacatcgacacgtcaccacaacgggcgtgatagttttatcttatcacgttagtcagggtgacgaggccaaataacattgtcacatccgttaggccggcgtgaccaaataacgatggaacattaggcagaccggcatgacagtatgcgtagctaaaagattcaaatttttaaaataagttttttcaattgtttttttaattaaaaataaaaaggttcaagacataacaaaaaaatccacgctcaggcctcacgcagtaatgccgtggtacgtgcactgacttggcattctagagcacagcgtggcatgcgctatccccgttcaaataccccaatgggtaaatccggtccgtccacgtgtaaaccggctcgggtcgggctcgccaaaccatcgacagaagcgaagccgggtccaaccccaccactcgcccagttgtccgcgcacccctctgacgtggtcactgacaggtgggcccgagagcggtggggtccacatgtcagtcaccacgttcctccgccttcgccgtcagctttccccttcccgaagcttcgccaatctcccctcctctctctctctctctctcctccccgcggtcgccgacgacctcgccaccgaccccgccgccggacgcgaggaagagacggggggagccccggaggcaggagcggcgggagggga

SEQ ID NO: 53513 - DNA, 1501 bp, Oryza sativa
agccacattctgtaacgaacagcttgagagacccattttgattcttcatccccatggaaatcccaacatccattccatcaaccttagcgaaaaggaatcatgaatacatcttgtaccttcgtatatatacatgtcaagggtgtctagtactcaaataatacaggtaaataaggtgtaagtgccataggtgacattgtttcggtgtaaactttcaaaaacacaactgagacgtttttactttttaaaaaagaagcagcttataattccaacaaattaactgaggagcatataggatatctatgttattgaaatgttgcttgcctgctgcaatgctgctatttaggtgcttagaattgtaaactccattgagctaaaatgatctagagaaaaagttaagatcatcttgaagtaaatcctaagcacaaatgccagctgctcctaataggcagcccacatgtcaccccaatatgcaccgtgcaacaagtaaccagctattgtgcctatcaatgtaaattactcatgtaccaactaaagaactagatttgaaagtgtcttcaaagctactcaatttcataacgtgctggattctactttacatacatgtttcattccatacatgccaataagcgcaaattcagacactaaaccactaattttgaacattaacttgtcaatcatggaagtccccctccaatctagcatcatctctcgaactgtgaaaaaaacaacaacaattgaacgcatgaataccgcgacccatacctgaatcgaggcattaccgctgtcagagatcgtgacgacccaggcgctataggagtagctccaccccatagtaagattaacgctggacagcgacgcggccaccacgatcccgtcgtccccgacggcgacggtggagtcgtcgaccgccacgccgtggaggacgatgccggaggcgaccatgtccacggtgccgatgaccgggatgctcacggacctctcgatgtcgggcacctccaggggcacgatggcctccgcggcgcgggacacgaggaggtccttgacgaagtcgaggcccgactgggagatgacggcggagatgtgcggcgacgcggaggcggcggagaggaaggtgaggaggaggaggaggagggggagggtggggagaggggcggcggctgccgccatggcgacgccggcgccggcgaggcgagagaggctagggattggggaggaggaggtggaggcggtggccggagtgggagtggcgtgagggagaaggcggcggcatgggcgccgccgtcgggtagtcgcggcgggtttgaacggtcgtcttccccggggagtggccgtggtgacgtggcagagacgtggctaggcggggaacagcggcggtaaatgcctgtccatgggctcatgccgcgtatatcctcttgaaaaataggaattcaatatttcatgattgaggctgtgtttagatgcagggtgtaaatttttagtgtgtcatattggatatatgaac

SEQ ID NO: 53514 - DNA, 1501 bp, Oryza sativa
cttcttattgactgacatgcatgctactgctagctagtgcaacttgagagacattagcaccaacaggaagagagttaaaaattaatttattttacgatggaccttttgagcacggcgccgatgaggcggagatgggtctgctggaggatgttgggcgaggtccgcggtggcacggcgcccaagtacaccacgtataccccacgccgctcgccgccgccgccatttcctcctccagccgcggcaccaccaccaccgctggcgccggcggcgagcagcaaggccaagacgaagcagatcagcggcagcaaccacatgattgctcgtataatttttatttgtactgcaccggccggtcagttcaagctctgctctctctctctctccccctctctctctctctggccacgaaacgatcgcactatgtatggctgcatttataagcgcgcgcgtgcgacgtcgtcacgtccgtacgtgccggtgaccggaggtaataagagcagtataaacatacgtgaaggagataagagagaggagagaagaaaaacgggttatagatatacatcgctgtagcacgaactttaaaatgtatgtgtatatatatgtgtgtatatatatatatatatatgatatgtaggaccaattatcatggtgtattatatatttgtaattaactagtataaattagttattagatagactatagatgatttagagttagtagttggctggagtatactactctttctgttttacaacgtaagtcattctagcatttactatatttatattgatattaatgaatctagacatatatatctatttagatttattatcattaatataaatatagaaaatgttagaatggaagtattgaggtagtggtcgcctggtgggatcggatcggatcggatcagccggcgcttgcgcgtgcgtgcgcatgatatgtggctgcgagcgcgaggggtaggttaattgtggatcgggtgcgccgtgatggtgcgtgcaccactgcgctgcgctggctagctactcgagtagagtagagtatagtatatcactagtcttggagtgcagccgcgcactagtgcgcgatctcaccttctctcgagcatgcgccgagcctaaatagctactagtagtatagacaaagttacctagttgcattctagtaccatccacatattttttgtcaggattcagtaagttcatcatcatatactccgctaatgtctgtaccaaatcctaagtgtaagcaggcttatcatgtttgacatccccaactagtgacaacaataatatcacaagatgaatagtatctttcaagttagtttggaaacatcaatgacttccccaaacctaatccaaaataagtgttctatctctcctttacgttccttgattcaatcaccataattcgtcctactttgacatgaacaaggtttgacacaacctagtatatgcaaaacagattattttacttgcccaacacaatacggagcat

SEQ ID NO: 53515 - DNA, 302 bp, Oryza sativa
attgtgagctatcattaagccatcattaaataatagtgaagcattagttatcccaattgtgtgctaatgtttctaagcatggctaagcaattatgtctaacatctagctgaaccaatatataaagctcaactagtcaaattataataacacaaggtatcaaggaatagagtaatcaatgcaaacaggccataacaaaggaataagttcacaccacccggtgacattaaaaaataaatgcacagttgaaacaaatagagaatttaaatataggatcaacatgctcaaaggaattgtgtttagg

SEQ ID NO: 53516 - DNA, 1501 bp, Oryza sativa
gctagcatcgagttcccgaaaccgcgtagatgctctcaccgccgggaatcgatccctcgtggcctcgccgccgtttccctcttcccccccctccgccggttgtcgccgccgtcaagcttcctccggcaaatccgagccgttggctcgtctcccctcatcacgagcaaccgcccggtgtgctcgcttttgtccgtatcgccgtggttcgctccgccgctcgccgccgccgcccgccgtccattcgcggccgggtcatcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagccctgtccaccggctctctctctcctccctcccgcgcgcgcgcgtcttgggccgctctgggccgccttcttgggccggccggcccgttaagctcggccgagccgccctttctctcgggccgcgccctagccgcccgagggaagtctatattccctccctctccccttttcttttctttttcttttccaaaaaaaaaaggatttaattaaatccttttcctttagaccaaaaatccaataatcttagaaattcaatatcttcccaaccgtaaatccgtttgactccgttcaaattccaaaatttctcaaatctcgagatctatctaatggcatgcttagaggtcattaatagggctttattttcgccgtttgttgagttgtcccgttttgcgtatagtttcggagcccgaagacccgcagagcgaggatttcgaggatcaagctccagatctcaagcaaggcaagccacctttggacatcttgagcctatattcgaaatctaattatattgcttgcaaaatattatgcattgataggattgcacttaatctgttgttccgtctgcaaggcagattggcagacctacctaacttgttgcatttgatccttccattgttaattgctataccatgtccccttgtaatcatccagttgcgcctcgatattcgtgcaccctgtgccagtatcgacggtcgccttcaaacttaaaatctgagtaacaacttgcgtaaaactggagttttacaaaagacttggaaaacccgacacctgggtcggtgcttgcgaactaaatgaatttccaaaaccgcggaccgggaaacgtaccgggtgtatggtttcccgctctcgcacttaaggaccgattccttggaatttcatccaaacataagacaagtacgaccacatgggtggaatgggacacccctggctgagtaactagcttatcaggggagccttgatgccgaga

SEQ ID NO: 53517 - DNA, 508 bp, Oryza sativa
gggtcttgtcacaatcactcaacatggtgacgtgtctggccgggcacggtaacatgctggtgggttgtgtcttgtgggtacaatggtacacctctggccagagtaaaacaattcgaatagccgtgcccgcggttatgggcgggtcgaacaatgtctttcgtgattagtcccacactactcattaataataatgtggtaattgatggtaattaatttagctcctggtttggaatggtacattcctggtttggagataaatctgtgcagccgggtatggttgttcaggatggttgggcctgtgcagcatgggtgtgctgttcagagttgattaatattgatgattaattactctactgttttacaatttttactatttgctaaatgcttcttttgcaaatgaaccctatattatgccattctttggtatccttgtgcacttgcatatttgctgtgtggcttgctgagtatgtcatatgctcaccttgctataatcaatcaaacctcagtt

SEQ ID NO: 53518 - DNA, 792 bp, Oryza sativa
gcacacacgcactttggatgagttgtttttaactaaaaagttgttgcaaaaatatcaaattgcctttcatgctagtttgatgtttaacatgatttctgctaaaaagttaaaacaacctcatgttgttttggattgctcaacatgtaatttgaataagatgaaactaaaagatgctttaggtcgtgttgagtacatggaagatgttgtgaaaaacaatgaagtgctttcttgccccaaatgtcgtaaaaacaaaggtgttgtcacatcctgattttcgttttaggatttaaaaaatatttaataaattattattagaatttatattaaatggtcattaatttataaagtgaagttaaatgtgggaaataaaatttcctaaatataaagcatggatggatttaatttttattaaattctccatggttaattatactctctggaatattctcggatttttcggaactcaattcctaattttaaccctacaaagaacatttcagtaattatccacatattaaattaatcattaaatggtctgattataatttttttaagtactttgagtgtccaagtattttcaggatttttcttgaaactatttgagcattggaagtatttttaacaattcaaagatcatttcagtgattattttaattggaaaaagtttttaaatcctctcctaagccgttgggctaatttcagcccaacatgtctctccctcgcgcgcgtgctgtgcagcccaagtcggcccagccgagctcctcctctttctttctttgctttgttttcagc

SEQ ID NO: 53519 - DNA, 1501 bp, Oryza sativa
gggcgcgccgccgctgacgccgccactaccgccggatccatcgctgccggatctagggcgggagggaggcgagaggggaggagggagccgccgccaccgccgacggactcacccgccgacgccatcgacaccgccatcgccgctggatctggggcaggagggaggcgagaggggagaagggagccgcagccgccaccggatctgccgcgggagggaggctagagggggtggagggagccgccgcccccaccctcggatctgtcgcggccgccaccaacccgccaccgccgacccgagagggagaggaggaggggcgccgccgtggctttgactgagaggatcacctccccgggagccgccggtggtggggagaacgccaccgcgctgccggtggtgggggaggacgttgccgcgccgccagtggtgggggagacgccatcgccgctcgcggggggagggcgccgcctctgctcgggagggagggcgccgccgcggaccgccgccgctcacggggggaggggtgccgccaccgctcgggggcacggaggggagggcggcgaagtgaaatgggagggaggggagggaaatgggctagggttttggcggctgagagggagggggttttgtttccccgatatcgacgctcggccgtccgatcaaaaccctagaaatcggacggccggtgtcatccgggccgaaatcggcccaagagggatcgagagtgaggccacttttctggctcaagcccaggttgcggcttggggaggggaagtgagcccacgcgtgcgcaaaaggccgtgggccgaccggtaagggccgaaaataagtctattttaggtccctcgggccgaaaaaaagagagaataagttcatgtttagtgctcattttttcagaagcattacaattatagttatttctcacacttactttacttgtaaatttatttaattatacacatatacctacttaaaaatatcaaatatttcagcgaatttgtattttaattaattgcatatttttctgatatgtacgcttcccgttgcaacgcacgggcacttttgctaaaccaaacaacacttttggttaatatacacactccgtaatcacccggtgcaacgtacggacacttttgctagtactttaaatatgtgttcatatatccaatatgacacactaaaaatttacaccctgcatctaaacacagcctcaatcatgaaatattgaattcctatttttcaagaggatatacgcggcatgagcccatggacaggcatttaccgccgctgttccccgcctagccacgtctctgccacgtcaccacggccactccccggggaagacgaccgttcaaacccgccgcgactacccgacggcggcgcccatgccgccgccttctccctcacgccactcccactccggccaccgcctccacctcctcctccccaatccctagcctctctcgcctcgccggcgccggcgtcgccatggcggcagccgccg

SEQ ID NO: 53520 - DNA, 1501 bp, Oryza sativa
actgttctggtcttgttatgctgctgctcctcttgaaggcatctgggcttcattctgttgaatagtgctttaacatggcaacagctctgtgagcccatcttttccctctcttctttggtgatgaacgatagtgtcatggcaaatgcgcttatatatgtccatgctccgtattgtgttgggcaagtaaaataatctgttttgcatatactaggttgtgtcaaaccttgttcatgtcaaagtaggacgaattatggtgattgaatcaaggaacgtaaaggagagatagaacacttattttggattaggtttggggaagtcattgatgtttccaaactaacttgaaagatactattcatcttgtgatattattgttgtcactagttggggatgtcaaacatgataagcctgcttacacttaggatttggtacagacattagcggagtatatgatgatgaacttactgaatcctgacaaaaaatatgtggatggtactagaatgcaactaggtaactttgtctatactactagtagctatttaggctcggcgcatgctcgagagaaggtgagatcgcgcactagtgcgcggctgcactccaagactagtgatatactatactctactctactcgagtagctagccagcgcagcgcagtggtgcacgcaccatcacggcgcacccgatccacaattaacctacccctcgcgctcgcagccacatatcatgcgcacgcacgcgcaagcgccggctgatccgatccgatccgatcccaccaggcgaccactacctcaatacttccattctaacattttctatatttatattaatgataataaatctaaatagatatatatgtctagattcattaatatcaatataaatatagtaaatgctagaatgacttacgttgtaaaacagaaagagtagtatactccagccaactactaactctaaatcatctatagtctatctaataactaatttatactagttaattacaaatatataatacaccatgataattggtcctacatatcatatatatatatatatatacacacatatatatacacatacattttaaagttcgtgctacagcgatgtatatctataacccgtttttcttctctcctctctcttatctccttcacgtatgtttatactgctcttattacctccggtcaccggcacgtacggacgtgacgacgtcgcacgcgcgcgcttataaatgcagccatacatagtgcgatcgtttcgtggccagagagagagagagggggagagagagagagagcagagcttgaactgaccggccggtgcagtacaaataaaaattatacgagcaatcatgtggttgctgccgctgatctgcttcgtcttggccttgctgctcgccgccggcgccagcggtggtggtggtgccgcggctggaggaggaaatggcggcggcggcgagcggcgtggggtatacgtggtgtacttgggcgccgtgccaccgcgga

SEQ ID NO: 53521 - DNA, 1501 bp, Oryza sativa
gacgacgagccggttccgccgctccctgaggcggaacgcgccggcgaggccgcggccccacgcgccctcgcctttggcggcgtcgtaccggacggcgctgctgacgatcaccgtggagtttaggagggatatctcgagcacctcagcggcgtcggcgtcgcgcaggaagagcttcggtgggtggtaggagcggttgcaggtgacggcgaagccggcgaggtggcagccggcgccgacgccgaacgggtaggggatgaccatgctgccgcacgagctcgggcagcccggcagcgatacggttagcgcggttgttgccgccattgttgcagcttggagaaacagtgcagccataacaaggataacaggagagggcgccatggagctgatcgattcagtggctcgatcagcagaagaaatactgaagaatggctcacccaagacgaagagtatatacgtccacgggttttgcttgacctgactgaaggagtgaagccacgccacagattttcttttgttcggcaaccacagatttttcatagatggagatattgatatccgatcagtcactcagtcatcgtgctagatcagtacacgccgcgttttctgaccgtgctgtttaatttgtgactttactagtaacagtatatggggactggattctaatagtacatggggagtgtctagatagttactcccttcatttcaaattgatcatcatataatgtttgtgcaccaagactaaggattatttaaactacattagtcaacacaccatacaaaatatacacacattctcccatgatgcatatagtatcgactaaaacacaagcatacaccacattatacgatgttatattaattgtattatgatgaaatccatatgtccacatggttatataatgatcattttgaaaaaaaaatgattttccttatgtgatgttcaatttgggaaggatcaaagggagtataatgttgtgatgatgatgatgatgatattggagtagtagactactacccccgtttcataatgtaagactttctagtattgcccacatacatatagatgttaatgaatctaaacacatacatatgtctagattcattaacatataaatgaatgtagacaatgctagaaagtcttatattatgaaatggaggaagtatttactgttacatgctagtttgttctagctcatccttgttctttgaaaaacaaatcacgaagttgtgcaagaaaaaaaactcaaaggcttaatcagtgctaaaatctgcgtgaattgttatgattttttgaagagatcctggcttcgtcactagtaagtagttacagatcagataaagatgatgatttagcccaaaaggtgttactgatcacactacttgtactttccgcaagtcatgcactcgatcaaatcggcaaaacttaacaactatatcaaattatcaaccagaagctacgggaccacctatatatttgtcgacaaattttcttctaaaaatt

SEQ ID NO: 53522 - DNA, 1501 bp, Oryza sativa
gtcgtatccatagtagccatggtcacatcatcctcccttcttcacggaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccagaactacaagatgttctaaatccgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatacttataatcagcacacaaagaaatagtagaacagttgtggcatggatataagtgaaacattatcacacaactcttctttatcacaaggaacaacaagtaaatcaacttgtgacaaaggcaactcagcaattgattccactaatggttgctctactatagcatgaaaagtggacaagtgtagctcaccttgagaatactcaccttcatttctctcagcaccatttaatttaccttgcgaacttttttcagacatcgcaggtgcttcatcctctttcttctcaagtataccattctccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgtcacattatcaagcaaaacctgaatttcagaattaagcccattgaaaaatctacgcgttgtattttcattgcactctttgagaccactgtagatgatacagaccttaaattcatgaatgtactccctaacagttctgtcaccttgtttcagatgttctaatttctcccgaagagtacatttgtaataagatgtcacaaagcgttttctcatcatggttttcaattcatcccaagtttcaggtttattactaacataagtccaccaaaataatgcagaagaggtaaatttattactagcagccttaatcatttgagcatcagaaaaatcatatatatcaaattcattgtctactgctagctcccaatcaatgtatgcaacagaatcatacttcccatcatagaagggtaacttagatgcaacttgttcaaaattatagtcatgtacctcatatgtatcatttggagaagtcgtcatatctcgtcgaaggtgtagaagtcgatgttctcgtattcccttacgcaatcctgccatggttagtagcaaacaagaaacacacaaaaata

SEQ ID NO: 53523 - DNA, 160 bp, Oryza sativa
attgcgatctggtagaacacggattcacccaatgaacccgacattttgaggaggagaagttcggggattcgaatccggaaggttggaaagtttcagattttgggtggataagttgtttggtttaggtttaaaaaaccctagttggaatcaagaagaaaaa

SEQ ID NO: 53524 - DNA, 1501 bp, Oryza sativa
tttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacagtgcattagtgagtccgaaagacataactatgcatttgaacaacccgtaccaagtgatgaatgctgtctttggaatatcctcttcacggatcctcaactggtgatagcctgatcgcaggtctatcttagagaacaccgtagctcctttaaactgatcaaacagatcatcaatccttggcaaagggtacttgttcttaatagtgacctcattgagtgcgtggtagtcaacgcacatcctcttggttttgtctttattctccacaaagataaccggagcaccccaaggcgacgtgctcgggcagatgcatcccttttgtaactgttcatcaacttgcttcttgacatccgccaactcgttggctcccattctatacggcctcttgtagatcggtgcagttctaggtaccaagtcaattcggaactcaatatccctttttggtggaatggttgtcaggacatctggaaaaacctctggatactcgctgacgataggaatatcctccaacttcttagtggttttctccactgctacttcttgttcttcaccagtagactggttcagactgatcccttgcttctgcggtacttgagggaaggtccacgagatcaccttttccctaacaaattaaggttaataatacatgcgatcgactaaatcataaaaagtatttgatctcctcaacaactagatcatcttcatccgacatcgacatgccatacgcctattccacttgctcgacgataggtatggtgtccattacctaaaattggcaaacaaatacacagttttagaatccaattgatctctatctagaaacaaacaaaattaactctacactagagaaaaactgcacatatttatactatcagcacaagggcatcagtgaatctcacaaaagaaaagaggagaagtgtagacaggttctacagttgattatgaactataatctatcttgatgtgacca

SEQ ID NO: 53525 - DNA, 1501 bp, Oryza sativa
atccacaccccgcacaattagagtggactagttgtccaaacacaaatatatctttaagataactgtgcatgtcaccgatacttatgatcatacttaggtgcttcgatgaatcattgaggttaaacttcatccacctcgctattatccaccgcactgcacgggcattttgttggtcacgtatcgataacgacagaaaccattaagattatagtgttttgtgaattttgatttagttacagctcgtcacgccgatttacgctaacatggcgttccagagagtgatgccaggtggcgccactcatgttattttcggactccacatgcagtgcagtgctagggccttttttttcctttcgcatacatcaagttattagttctatttttttcgtaattaggccgtgttattaacgttaacacttttttcaaacaaactattattgtgtttttcccctttttaattctaatataaaacttccactttaaaatttactctaccaattatttaaactttcaacttatatttgaaaactttgaattcaacttttaaaactttcagttcaaaatttaaagctttaaactcatatttgaaaactttcaactcacttccaacttatttttgaaaactttcaactgaaatatatattttaaatcttgaaactttcaactaaaattttaaaatttaaattcagttttaaaaatttttagctcaaaatttgaaagtgttcaaataaaaattgaaaactttcagttcaactttcaattcatatttaaaaattttatatcaattatttatttttttaaaaaatagtttacccataaaaaagggattagcgctaagtgctagagattagcggcttggtgagggtgacgtaggctgcgctcgtctgtgctacttgctccgcctccgccatcgcgcatgcgtgcattaggattcccggtatgaatatgtattgtgaactactatgggcttctaaaaagtagttttgtaacctcataaatttgttcttacatgcatcaattaattaatttgcctttcactgaaatttgaactttgtacaaaagtttaaaggtagagttatattttgggttgagagagtagcatgtttttaaaggacgtaactacaccgagagtactagctggatagtgctaaagagagacaccattctatccaaaaaaaagctactagtacactcaatatctatatatttttttcttcttagagaagtttctcttaaattactcatccgatttataatccaattacaccgttgtgttcgtaacaattaaatctttacaacaagatctcacatgattatattttgatgaaaaatcacaaattacttttatgatatgtctaaattacttctagatttcactaagttacttcttatatatataaaagtaaattcagtaaagcttaaaagtaatttacatatattatagaagtaacttataaaaaaagaaagtaactttaatttagaactatatctagattcatta

SEQ ID NO: 53526 - DNA, 812 bp, Oryza sativa
gtcttacactgaagttgtggccaagttgcagcctgcagcagtgtcttttccttctaaaagtccaaatgctcctttcaccggcctaaccaggaaattgcagacttgactcgtcacttggggttcatcaagcttgactcttgacaacttgtctcgtactttcctgtgctaatttaactgcataaaccatgtagagttgaatcagtttttgatagtatccactggtagcaacacaaagtcttcgggtcaatactagagatataaccaagttgagtcccccagcatcctcacctgctgttccgattcacatcccggcagattgtacactaattttagagaagaggcattgctgcccagctttatactgaaagcataacagattgtacactaatagactatgccaatcggagaagctgtgctgtccgcgttcatgcaggcgcttttcgagaaagcggtggccgctgcttccagcgagctgaaattccctcaaaacatagctgtggagctgcagaatctatcaagcagtctgtcgacaattctggctcacgttgaagatgcagaggagcggcagctgaaagatcaggcggcaagaagctggctttccaggctgaaggacgtcgcctatgagatggatgacctgcttgatgagcatgctgctgaagtcctccgatccaaacttgcaggcccatccaactatcaccatctgaaggttagaatctgcttctgctgcatttggttgaaaaatgggttatttaacagagatttagtaaaacaaataatgcggattgaggggaagatcgataggcttattaaag

SEQ ID NO: 53527 - DNA, 382 bp, Oryza sativa
ctggattttctttgaagttttccggcaagttgaaaccagtcatgcactaccctgttttcacaaaaaagtgaaaacaattaaggttagcctgcaaaggaaaatggttatatagaggtaaatataaagtattagttcaggtaatctctattatgaatattccccggcaacggcgctagaaatgtttgttggtatttcttacaacattactagaaatataatttccaacaatggcgtagaaatacttctggtatattatggttacagagttcatctgcaggcgcacggatataccattgtagcatttcacccgagagtattccaagggtatcgtatttattttatcccgtgataagatcatgtagagagaacttgactaataatt

SEQ ID NO: 53528 - DNA, 1501 bp, Oryza sativa
cccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttttaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcaccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcaga

SEQ ID NO: 53529 - DNA, 1501 bp, Oryza sativa
ggtggttttcgctaacgtgactcattgacttagttcaaccagctgaatcagcacgtagaacccacatgtcagcatgctctcttccttcttctatcctattaccttactcttcatttttgcccctctcctttccccacatgagcacgcatgacgacgagcagacctccgccggtggaggcaagggatagtagcctccatcggtggtggccatgtggtagatgccgagagctcaacgagtgggcaactagcgtggccttgaggcagagcagcaacgacacgcccctactattgcctccttaaggccctccggtcgctggcgatggacgaatcttcaccgctgtcatgtgaaccagcctgcagggcctcacccccaagctctcggcatggaggcattggggtgcctgtcgccaaggccgccactgttgcgaggaagtggctcgacggccagggggtacgagcacatagaggagaggggcgtaccacaccgacccatgtatactccatgatccctcctccacaactaataaaggcgagatctagaagcgacgacgatgacgggtcgatggaactgcagctcgccggcggccaccccacatttgtgaaggaggggatagggcgaccgttgatgtcgtttgaactgtcgccatgcactgccacgctccagaaggttttccccccatcttgttcttcctccacgccgctatgattagccgtcatggccaacactaccagccactcctactctacctctatcaacaagttcccctcctcttggaatgcattttgacatgctaacttggccatgttcaccgccgaagctcgctgtccagtcgtcaccctgctgcttccctgccactgccctactgagatgtcataaccgagaggaaatatggaggagagaggaggggggagggaggaggaaaaatgtgatgactggactgccatgtcagccaatatcacctttgcctagtcgtcattttatacccattttaaccgttggatgggttgttatacccatttgtgatcaaaggatatgaatcagatttgagggaggcaagtagactttttttttagcaataatggtttatgggcgtattggcgcagggccgcaggcccatagaggaagcgggactctccttcccgtcttccacgtaccgatagcgccccgcgtcattacttcgtcttcatcgctgccttccatgctaagcatagaaacgcatcacacttgcctcccgtggctgtcgcgatcgctgatcgcaatcgcatcgtcgccgaaacgacacgagcaaatcaacgcgaagaagaaaagaaaagaaatcctcccgcttcgctataaaaatcgcccgcttcccccgtcgtccgcttcaatctatgcgggcatcatctctcttcgcggaatcggtgttcactacatctgctgctgctggtcgtcgtcgttgtcctcgtctcgccgccgttcccgttaccctcttcttctccaccggtcgcggctcgccggcga

SEQ ID NO: 53530 - DNA, 273 bp, Oryza sativa
atcacagtattatcattaatgagtagtgtgagactaatcacgaaaaacattgttagacccgcccataaccgcgggcacgggtattcgaatagttttactctagccagagatataccactgtaccctcaagacacagctccacgacatgtcaccatgcgcctcaatactaccacggtacatcggaaaggaactgtgacaatacccctcgcacaacacaactcaccacagtgcaccatacctggaccataatcaccccctctacaaccagaggca

SEQ ID NO: 53531 - DNA, 226 bp, Oryza sativa
ttgttttaggtttggttgtgtgtgtctcgcatgtgattacatcagtggtgggatgtaagtgcatgcgttggtttgttttcgagtgttaggtagttggtgagtttagtggtgtgagagtcttcagtttgtaataatgaaactcacttaagatcaataaaagttaaattaattctctgtcctaagtagttttccccggtttctcttcttgtgctctgtccatgccaga

SEQ ID NO: 53532 - DNA, 1501 bp, Oryza sativa
ttccagagcctcccttacctgaacgccgtcgtcaaggagtcgctccggctgcacccgccgacgccgctgatgctcccgcacaaggccagcacgaacgtcaagatcggcgggtacaacatccccaagggcgccaacgtgatggtgaacgtgtgggcgatcgccagggaccccaaggtgtggagcaacccgctggagtacaggccggagcggttcatcgaggagaacatcgacatcaagggcagcgacttcagggtgctccccttcggcgccggccgccgcgtgtgccccggcgcccagctcggcatcaacctcgtcgcctccatgatcgggcacctcctccaccagttcgagtggtctctccccgagggcaccaggccggaggacgtcaacatgatggagtccaacggcgtcgtcacgttcatgagcacgtcgctgcaggtcatcgccaagcccaggctcgacaacccggacctgtacaagaggttccctgtcgagatgtgatcgaacagtttgctttgctgcctgctgctgctggttatacagacagactggagttctgctttcaaagtttcagctattgctcatgatgttgttgttgtaaaatttgaggtgttaattgccttgtgaatgaacgaatcaatcaatctcgtaaagttatcgagagcagatcgacttttgtaatttgtacaatatgactatgtacttaaggtgttttgttcagatagaattttgtaatatgattaacacgacaagcgatgtattttgaggtgtcattaatgaataataataatgtaatgtaatctgcaatttttctttttttttctttctgttctgtttctgttgagaaacaaagaattaagataattatgatgatgataacatgacgtgggggcgaccttatcttgaggcacgtccaaaaacgtctgcggttgttacacctaaacccagataaagcaaagagcccaaaacgagcgaaggacacgagacgcgctcccagccgtcggatccatccggagcccccgaaaacggacggtggatggagacgccagccccctcacgtcacgccacccccccccccccccaccaaactaacgtggggcccacaccatctccgcttcgggggtgtgatggtgtggatggatagaaccaacggctgacgtgtacccgaacgcgcaacgcgggggagtccaagctaacgtgggccccacacccccctttcccctcctcctctctcttcagatccgcgcgctgaggtcactgtagaacacggcggtggacccggtccacgggattaagccggtgtagtgtagacccgtctgggtggggcccacaacattggtggatcggtctatgcaccgggtccacggaacgggtctcgtgtagaggctctctctctctctctctctgggtgggggttgggtttgcttcgctcgcctcgctttgcccgattcggccggggtcagggtcactggccgagcaaattagggtggaaaatttttta

SEQ ID NO: 53533 - DNA, 1501 bp, Oryza sativa
cttccagcaagaccagtaacatgttctagtagcagataattggatcactggatggctctgctttaagccgatgattcagcagccggacgatgatctatgtacctgaaattatcagcacctaaattatcagcctcctgccaatgatgacgaaccatttgcaattcgcaaagcacaaagcgcggcgattcattcaagaaacgatcaacgaaagagaggtttgaatttgatgttttacgtttaggcggtggcgtcgtcgaggggcttgaaatcctggagctgcttgaagttctcccacgccctctcccacaccttggcctcgtacagcttattggcgccgccgggttccttcacctcgacggtgaggtagtgcatgaacccgcccaccacctgctgcctcaccttcaccaccctctccaactccaacatcgcgttctgcaattagcttagggggtgcttaggttaagggtgtaaaattttagcatatcacatcaagtattatgtaaggtatcgcatgaggtgttcgggcactaaaaaaaactaattataaaatacgtcagtaaaccagaatttattaagcctaattaatcagtcattagtagatatttacggtcacatggacgaatcatgaagcaattagacttaaaagattcgtctcataaattaatcgcaatctatataattaattattcttttagcctatatttaatactttatatttaatactttattgtaaaatttttacgtggaaactaaacatgcccttattgtattttatatttttaccacaatccacacggcgatccacgcaattaacaaggggaaaaaagaaaggggggcgggtgttcttaaatcttacggccttgctgttgtgctcggcgacggcgaaccgggcgagctcgacggtggtgaggtcgttctcgcgcccggccggcgcgtcgtggatgccgcccaccttcacgccgcgtggctgctgcgcctcctcggccatcgccggcgagccgcgaccggtggagaagaagagggtaacgggaacggcggcgagacgaggacaacgacgacgaccagcagcagcagatgtagtgaacaccgattccgcgaagagagatgatgcccgcatagattgaagcggacgacgggggaagcgggcgatttttatagcgaagcgggaggatttcttttcttttcttcttcgcgttgatttgctcgtgtcgtttcggcgacgatgcgattgcgatcagcgatcgcgacagccacgggaggcaagtgtgatgcgtttctatgcttagcatggaaggcagcgatgaagacgaagtaatgacgcggggcgctatcggtacgtggaagacgggaaggagagtcccgcttcctctatgggcctgcggccctgcgccaatacgcccataaaccattattgctaaaaaaaaagtctacttgcctccctcaaatctgattcatatcctttgatcacaaatgggtataacaacccatccaacggttaaaa

SEQ ID NO: 53534 - DNA, 537 bp, Oryza sativa
tgcctcaccatcttcaccattgccactcccattgtcatcaccatcatcacttacttacatctcatcaccctaaacattttccatattttcatcatcactttgaacatactcatctccgcttgaatcctcattctcactgacgggatcgggcgtgggctcacgacgaccaaggcgagtgcggggaggcatggctaaaaaacaaggagcaaaggatggataagcaaaaattttagaagccacatagtgaagtgggagaagggggagtgctgtctgtcaggggcagtcagaccgagagccaaggccggtcagaccgcaagccccaagtcggtcagaccgacgtccataggccggtcagaccggcggctcacggccggtcagaacgacggtcctcggccggtcagaccgccactgacagtagcacaaccgaatccttccacaatccacacaaatgattctaaaaaaattgctaggacaaagtcgcacaagattggaacatgaacatcaaggtgtaggtctatttcattaagattgaagcaa

SEQ ID NO: 53535 - DNA, 1501 bp, Oryza sativa
taggacttatccgtataatttccgagttctgcataatgccttggaaaccaaggacttttgaaataaaatgccgttttcggaccaaaatcacggttcgtgcccgactccttttaataggccaatttctacttggcccacctccttatactggctagcttgaaaatctggccagcccatctcatatgttgcccaatgagctactacgaccttctcctacaagaagtgggtgaggtatgatctaattgatattcttcaatggagacgacggatggaaccaattgcaaacgtgctagtgagccctcggtagagatggacgactatggcaagttgccatggtcagaggcggagcggcggtgcaacatctagtagcaccgacaccggcattctttggcatcaggccgtgaccagcgtccgacaatcatagctccatgttacgtgtcgacgaaactcggctcggcatacatgccggcatggcggacggctatcggcggcgggcactcacggcggcttcgaccctcgtcccggccgcgtgcggtagcgtgggaggcatgccgtgcgtatcggcggcaaggggaggcgggcgtaagctcctcggcatcgctacgggcgacggccgtcaattgcgttgcggatggcctcgaaaggccgtcgagtcggtgtttcagatggcggatcgacgagggaaggtctctggattgattcggcaaccattgacaaaggggaagacgtcatgtggtggcgtctgggtgtcgctacgtgcaggtggcggcgcatgcaggtgctgatgactcagatttgttaccatctacttcatatagatagcaatataacggattattaacatacaagtcacaaccaacattgtcccaagcacgctgatccataagatcggtgatgacgagtgtgttaatatattcatagatcgacgactatgttagccagatagacgacaacttctaggtggtgtcgtgtgttaccgagtgtgaggtgtcgtcgttcgggacagcactccatcattcaattcaacggattatgtatgtgcaccttctggtgtgcacggtaagcgcgttcgggcgcgtggtgccaaacttcgtggtcagcgatataacaagagaagagtcgccgctaaggccagacaaatacatctattcatgcgagaaaataaaacgactagaggcatgatctagcatattactctcgctactgcaaagtattagaatagatgaaaccgatacttatctcgtttatccgatgtaaaggtagccgatccgcttatgcacgtccgcatagcgtatcggcgacgcggcgtcgacgagttgcgtgctggtgtagctgtgtatagcccagcactgtcgacacgtcgttgcacacccatgttgttataggcttggtgaagatcaatacgtgcacgtactagattggttcataaaccaatctgtacattcatgtgcatgtatgcttgtctgcttgatcctttgctcctggatcctagccgcagggt

SEQ ID NO: 53536 - DNA, 1228 bp, Oryza sativa
tgtagcgcgcgtgtcggctagcccgtccgtctgcttgttcttcggaaccccaacttatcatttgtattaaattcctatttgcaataccagattgcttttatcttgttctggcttgtttctacgatttgcttgcaggaatagggttgatatgcaccggcaagatcaacaacccgcggagaggtgtatcgatcgctaaggcgcaacacaacgtctcatacggttgtagtcggatcgtcaacgtttctcccaaatcgtagttatcacaactcaccgaaagatcgggccaacaacagccttgagtgtcgagaggaactcagggttcatcatatctagatgtttgtaagcctgcacagacaagtgataatggaaattacaagatgcaattttcctttgggggaaaaaaaggaatcaacggatttctttgtaaggttggaaattcagtatcacctcttctccggctggttgttggctgctcgacgccttctttctgcatactttgcagctagttccttgtccttctgttttcatccaagatgctaaaagttacaaaactttccaaacagataaatgtatttgcagctaaaatcagaacgataacaggaaatgacctggcttattttgttgaaaaaaggaacacaatttgtgatagagacatttgtgattagaacactaattattttgcaaataatttccgagataactagatacaaattgcaacgagcaatgcgtgaggaaggacatattagctacttcatgaatgaccaatacaacagctaaccgcttagtggaaactgaatgattattcggctacgcatgcttgaaaattagactgaagaaacaagcatatttgtccgtgctaacagtaaccagcagttctgcgttcagtgcctctatagtgcagctgtgagtactttgctaatgccgcacaatgactagcagttcaagatcaaattattagttgctagctgtttcgtgagtaaccaatcagcacctttcaccaattgataactgaaacagtaattagccaattctaatgtagaaaaatgggaataacagtataaaccaatccgattgccaatgtccaaaacaaaatcagattccccagtcaccgatgctcattttaattcaaggaaaaaccgacactttatgggagaaagttagggataatatatatatatatatatatatatatatatatatatatatatatatatatatatatatagga

SEQ ID NO: 53537 - DNA, 1100 bp, Oryza sativa
actgccccgtccttgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcagcccgtgtggtgtctagtggactccgtttgtcggccactcgccttggttgacacacggggtccgctttcgtcgacccgtggaccgtctctgtgtactcggtctaccgcggtcctttaggttgtcatgtggggtccgcatgtcaacagcgcagccttcctgtcttttccaggctagcgcttccacatgttttatagttgcaaagcctaattataataacccgtaaatctccatataacatcattaaacttcggatgatcatatcttggtcatacgaactccgaatcgacccgttcaagtctcttaatgtttgttataacctaaagaactctgtgctttctttttatgtattggtattgcttttttataggcttgtagctttgcttgtgtgcttcgcgtagctttcgtcgttccggaggttcccgaagcgtggttcgcggccgtcgccgaaggttcggaaggccgttatctctgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 53538 - DNA, 283 bp, Oryza sativa
tgatttgtgaaattgaatcgtgcattggctccatatttgctatttgtgattgttatgcatatgtttaaggggaagcttttgcttgtcaatgcaatatatgtccatgtgctctatgtttgattatatatatttgtagtgtttgtcaccaattaccaaaaagggggagattgaagcatctaggcccccggtgttaattttggtaattaatgacaagcgctaattttggactaaccgttgtctttgagctatacattttaagttaggtccacgtcatatgtgcgca

SEQ ID NO: 53539 - DNA, 364 bp, Oryza sativa
attgatcacttttctcagttttatgaagaagggggaaggcacacatatggaaaggtggcgggtttgagggctctcccaagtgtgatcaaccgcatagtaagggccaccatcctcccaagatgcggcaacaatgatgacatacgcggagttgcttggcatgtcattgatgcaattttggatggtcgtcggtttgatgttatcaaccttatgatgaaggagattgccatctcaaaggcaactattagataaggaatctattatgctccctacataatgaggttgacaaagcaagttgggacaaattggtcacaatttaaaagaacataaggagtacaagcctcgtctccaactctccactcctaga

SEQ ID NO: 53540 - DNA, 652 bp, Oryza sativa
attgaaaatagtggattttcaagaattttctctctctccttgggtaactagtttgacctagctacaagagtgtcaaaaatatatgttctagtgcggagatagattgagttacctagtttccatttttcaaagtttcacttaaaaattcgaaatattttaattctggcaaaaaggtgaaaaggggtatgctgagaactacaatgaattttaataaggtcagaactgactgtaaaaattctagaaaaaatttgttaactcatgataaacaatctagtatttgaataaattatgaaagttattccctaatgttcaacttaatgcacacatagatgatgctttgttttgccaattaggggtataatttgctccaaaatttaattgaatgtagaagctaatgcaaaaataataattatgcaacatattaacagaaataagtaatcctaaatacctcgtcctaaaagatagggctatgacactccgtttctcttttttgttggctgttcgctgccagcgaacgttcgtgcattagaccgatccatcaaagcccatctactactgcgcacgtatatcaataaaaatttcttaccaatgctgtttgtctagcttgcatcggctaattaatttttgagaaatattttgcttactgcacagg

SEQ ID NO: 53541 - DNA, 1501 bp, Oryza sativa
cagcatggtatcagagcaagtaccgactatatggagccccttaagttggtcgcttagaattgcttcttaaaaaaaaattattttgagggctttgctctcaaatacaaattatttgcgaaaatcatattcaatcttatatctcatccctctatagagattgttttactttatgtctcatgttttgattttaaaactcgtatcttgctctataggaccgaaaccttttgaaaatgttacttctgtaaaaatgtaaataaaactacttataggtcatcataaagcagtaacaaagtgttttgaaaagtttcgaaatccatttgcaaactactcctatgtactagcacggatttgtaaaatatcgggttaaacatagcccctagtgaatgggttttgaaaatgagtctataaaatttaaaacttgctagataatatagagattctatctccttatgttatctctgaacaaaaaaaaatgaatttggtgggatttttcactttcctctcccgatatttcaaaattttaccggtatggcctaaaacatgtagttggtatagaatagaatttgctgtgcttaaccctctagattgtttgcttagatggaccacccaaaattcatctatcctctggaccaccctaacataatgtgactaaaagatgataacatttatacaacctaaaacttgattaaagtttcattttgtgccgattgttcttttctggaatcttgagtcagtctgcttgttaattttgtctagactaaaccgtaggtgataaacctgagaatttttacatgcatcatgtagactaacccagtaagcttcatgaattttggcataatttttagacccctgcatcatagtgaaacaatctagatacttagcataatcatattctggaaatttgtagtagctgcattcatcttttcatgtagcccaaaacataattgataaaatatgcatctttttacagtagttttcatacataacctgtaggctccacgaattttggttgaatttttgagtcattgcgtcatggcataaaagttcatataatactgtatagttctgtcctgaaatctgtagattgtcagtttcacaaatttgtgtagcctaaactataaatgataaaatcatgattcctttagggtagctcctaatctaacccatctatctctctgatttttgtcaaaatttttgtatctttagagctagacctaaaaatttgattaagacagtaaagtgatgaatcccagcacctagcactcatgtcggattaacccctatcctttgaagattattagaaaaccctagtgcaaaaatttattttattttaagggggatagtaagccatatttgtatcaaaaccaaagataaaatttttaaccttgcataattcttcttagacctaaaatagaaatcccattctaagtaagccctgtaccgttaatatgaccaaaattaatgattagaggtctatataaccataggttgttaaaaaaaa

SEQ ID NO: 53542 - DNA, 180 bp, Oryza sativa
gtatcagagccaccttgtatagtttatgatctagatcattgcatataattgatatgcgggtgtagtagatgagatctattatgttgtatatgagttcttaggtgatcggaacatgagatgaaccgatagccgcatgggttgatgagatcaatcggtatgtgtgttggtgacttcactaga

SEQ ID NO: 53543 - DNA, 173 bp, Oryza sativa
tgtagccttcctcatgatgtggcttgaaaagttcttgttttgtggtccgagctgtggtcctactgcgaattggcaacatatagctgagaacttggtagaaaagaaacaattcccccatggaaaatacttgctgggctacctgtaccaaaccctgaacagtgcaataaccaaga

SEQ ID NO: 53544 - DNA, 717 bp, Oryza sativa
cattacccctcttaatagtacggcgaaactaaaaataactagcaaatttgatcgccctacaccccgatcaattctaaattaaagcgctagttttaccgtcttctttccctttacttttgcgccgtcaattttaatccatcgataatcatccatgtgcacatatgaagtggacctaacttaaaatgtatagctcaaagacaacggttagtccacaattagcgcttgttattaattaccaaaattaacaccgggggcctagatgcttcagctagcagtagaaaatgaatttgataaatatgatttttctaatgcgcaaatgattaaggctgctagtaataagtttacctcttctacattattttggtggatttatgttagtaacaaacctgaaacttgggatgaattcaaaaccatgatgagaaaacttgtgagttcttatttcaaatgtactattcgtgagaaattagaacatctgaaataaggagatagaactgttagggagtacatccatgaatttaaagtttgtatcatctatagtgatctaaaagagtgcgatgaaaacaaaatgcacagatttttcaaggggcttaattttcatattcaggttgtgcttgctaatgtgatatataatcatattggacatctattcatgtttgctcatagcattgagagtgaaatcaaatgcaagaaagcatgaacaatgtgatttatctcatg

SEQ ID NO: 53545 - DNA, 155 bp, Oryza sativa
catgcatacacacgtatgacatggttcaacttgagtcttctttgtgcatttggatttttggttggcattgcatattaggacccatgagcataaataaaagataaagattcactaagcaaacctataaccacacttgagcaataattataaagagt

SEQ ID NO: 53546 - DNA, 186 bp, Oryza sativa
cattatgcaccatggtacctccaccactagataaaccggcttgcatagattttgtcgaggagtaatcctctctagcgggtggtcgtgagggccccctttgtaagttcggccgggggaaatggcgcaatgatcaagggcctacttccgcttgcagtctaattgccagatcactctcgtggctgagtg

SEQ ID NO: 53547 - DNA, 290 bp, Oryza sativa
agctgggacccagggttgggttgccagttcggtctgaatcatcgtaggccttgggttaaggcaggttcgtgagggttcacggccttgattgataatattgtatagctctaggatcgtctttacaaaatagctttgggcaactaagtgacttttaaatgctgtttactgcaaaacttaacccctatattattaaccccttgtacccccttgcattaatcatgcatctgccggtgtgacttgctgagtattgtggttgtactcattcttgctcaatctttcccctcttcagt

SEQ ID NO: 53548 - DNA, 343 bp, Oryza sativa
ataaacaagcataaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagagaattattgcgtcagcggctagggtttgcggtggaccgggtgcacggcagcggttcacgggaatgaacggccgagatcgatccatccaaaacggacggccgagatcaatcgggtctacggcggctcacggcaaacggccccga

SEQ ID NO: 53549 - DNA, 1501 bp, Oryza sativa
aatcgactaagtgccgcaattcgcccctcgagcttttgtacttgccgaacgctcgatggtggcttcatttgctgaatggcatcgattttttcgaggtttgctttgatcccccgttcggacacaaggaatcccaactacttaccagcacgaacgccaaacacacatttctctggatttagcttcatgctggttgcgcggaggttgtcaaaagtctcttgcaagtctgatgcgtggtcgaaggccttgcgactttttatgacaatgtcatcaacataggcttcgacgtttggccccaattgtgatcccaagaccctgtacactagcctggcaaatgtagcccctgcattaaatcattcgaatgttgccgcgcttccggttaagaagctatgtgattgagtgattcctatttatcatggtatgagtagattttaaattaaaatatgtaatatgttgaagatgaggatgaatggtgattaatattgataccattttaaaatgatgatttacaattgtttgcgaatgaaatgtttgatgaagtagggaaaaactatttataatcgacttgttatgaaacctccttgatgaactatattccttgtacgccttgcatacattctatttgtattattatggatgtgtcttgctgggtacctcggtactcacctcttgcataaaatgtggttcagacgatcagtccttccctgagaaggcgcatgaaggggaagaattctacggtgctgacgagttcatgttctaggtcgatctgctctcaggcattgcctgtggtgttttttatcctattttgtgtatgggtcttttgtttgtaaggagtgtttagctagtcggcccctaaaacctgtcttagttaacttttatgtaataatttatgtaaaaacttggggtatatatgtcaaaaactgttctgtttatcaatctgtgcgcgattgaaatcctggacggtcgcgggtggtttcgagataccgtactcaaactgggtatccccacagacttggtatcagagcctagcttgacagtaggttgacctagatggtttagagtcgatttttgataaaaagctatttttaaatataaaaatatattgaaaaaccttaagtttaattacttttcgtccttccataccttctttagtgctttcttaccccctctgtcttagcaatactagctaaaatatattttattttctaaatattttttgtcttatcatcgtttctaaattcaaaatttcttgtctcttgccttgttctcacgtaagaattagactttgaaccttagtagacgtgttgattggcatgttttatgcaagctgtatgccaaatccactaggatttgtagctacatcttgttaatttggtttcgcttttaaaaagtattttgttgtggtaggtagatttatgcatcatggttacgaaaattgcatttctatccattcttttctcttttgtctttattctattctgtcttaacttactctattcttgct

SEQ ID NO: 53550 - DNA, 1247 bp, Oryza sativa
atccgattcgaactcggatccataattttccaaagcgatttagccgatgattcctaaatagaaaaggtagagaagatctcaaagattgtttcccctcaattcatttctccgcagaaggaaagacgcggccgaatttgaaagaatacgacggcggcccggcgctagggtttcggccggcggtggccggaggtaaacgatgagtccgacaagtgggacccacctgtcagcgacagcgcgctcgcgcggctgcgggctggactgggccgacttgggccggggaaagagagagagacagagggttttgggcccactttcggcccaaagcccaaagagacttttaaaaacctttttcaatttaaattattcatgaaatgcaattccatttattaaaaatacttccttagctcaaataaatcccagaaaaatctaggaattatataattaagcaaagtatttaatgaaattttatctggccccattttatattggaatttattaattaaaattagatcttctcttctagacttttaaaataaattctaataattccaattaaacaacaatttatatatttaggatttttagggtgtgacactcatctttttgtctcttcaatccatcatgctcccttgctgacatcctataaggtgctttagcaactggcttggttcctggtttcaactcaatactaaactctacttctctatccggtggcatacctagcaagtcatcagggaacacttctagatactcattgactattgggacaactccttttgcaattgccacattcacaaccctctttttaaactcattcatcttagaattacttttgtactcaacgttttgtccatctgcaccaactatctccacaaccttcttagcacaatctagtttgcctctatatttagacaatcaatccattccaaggattatgtctaacccgctcatatttaatagaagcaagtccactaagaatgacattcctatttacaaccttactcccaaacaaatagaggaaactaatgacttagttcccggtgcataaatcacccgtggcacttctaaagtggataaaggtaaatgacttttcaaaataaaactttcggaaacaaatgaatgggtggctcttggatcaaacaacaagaaggcaagctctaaattaacctggaacttaccaattatgacatcagttgcttcttcggcctcctatatgttgacgtggttaacacgatcacgtggggcac

SEQ ID NO: 53551 - DNA, 1075 bp, Oryza sativa
ataataatttgattagctcctggtttggaatggtatattcctggtttggggatagaactgtgcagccgggatggttgttcagaatggttgggcctatgcaacagggtatgttgtatagcgttggattaatattgtttaattatcacttaactgttttattaaattctgaaatgtttattaaatgctgtttatgcaaatgaaaccctactatgccatcctttgttatcctgagcacttgcatatttgctgcgtggcttgctgagtatgtcatatactcaccttgcaatcattcatcagaggaagagttctacaatgatgctgatggtgtggaggattaggtgtagccctggtcaagctacctgtggaatggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagaacctccttgaccctaggttatgccaaatggttacccatagaagccctctaaaaatattggaaaagtagaactgttctcctccccttctcttttaattaaaccaaaataatggcacatgcacttcgtaatctcttttagttgttctcattcaaaatttattccagtgttattagtactgtacatctattactgtactaatggctcatttaccagcaaaagttctacaacattgttttatttaatcttgctgcaaggaaataaatttagcatgttgattttatgactttcttttatttcttttgaaacctgttattcaaaagcacaaaatttgtggccttgtttccaactgtttcaaattatcctgcaagtttggtttactttttactttgattttctaactttattcaaattaatccaaaaacttgtgctattgattggataaatgtcttaactccctcctttcacttgtctttaga

SEQ ID NO: 53552 - DNA, 724 bp, Oryza sativa
cctcatggggattaaccgaacaaggcctaagtgggatggttttcaagcacgatatcatttctggtgactttgcggatttctttggcacaaaaattaactgaacaaagcctaagtgggatggtttttagcacgttaagttggaaaaataagaaatatttgccaagtatgattgtagtcatagttagggtagcaaatgaatgcaagctgaagccatgtagaggacgtgatgagtgcatttttattgatctttctgcttgaagctcaagcgtcaccaatgagatcttgagaagttcctatataatttgcctcacttccaatgtggccacaaatagtatgtcaagacatacttggctgaacttagttattgcaaaagttaggcgcaagccaatgttgaacaataccaaaaatatgtaactggcaaagtttgctttccaaccaacaagttatttcaatatgggtatttcatgaatcagttaagtggcaatctagtttgtaaatatgtgttgctttctgttgtcagttctatcgttactaataaacagctacatgctttgcgaattctcatgaaaattgtaatatgtagtaaattctgtgatttgttggcatattgttaacgcatgatgcttcaaatgaaacatgattttgagatattagtgtgcatgtgttgccatattttgatataatcaattccacctataatatgcagggataccggtatgagttg

SEQ ID NO: 53553 - DNA, 1393 bp, Oryza sativa
aataaaaacaattctaaattaagtaaagaaaacttctctaaatcatcatcaaattcaacgtacagctaaaaacggagttttaaggttcgtgaacgataaatgtacaccgtatcacgttaacggaatggttttactaccgttaacgtatatacggccgattaatcggttggtacggccgtttttccataacactggtatttctttaaaaaaacatgaaatgcgtagctctttgcttaatgtatttgtgattcatgacatgaggtgaagagaactctcctggacctaactatggttttatgtatccatactacaatttatgcttactaatgaaattcaaatattgtatattgtttgtcgcttagtgagtagtgagttagtgacttcagtgtagatgtaaatgacaacgaaaatcttatcttatagcttttttgacttgtattcctttaatttatagactttcttttctcttgttttggcatgactggggttgagaagagtgttcactacaattactttcaacaagaaagcatgcttagactttcttctagatacagtggtaaaaatgatacattttgattgtatgttgaatccttcacaaaagaatgaaagagagcattttatggtgaagatattaggtccttatgattatcttaattggagcttgcaaaggccttttgactgtgatgcaagtatatgaaagatgtaagaatatgcaagctagctcatatatcttgataaaagagatactcttttaagaatcaatgtagcacaaatcataccaaagtcaatcatttttcagttaatgttaataataatctcatgagaagaatgtttttattgcctttctaaggggagttattcttagtataagaattgagcaagaagtggatgatcgcccctctcattttcattgttaatctgtgtactatgtgaagaatttgttttttcctaacaaacatttaatttcatttagtaaagcattatagcaaattagcaattgattgcttgtggtagcaacaactgactttccttgttgcacttgagtgttgaatttaaaactttaacaatcaatttttagttcttcatttgatcaattttgttaataaccaaacccaaatattaggctttaaattatttgcacgagggggtccatttgtttacatctgactagaaaaaatacccgtgcgttgcaacgggtgaagtctattttaatcttattattgttatatggtttacttaagatgaaattcactgtgagagttcgcttggatatatatatttttagaaaatcataagctgcagttaggagtctgattgtctcaagttagcatgcgagtttttttaaacagatttcttatatgattccttttgtattaccaagagtgaacgatct

SEQ ID NO: 53554 - DNA, 258 bp, Oryza sativa
acctttgttgtttctgtcctcgaacaacggtcgatcgaactcctgatcctttgcatcaccctcgctgacaacttctcctaccacatttttccctcttccttcctttcgagtcaccgatgctcctaaatccccagccttgttttgccatgcttccttctttcctcccaaaaccttccttgaaccttcagctgatttatcccatcggctcacaagtgtgcctcccttgttgctccctgatcccgttgttgttttctcagc

SEQ ID NO: 53555 - DNA, 210 bp, Oryza sativa
ctctagaacctcgcaatcccagcccaactttcgaaggaaggccgggccccatcaggccgatagcctgctcgaaatggtgaagctccggataataaaagggataagccggcaaacatcgactgaccgccgcacttaatcccccccttccctacctccctccgacggagcgccgtctcaaaatgggcggcaccttctccaccgccttcgcca

SEQ ID NO: 53556 - DNA, 618 bp, Oryza sativa
cttctgaagcagctgtcacagcctgattttctgtttcaggatttataaattatttaataaattattaatagaatttatattaaatgttcattaatttacaagtgaagttaaatgtgggaaataaaatttcctaaatataaagcatggctggatttaattcttattaaattctccatgattaattatactctctgaaattttctcggatttttcggagctcaattcttaattttaataatacaaagaacatttcagtaattatccacatattaaattaatcattaaatggtcttattacaatcttgttaagtactttgggtgtccaagtattttcaggatttttcttgaaattatttgagcattggaagtatttttaacaattcaaagatcatttcagtgattaatttaattgggaaaagtaattaaaatccccttttcattttcgggccgaaacaggaaaagttcacctttaattcttggcccattcttccttcttttcggcctgcagccctctccctctctttcccgaagtccaatttgcattcctccttaggctgtgtatttgaggcccagccaaaagtctaaattccctccctgcgctactgttcatcttccagc

SEQ ID NO: 53557 - DNA, 194 bp, Oryza sativa
  unsure (1)..(194): unsure at all n locations
aggtctccgggtcactctggtaatgactgcccgtaaacccgtgaggagccnatgtacatggccaacaacatcatcgggtatcgtccacaagaaggtcaggggtggaaccactcacgcctatatcatcaaggaggtaacatcatcgatccagagaagaccatgccgcaggagtactgacacacgattgctgtcgt

SEQ ID NO: 53558 - DNA, 516 bp, Oryza sativa
cctggtttggagatagatctgtacagccgggtatggttgttcagaatggttgggcctatacaacagggtatgttgtatagcgttggattaatattgtttaaatattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcaccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtt

SEQ ID NO: 53559 - DNA, 426 bp, Oryza sativa
aatatattttattttctaaatattttttgtctaatcatttctaaattcaaaatttcttgtctcttgccttgttctcacgtaagaattagactttgaaccttagtagacgtgttgattggcatgttttatgcaagctgtatgccaaatccactaggggggaaaataaatttttttttctgggggttaaaaaaggggcccttaaaaaccaaaatttccccttgtgggtttaatttgggtttcgcttttaaaaagtattttgttgtggtaggtagatttatgcatcatggttacgaaaactgcatttctacccattcttttctcttttgtctttattatattctgtcttaacttactctattctagcttattcttatctatctctatttaaatcgctgcagatttgactaattaggacagtggtcagca

SEQ ID NO: 53560 - DNA, 1243 bp, Oryza sativa
ttttatccctctccttaatacctgtgcccaactctgaaagtcattatatttggatggagggaatatttcttttgctgaagaagacaggaacatctctgagagagtgtttaagtctagggacatactagagctggataactgagtatatggaaccagtaaacccacgagtggtgttttgcatcaggaaggcatggaccttgggaacaaggatcagtggcaaatccagggggcaaaaggaggtctggcctctcccagcatgttgcttccccagcctggcctggcgaaaccattagatctctaaagctctaatgcaacccgcgggatatttaccaattattttcgtaatcattgtcactcggcaagtcgacccccctcatatctaaatcctggcttctccactgacagggatgccaagctccttgtcagtggcagtgcagagtggattggatttgaggagagcatgcagaggggattagattgtgcatggaggtgaatatggaaatgaaaattcgaagtttgacacagccttgaggtctcttcttcctctctcctaccatttgtatttggtatgactgttttgcagaaggaagaatagaaaaataggaaatgcaagtgatattcaggttaagaagttgaaagaatggaaagggaaattcaatttagtccaatgtggcacttcttagaccaaaccaatcaaggagttgcattttttcaattagcttttgggattggcaaatcctagagtccccatctaaagcatatgatcagttatcccagttctattatggtgttttgttttgtgctatgagatgtctaattttgttactgacattaggcagatgacaaaccgctgatgtggcctgtactttttggatatggcaagacctttttaaaaatatcagaactttagttttgtatgttgtatccttttgtttggaaaataactcttcccaatctatttcttcctgcatttggctaataaacatgtgatgcttaaaagcttggccgtacatttaattgttctgatctttgaagattaataaaaaaaattctttggcggagcaattttataggtgttcttcctgtgatggtatcaataattggaatttctaacactcaaatcttgtgcatatgagcatatcgacaataattgtgcatctcctatctttctggcagttatgtctatctacaataattgcaattctgagtattatttcatcttggtttgtcctgcacaacaagc

SEQ ID NO: 53561 - DNA, 1501 bp, Oryza sativa
caaatccagggggcaaaaggaggtctggcctctcccagcatgttgcttccccagcctggcctggcgaaaccattagatctctaaagctctaatgcaacccgcgggatatttaccaattattttcgtaatcattgtcactcggcaagtcgacccccctcatatctaaatcctggcttctccactgacagggatgccaagctccttgtcagtggcagtgcagagtggattggatttgaggagagcatgcagaggggattagattgtgcatggaggtgaatatggaaatgaaaattcgaagtttgacacagccttgaggtctcttcttcctctctcctaccatttgtatttggtatgactgttttgcagaaggaagaatagaaaaataggaaatgcaagtgatattcaggttaagaagttgaaagaatggaaagggaaattcaatttagtccaatgtggcacttcttagaccaaaccaatcaaggagttgcattttttcaattagcttttgggattggcaaatcctagagtccccatctaaagcatatgatcagttatcccagttctattatggtgttttgttttgtgctatgagatgtctaattttgttactgacattaggcagatgacaaaccgctgatgtggcctgtactttttggatatggcaagacctttttaaaaatatcagaactttagttttgtatgttgtatccttttgtttggaaaataactcttcccaatctatttcttcctgcatttggctaataaacatgtgatgcttaaaagcttggccgtacatttaattgttctgatctttgaagattaataaaaaaaattctttggcggagcaattttataggtgttcttcctgtgatggtatcaataattggaatttctaacactcaaatcttgtgcatatgagcatatcgacaataattgtgcatctcctatctttctggcagttatgtctatctacaataattgcaattctgagtattatttcatcttggtttgtcctgcacaacaagcagagcagatgcagactatggagcagccagggtcatgttgaggcctgcttgccctggatctggtgtaattgcaggtggagctgtgagggtcgtgctggagatggctggggttgaaaatgctctggggaaacagctgaggagcaagaaccccctcaacaatgcaagagctaccatctaggcgacccaaattatgaggcagttcaaagatgttgctgcagagcgcgggcttccaatggagcagctatggaaataatcaaataaataaaccttaaattgcctccaatattgttctgttctccatttcttgagatcattttcagttgtatctgtcagtggggataatcctacatttaagtcctctccccaccctaaatgcattatgtgtctccacatatacatggcaaagctttagatgaattgatctgcgaatacctttagcttcactagtaatagtgcatgtgcaagacacgttccgc

SEQ ID NO: 53562 - DNA, 359 bp, Oryza sativa
cgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaata

SEQ ID NO: 53563 - DNA, 269 bp, Oryza sativa
agtatgctttggtcaataccttattacttgctctattctcttgttcttttgacatggtatgaatgcactttgattaattacttcttcatatttaaatgcatgctagcaaaatatattacacgcataatgacactgttggtacttaaaggcttaaaagctagcagctgttgagctagctgtctcatgaagctagcttaattaagtctgatttatatatatatatatgtagacatccagagagagagagagagagagagagagagagccag

SEQ ID NO: 53564 - DNA, 848 bp, Oryza sativa
actccgagattataacattgaattatatccaaacagctaaaaccctggcagattccttcacgaatggactatcatgaaatgtgatagatagtgtatcaaaggagatgggcttgagacccaagtgagttatgctatggcggtaacccaatctatgtcatcggagatcccgtgaattagaacctaggaagaataagccattagttaagtagaggagactatcaatctaaaccttctctaagtgaagatgcatgtactctcatgagttacaaggcaggttggctatgccttaatgagttctattgcctttaattagcgaagatactatcctacaaaccattcttgaaagaacgcacctttttgaccttgactgttggtcgcagtctacggatattttgggtgaatcttctaggaagcttactatgagacaaaggagtatgacctatacgctacacccgagggtagtctactcacgttgtagtaccagataagactctgagtgaaacttacttgcacaagacttgcaattcaaggtgtagtccattgttcaagttgtgagtaagtgtagcttggagttgtaggtagatgttcaaccttaatccatctccattgaactgctggtatataagcggtacattggaataaggcaaatcccagtgggattttgatatttagtgggggattgttggaattagtggatgggccttagcccattcgaagattaattctttgaaaatcacaaaagcccacctcatgggatggcatgcatggggagtttagtacaaccttgcctattctaggagagggagaccttcttataagggaggatgctctcctagctacttgaggca

SEQ ID NO: 53565 - DNA, 264 bp, Oryza sativa
actaaagatgaactttagtcccggttggagttaccaaccgggaataaagatgatttttagtcccggttggtaacaacaaccggtactaaagatctttctcttataaaccgggactaaaaatgatttttagtcccggtttttaatggaaccgggactattgtggatttgggtcgaccgaccaaagatggtttctctactagtggtagaggagttgataaggaagaagacatgggcattctcttacagaaattttagaaaatgcaa

SEQ ID NO: 53566 - DNA, 575 bp, Oryza sativa
cccatagggtgttcaaccaggattccttttggtggagggatatcattaatctctctgtttttttagggtgattgcaaggtgtgatttactctatgggacgaccactctcttttgggatgatacgtggaatggtcatataaggagtaattcatatccaagtctatgtactcatgctattaacaaagtttagtcagtggttgtcacttgttcgaaactcatgaggcttatatggaattcctacagctcagagcggaacttgatagtttaactttgtcccatcagcaaggggataattggagcttcattcggaagcgcaacctacacctcaaaatgcttttacatgctgaactttgctttcatgcaaccttcaagaccttttcactggagatggaaaacaagatgtgtgatgaagaacaaagtctttatttggttgcttttcagtgataggctgaatacaagggacatgctggatagaaaaaaatgtgctcctctgaatgctgatcttatatgttttctctcttctttgcagcatagggaaacctttatttatctctttttttcaatgccctttcagt

SEQ ID NO: 53567 - DNA, 1501 bp, Oryza sativa
tatacggaatcatacctcgtatatagaaggagttccggataaggaaggacaagcagagttctacatggaaactatatggactactcggattatatccatacttgtctctctacttctacttggacaaggggacatctatgggtataaatagaagacctcctagggaggggaggtgttgatgcgaaaaacacacactggcctgggagatgtgcttagctccagtgcaggtccaaaggttgatgagatgcgggcgtgccagtcagtttgttgctgcaactgacaagatatacaaatagtagaccaatgagccgatcggttgtcaaaccaaaggaataattccagccgatgccgataccagccgctagcgatatggttttgagcaatctgctatatacccaatgtggataatgatataaagacaatcgactgatgataatataatatatcaataatataatctagtagaaaccaatcggctaacaatgacatgatagaataagcactgatccgaaggttaaagcatacatcggctggaggtccaatgtcataaatccacaatattagattaaacagtgaaatttttgttgccatcagctaaatccaacttgtatgtaatccttgtaagccgatgcaacatccagataactcatcggctgaaatcccgatgaaacccttattggcagtcaaaaagcaggctagggattatggttctaaacacgacttagtagatcaaacttaactgatgcaacactaagtatgaaaagaaacatcatatctagaaaattaagcccttgactgatttttagggtggtagatgccttagctaatctaatcttgtaaaacaatttagccgataccgacagaaaccctaaagcgagagacaatcgatagagctaaattgagatactaagcctagactaactaagacatatgataaataggcagacaaatatatcatccaaaccggagcaatccaagaggtcgaatgtactgatgcagccttaaacgacaccaacgtaaacaagacaattgcctgcaccggcggaacgtaggagttacccattcgccggagatcgaactgaacagatgcagccccgcgtcaggtgccaaatttcgtcggttgataagtaaaaacctcagaaaagagggtggcgatgcgccgagagtattattgatcgagagctaaattataatgaccccgggtgtacatatttatacccatggggagatactagttcttttaggacaaaaaagaaactttcctaaagataaaaggaaaacataaagttcttatagggataatttgccatgataatttgccatgccgcatcctcattgaactcggtcacttctggataagcttcctttaatagattaatttcattcaccgaatatagcaagaatccgactattggcggtgtgataattctcttagggacttaccaaatttcaatgttaataggaggacaagcctaatcaacaggctcagtcaaaatataca

SEQ ID NO: 53568 - DNA, 1204 bp, Oryza sativa
catcctatgctatgatttgggccaattctaagtggttttgattggcatatgggccctccaatgggggcgcttgatgggcgatcgctcgctaagcgagcgatccagcgatcggccccccctcctttctccccttcctcctccccttcttttcctattacagtacaccacaaaaaaatttaaaaaaaacaaaaagttagaaaaatttatgtataaaaaatttgaattcaaattcaaatttgaatcgggtacgtaaacttttgatttataaactttggatctataaactttaggtgtataaactttagatgtatagaaatactatatatagaaaatatttgaattatttgaattcaaattcaaatttgaatcgggtatataaactttaggtctataaactttaggtgtataaactttaggtgtataaactttagatgtatagaaatactatatatgaaaaatatttgaattcaaattcaaatttgaatcggacataattcaaattcaaatttgaatcggatatataaactttaggtgtataaactttagatgtatagaaatactatatatataaaaattatttgaattcaaattcaaatttgaatcggatatataaactttttgatttataaacttttggtctctaaactttaaatgtgtaaacttgaggtgtataaactttaggtgcataaatttactaaaataggaaagtaatgcggtgccaaaaaaggaaaccaggtggagagagggagggggaggggggagggggaaccgatcgctctgggcgagcgagggcgctcgcccgcccagtagcatttccgccgtccaatccatgtaaacgtgtcctgattatccggaggtgtattttgtcacaggacagatgtgttttctccttaaaatacatgcatacatatatttcaccaacactagcggaaatgattagtaataatccctaacactagtttggataccatattttatttcattatatgtaggcattgacggttagatattatgatttaaggactgtcaacacttgccttcaatccactcgaccaatctggacaagaaagaccaatctggtagccactgcccctagggccatctttgccatccacaccaaaagcacaaccaccatgaccgctgcccttggcaccacgcgaccggatctaggcgctcacccggctcgctcacccggccgctcgct

SEQ ID NO: 53569 - DNA, 1501 bp, Oryza sativa
gaacatcggtctgaccgatataaatcgatcggtcaacccgccgagattgcctgctgccgtctgaaaccgccgccggtttgaccgctcttatgccgccggtctgacctccgccttgccgtcgatctgaccgccggtatatcgctggttagaccgccgaacccgaagaaacacaaatcgaagaactctcaaagtagatgacaactttattgcttctctttgtgtttacaaagtgcaccaacagcactcgttacaaaaatctcaagtaaactcgaaaccctagctaaactagcaactcaattgctctcaaaagcgataccgggaagcctcacgctccccctctatttatacatgaggtaggcagcctaaagccacgaaccaaactcatactaagagtcctaaacaccttaggaaaccctctagtacaaggaagaaactttacataatcaatcgtaccaaatttggactccttccaaattcgactccgcatcccatactcacacaatacctccatcgtatgccatatggaatcttcaccaaccacgtgcatcaactctagccttagtatcccgcatgatatctgaccaccacggacatcgtcttaccaccaagccgactcccgatccatcaccgcaaatactctcccgaggcattgagtcacctacacatgaaacaaacaaagaaaccatattccgagaccaagctatccccaacttgagtcattagtagcaaataacagtattacatacgtatagtatccatctcgaagccataaccatgaaacaatcacggatatccaaagaaacaacccgaaaccgataccaacacagcgtcggccggtcagaccgcgggcctggccggtctgaccgctcaacacaagccggtctgaccggcaacctccgcccggtctgaccggtcccaacaaaaccgagaaaacagttatatccagaaccacttcgacagtaatctccaaatatcaaaaccaataatcatagatgccgattgttcatcacagaataagaatcaaaacacactttgatcttacaactagcactttggataaagaaggaagttcctgtacaagtattagagtagtaattaataacttagacgtgatgtctaggttagagattacctctgtttgttgtgtatcccacagatttgtcagaggtagacggtaggtggtgacagccctgaatcccgtcctagtaatcctccgcgttcagatacatcatagagatatagccggaaccatgctagcagactagcaggggtcggtacccgaagcaatagataggaaattacctttaacttatcttggataattaaaacaaatagaaagtcctctctagcctaaccagcctacctatagttgttgaccttggatagtcttagccttaggtagattacacgcgttccctgagttcgatatacttttggggtcacccgaagatgatgtgctacatcagtattccatcgcttgcagatttatctgtggtcgtaa

SEQ ID NO: 53570 - DNA, 1501 bp, Oryza sativa
cacaggaggcgctgatgagggcgtgcaccaggactcgtcaaggcgtgatcatcaagcctaagccacgtcctaagcctacttacgatgtggtaagtaatgaggaggtaacacaatttatccaacaacacattgcatctacaatagattcatctatgattactttgaataataagttaaatgcatctattcagaatcatgttgaaggatttttgaggactagattcggccctctcgtggccgattttatgttcaaagacaaagcctctaccagtgctagccaagccactatagatcagataagtagtataaccaacggggcgaaaacacaacagcacggcgaggggtgggcggcgcacacagccagtctaaccgggcctggtggccggttagatcgcgatgtcgctgtcggtcagaccggccagacggccggtcagaccgggtattaccccggcggtcagaccggaactcaggccggtctgaccgcgccactggacgtcggtcaaaccgggtcttgggccggtcagaccggcacaatcatcccaattcagggggtagatccaatgacaaataatgcttatttgtatcatcttagaacatttgattcccctgtatctactgccactacttgtccccaaattctcctacatgttcctaatgcttataatgatgtttctagggggtatcctcccgatactaggcaaggccaatataattatattgcgccgcaaccacaacctattaggccaccaaacccaccaccaaaccaacataggcctgataatatggaggaattgattagtggaatcattagggataaattcaggattgaagctaggaatcgtgctaaggtttaccaaaagccgtatcctgactattatgacaacataccatatcctcgtggttatagggttcccgaatttaccaagtttaatggtgaggatagtaggaccacatgggagcatgtaggtcaattcttagcacaatgtggagaggctagtagttccgatacttttaaattgcgcttgttttctttatctttgtatggtactgcttttacatggtttacttctttaccggcaaattctatacatacttgggctcaattagaacaaaggtttcaagattatttccatactggtgaaactgagtttaggttatctgatttaacatcagttaagcaaaagtataatgaatctgtcataggtttagggatgttaaaagctgatattatagtttaaacataactgatagagatttgtctgatcttgcttttaatggtttaattgctcctattaaagaaagattagatgttggccaacaatttcttgatgttagtcaactcgtgcaaaaggcactagctcaggaaagccgggttaaggatagcaaaaaatttgttagaccatatgagaagaagcctaatgttaattcaattgattaccatgaggctagtgatagtgaaggtgagggtgatcatgatatgtatgttgcctgccgccgagcc

SEQ ID NO: 53571 - DNA, 1501 bp, Oryza sativa
tcctcgtaaagatcggcaaagtaggattaagtatagttttgatgtggccaaatatgataagatctttgattatcttttgcaagaaaaacaaattagattacctaaaggtcatattatatcatcttaagaagaattgaaacgtcaagcttattgtaaatggcatgattctcactctcattctactattgattgcaatgtgtttcgacaacaggttcaatcggctataaatgaaggacgattgaagtttaccgatggttccaagatgaagcttgatcatgatccttttccggtgaacataattaattttgatgataagaaggtattgattcggccggagcaagccgaatctacaaaggggaaaggaatggtcattggagagcctaggccaaaaatgatggtgccaaagaatccggaggttggtgtttgcaaggaaaataggagtgaagcttcaacttctagagttcctaagaagactaaggtgaccttcaatatgcttttggagaagtatgagaagcaaggcggtgagagagatcgcaacaaaggaaaaagaccaagatcacctcctagggagcgatttggtcattgaccaagacggtcggaatcacctccatatcatcattctcaagacatgtcatgggggccttacccaatgccgccgccgggttatccttatccttactacatgccatggggggcaacaacgccaatgttcaatcatatgcctccaatgcaattcaaccaagggtagggaggaccaaggaggccaattcatgagcatttgtcttcatcaaacaatggttggttttatggtaagaaccgggccaatggagaaaagcgggaaggaaagcgcgtcaaggtgaagactaggacttcggaggtgattaccatcaaagtggggtctcatgatgtgccaataccttctggagatgaagttggggagtcctcaagcaacaaatctgaagccggtaccagctcatcgaagtcggccgatctgaccaggccctctggccggtctaaccgcagccatacggccggtctgatcgccaatccaacaacggtctgtccgacgcctcaggccggtctgaccgctgacctaatgtcggtctgaccggcacctccggccggtctcaccggtggtctaagtccggtctgaccgggctccagcgccagtttgacaggaggtttgcaggaagcaatgtaggggcttcctcgtcttcaaatagacttaacagggggcactatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagaca

SEQ ID NO: 53572 - DNA, 1501 bp, Oryza sativa
ttcgccaagcaaccccatgtccgcaagtaagaaagtgatggttttttcctaatccatatcccgcatggtgttttttccttatttctattaggaactctatttaacacatgattcgaggtcaacaatacctccccccaccatgccttaggtagtcccgcggtgtccaacttggcattcaccaagtcagttagtgtgtggttcttccttttggcagtcccattagactcggaagaatagtgatccgtcctctcatgtatgatgctatattcctcacagaataagtcaaactcgtttgagaaaaactatccaccatgatcagacctaagtctttttatctttctgtcaagttggttttcaacttctgccttataaatttaaatatagtctagagcccgtctttcattttcaacaaatacaaatagcaaaatctagtagcatcattaatcaacgtcatgaaatattgttttccaccctttgtcaagaccccattcgtttcaaaaatatctgaatataggagttctagagatgccaagtttctctcctcgatagctttgtgaggcttgcaaagttgctttgattgcacacaactatggcaattagaacctttgacaatagagaacttaggaattaaacgtatactggaaagctgagacatcaagtcaaaattaatatgacataaatgtgagtgccaaacgttagcctcatcatccacactgccacaaatatggttcacagatttattacagaaattagaaagggaaaagcgaaacaggcctcggcactcatagcctttaccaataaaatatccatttttagacacgactactttaatagactcaaacaccaacttaaatccatatctatatagacgggagccactaacgagattcctgttgatagtagggacatgctgcatgttcttcagctgcatgatctttcccaagtaaactttagatgtaccatgccaacaccatgaacagaagcatgtgacctattccccattaggacggtagaatcttgtgtgatctgataagaagaaaactgcgagatgtcagcacaaacatgtgcattagcccctgtatcaatccaccagttagtatacgatcaactaaaaaaactgtaggtaaattaccatacctgcttctatctccagtgttgtcaattgtcacattggcagatttagaagactgccctacaggtgccatcatcccttgcgttgtggacacttctagatgacaatgcaattcacacacaaagctagttctctcatcctggtttggactgctattcttcgttttcttttcttgaagttggtgctctgctgaggtttgtatttctctttgtacttgttttggacctttgtgcacaacattggcactagactgcccaccatcgcccttagacgcggcatctttttcccgaactttctcctcaacatcaagagatgcaatcaacccctcgacggagtattcctgtcttttgtgtttgagtgcagtactga

SEQ ID NO: 53573 - DNA, 1501 bp, Oryza sativa
gatggcatagtagggttcatttgcataaacagcatttagtaaatatttcagaatttaataaaatagttaataattaagcaatattaatccaacgctatacaacataccctgttgtataggcccaaccattctgaacaaccatcccggctgcacagttctatctccaaaccaggaatataccattccaaaccaagagctaatcaaattattaccagttatagcatcttttattatggtgagaagtgtgagactaatcacgaaaaacattgttagacccgcccatcaccgcgggcacggctattcgaatagttttactctggccagaggtgtaccactgtacccacaagacacagcctcaacatcatgtctaccatgcgccgcgatactggaaagtacccgaatagaggctgtgacaataccctctgcacaacacaactcaccacagtgcaccattcctggattataatcacccccttataaaacaaggcatggactccccagcgacctccgtgggcttatctccaccacttctcagtctggtgctccgcaatgaaccatgctatacaaaaggtaaagccgttgcccacgctggcttgtggttggcacggttaatgtttcacaaccgaaactcgtgaaccgatccttaattgtcatgagcacgactctcaaaaccatgtgctcataacccaccattatgaagttttagttggcaagtaattaattaaccaatcacgattgaccatcgtgaactaacaataagccatcattaaataatagtgaatcataagttatcccaatagtgtgctaatgtttctaagcatggctaagcaatcacatctaatatctagctgaaccaatatatatagcccaactagtcaagttaaaataacccaaggtatcaaggaataaaggaatcaagaacaaaaagggctataacaaacaataggttaattccacccaatgacattcgaaaataaatgcaatagttgaatagaaacaattgctttaaacgggatcaacatgctcaaagggttgtttgggatctgtgtgacttgcctttctggccttggaactcttcaaattcttctcctgcgaaaacggactctccggaaacgtcgaaatctaaacagaaaagagcaaaaacaccaaaacagcacataaacaagcatgaacagtacttgtggatatttttaacatgtagatctcaattttagaaaaatttagagacttgaaccaactaaatccgagctaagatgaattagttatgaatttttaaagattaaatcggattaaaacacctatatggattttaatggaattatgacgcaataatgaattatttttgaaaaggaaaagagatttattgcgtcagcggctagggtttgcggtggaccgggcgcacggcagcggttcacgggaacggacggccgagatcgatcttatccaaaacgaacggccgagatcaaccgatccacggccgggccacggcggacggtcccga

SEQ ID NO: 53574 - DNA, 1501 bp, Oryza sativa
tagaaaaatgcttataaaaaccacatgaacagaagcaataaagcacataaatgggttctatgcatttttaggagaaattagagatttgaacgggtcgattctgagttcaaacggtcaagatatggccatttgaagtttaggtgttgtttaaatggaaatttgcaattttgtgaattatttttctaaaggaaattagaattattgcatcagcgatgagagagggtgcgcgtgaatcgggtccacgggatgggtcccacctgctagatgcatggtccaccgtgagacgagaacaccgagacgactcacggtgtactggcgcacaggcacagccagccagagcggcacccggcgacgaccaacggcgcggcggcagtgcaacggagcacgggaagataaaaacggaaagtggaggaggtgacggttctcaccgagcagacgtgggggcgagaggtcgaccgagatgccgatggcgagggagaaacagcgagaagcttcggattacagtttaggtttgatgaaaataaatcttgatgaattttaattgttggaggctcttttaggcttttaaaatttctagaaatgcatttaagcacgatttaaatttagggcgattttcaaggcgttgcagctcagtaccaccttgtagagggagacctccttataagggagattgctctcctagccactttaaacatgtgaggtggagagaaaaggggaacacatgtgtgcgattgcggcgtgtacacgacatacacgtcgaatggtccaccaaaattggttcctcacccatgcgcacatgcgctctccttttgccgttttgttttgctgcaggaaattcggttttgtttctggaaacacaccaaataatccggtgtgtggagcggcatggactctggataagatacgcgcgacatatccgatttggttacgcggagtggagatcatgcaggcgccctaatcaagtgtcttgatatctctatataaatcgagctgccacctccatgcaacacatgagaaattaatctagggtttgcttcctcctctgtaatgcgtcatcgcttgtagtctaatccatcccacccgccggcgtgcactgatgatcgggagagtatgtctccgaaaccttcgcattcgacgtcttgaaccggtagaaggcggcaataagatttttgataagcgctttgcgtgactgcttgctatttgtccacgacagctcatcttcctcttccctagagtattgcgcgtcatcatcaacactcggtactgtgagttcttcttgctgtgcagccgctcatccaaaaccctcagtacacattcaatatttttcgcatattcgatctgtttatggcttattgtctagtttacaagtgtagattgtatgatgtgattatgctagtttacatctacaatggcatgatttatttctggaagaaattaaatcattatgtgcttatatattcaacaatccaaaaaccttactataggtattgtggttttacta

SEQ ID NO: 53575 - DNA, 1501 bp, Oryza sativa
gatggcatagtagggtttcttttgcaaaagcagcatttagcaaatatttcagaatttaataaaacagttaagtattaaacaatattaatccaacgctacacaacataccctgttgtataggcccaaccattctgaacaaccatcccggctgcacagttctatctccaaaccaggaatataccattccaaaccaggagctgatcaaattattaccagttatagcatcatttactatggtgagaagggtgagactaatcacgaaagacattgttagacccacccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttaaaaacaaggcatggactcccagcgacccccgtgggcttatctccgccaattctcagtctggtgccccgcaatgaaccatgctatacaaaagataaagccgttgcccacgctggcttgtggctggcacggttaatgtttcacaaccgaaactcgtgaaccggtccttaattgtcatgagcacgactctcaaaaccatatgctcaaaacccaccattaccaggttttagttggcacattaattaattaaccaatcacgattgtccatcgtgagctatcattaagccatcattaagtaatagtgagtcataagttatcccagaagtgagctaatgtttctaagcagggctaagcaattatatctaatatctagttgaaccaatataaataaagctcaactagtcaaattataataacccaaggtatcaaggaataaagtaatcaagaacaaaagggctataacaatgaataggttaattccacccaataacattcgaaaataaatgcaatagttgaaaagaaacaatagctttaaacgggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaattttgaagattaaatcggattaaaacacttaaattgattttaattgaattatgacgcaataatgaattatttttgaaaaggaaaagaggatttattgcgttagcgggctagggtttcggtggaccgggcgcacggcggcggttcacgcgaacggacggccgagatcgacttgatccaaaacggacggccgagatcgatcggtccacaaccggtgaacggcgaacggccccga

SEQ ID NO: 53576 - DNA, 401 bp, Oryza sativa
agctctacatatttggtagtactatagctgtaccgtaactactacatgttctatgttactacaatttcattaggacattactgtcaaaagtgcagtaacattctatatattttacagtaacgcggtgtgttactgcacttttacggtagtgttactactggaacatagtaacatgttatgaaatttttttataacatacctactttgttctatggtggtaatgaaagatataagaatcggttatcatatttctttatcgcaaagtaagatgcaaaagaaataagtaataatccttaaaactaaacgtgccatggggtgaattggttagaagaacatgttatgaattaagagatcatgggttaaagtattgaattcactaatttatttttttattttttagg

SEQ ID NO: 53577 - DNA, 1501 bp, Oryza sativa
tgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataacttgttgacttgaccaccctaaactctctctgcaaggaaactgcccaatgcttcaccgccttcttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttgttttttttggatttttagtgaatataatgaaatttcacagagaagggactgggctttatagggggagagg

SEQ ID NO: 53578 - DNA, 1009 bp, Oryza sativa
agaatggttgggcctatacaacagggtatgttgtgtagcgttggattaatattgtttaatacttaactgttttattaaattctaaaatatttgctaaatgctgcttttgcaaaagaaaccctactatgccatcctttggtatccttgtgcacttggatatatgctgcgtggcttgctgagtatgtcatatactcaccttacaatcattcatcagtggaagagttctacaatgatgctgatggtgtggaggattaggtgtagccttggtcaagctgcctgtggagtggagtcgtctgcaccgtttatcttatttttttccgctgcatagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttatcccagtgttattagtactgtacatctattactgtactaatggctcattttccagcaaaagttttacaatgttattttatttaatcttgctgcaataaaataaatttagcaagttgattttataactttcttttatttcttttgaaacctgttattcaaaagtacaaaatttgtaaccatgtttccaactgtttcaacttatcttgcaagcttggtttactttatttacttacctttttactttgattttctaactttattcaaattaattcaaaaacttgtgctattaattggataaatgtcttaactccctcctttcacttgtctttaga

SEQ ID NO: 53579 - DNA, 591 bp, Oryza sativa
ctaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtaga

SEQ ID NO: 53580 - DNA, 1501 bp, Oryza sativa
catcccgacagcccaccgccccttctcttcgtaaccacatcttaaacacctaccccaaccttaatcctgcaatctaaccactcgacaaacccgtagaagtcctagagattcgttggagatggagataaaacattaatcacaaaacaaataatgatattataaaaaaccccttgttttttttctcgaaatgtgatgtatagcattttctaactagccaaccctacaacctgctgatgtacttcctccatccaaaaaaagccaacccaaaaaaataagacattcgttgtactatgtaatgtctttatcggtgtctaggttggctttttttttggacggagggagcagattgttggcggcttggcgccgaacccaaaagactctagttagtttgctagggcgcatcaagacactaacacattaaattgcaagctataactatttctgacatgacagcgtcgcactacccataaggggtgagagcttcgagagaggcccataaccgcatacccctagggccacgctatgctcaacgtttgttgaagacattgcaatcttgagggcacaatttcgacactagtcaatgcaaaaccaagtcgagaatacgcgccacagatagaacataggttcccataaagtggagcatgtcaatggcaaagtcatacagacatatggtagacgatggccacaaaatctcttttcgaataagagatccaactcaagagggtgcgaaaaaaaaatcatgtcaaatagggtgtcatgtaaaaaacaatatcgaatgtttgcacttactcgatcttggctatggaaacttcattgaaaacgccccaaaccaggaatacttttctatccttacggctacgagcacctccaaaattgctccgacatatattgatcttggcaaagttactgtaacgccttactttcgaccactaaaaaattagccataaatacgaggatatgtgccaagtatataacttaacatgtttcatcactaactacctaagctatacttagtgctggtgttacaaaatttgaagtaaatttcacttaactctagatatcgtggtctaagttgcagaaaacgatacgggtttggatgattgttatccaaaactggccgatccaagtccacgaggtgcaaagcgtaaaattatgctcgtgcagggtcttgcgtgcaacatggtctccggctctccgcccctcagccctacgcgatctgggccacggaagctccatcgaacggcccaggcttacccaagaataacgatccaacttggggagggagggccgtttcagctcgggcttttttttcgtcgagccacaacgggttgacccgttagccattaggcccaaaaaggcccatgtaggaaacaagtccaaaaccaaaaccctcgcctcttcttccccctcctgctgccgcccacaccgccaccgcctccccccaacccgccgcttccgtctccgatggccgcagcgccgccgccgccaccgcctccgcagc

SEQ ID NO: 53581 - DNA, 263 bp, Oryza sativa
gatagggatcctactaaggcatttgaagccatgttgaatccaatttattttttaggcgaacttttttcagtacttattattttcttgcataaggttttccacccttgaccaccaggattcctatccatgctcatcatttcttgtgcctttcgtttgccttgttagttcatagcaaagccccacttttgtaagaaagatagaagtagaacatacacttctattatacaaataaaatttattataaccttcttctcattgtggtt

SEQ ID NO: 53582 - DNA, 1271 bp, Oryza sativa
ggttgatgatataagttatattttcctttaaaaatggtcccagtgtcccacatgtcatagacttgtattagttttacagtatttatttgattggtgttataactatggctaaccatactatttcttcgtatggccccacatcatagacttggatttttagttaactttggctaagtcatggctagcatattctatgtcaggcatgtcttacttaaagtgtagtttggaaaaggtagtaagcaatcaatcatctgctaagagtacgaaaggcggtgctaggacccatatgagacactatcaggttgcgctaaaaaggaataagtatatttgtctccctcatctcctgaccctgaccctagatgaatcgtctttctcaagtctcaatcgtagaactggtataacacctcccacatattcaaaaaccggtgtaaattgactcctcggtggtttcaaaagtgatttcgtcctatgtggcacttatgagacccacatgttagtgaagaaaaataaaaaattaacagtcccacatgccagtcatcttaatctccttttctttttcctcccctctctcggtgacaccggttagcattgttggggtaacagtggcgaggttttggggaagagaacatggagccacacgagcgcgaggcaggggagggacaaacgggcgggaggacacgatcactaccatgacatccctctctactgctgggcttgtctccatggtgtcatcaccaagaggcgttacattaagatgggtggcacgcgggagagaaactcgccggctggctgcaaggcgtgggcttctggggacttggccagctctagtgcgtgcgggaggagaagctcgtcggcgaccacgcacgtggggaggacttgactggctccagcacgcgtgggaggataagctcattgcccagctacacacgtggggaggacctcacggactacacgtgtggttccaatccttcctcctactactctcctgcccctccctcccccactcactcctcagtgctcctctcccttttgtcgaagccattttcgctcaccttcacaaccgccgcctagagagggagagaatgggagagagaggggacataaaagggtgaataaaaagaaaacggatgttaggacaactaatttgtgaagctattattttctctcagtgacatgtggatcttatgagtgtcaggtggaccaaaccgtttataagcaagagagcagatgaaatagaaaaagtagacttattccgtgtaaaaatgtgggat

SEQ ID NO: 53583 - DNA, 954 bp, Oryza sativa
cccccccccccccccccccccgattttgcttgccagactcggttaattaatgaggcacttgaatggtttttgagttttcaaagtacttaatctagtgatgcttttgttgacctccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatgg

SEQ ID NO: 53584 - DNA, 829 bp, Oryza sativa
gctgagtatgtcatatactcaccgtgcaatcattcatcagagaaagagttctacaatgaggctgatggtgtggagaattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctaaaaatattggaaaagtagaactgttctcctccctttctcttttaattaaccaaactaatggcacatgcacttcataatttttttttggttctcattaaaaatttattccagtgttattagtactgtacatctattactgtactaatggctcatttatcagcaaaagttttacaatattgttttatttaatcttgctgcaataaaataaatttaccatgttgattttataattttctttcatttcttttgaaaccagttattcaaaattacaaaatttatgatctcgtttccaactgttttaatttatttcgcaaagcttggtttactttaattacttacctttttactttgattttcaaactttattcaaattaatccaaaaacttgtgctattaattggatagatgtcttaactctctcctttcacttgtctttaga

SEQ ID NO: 53585 - DNA, 329 bp, Oryza sativa
ccacaataaaccacaattcaaagtgcccaggtgatatgatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataatagggtcataacaaaggtaaataggcatggctaaataaaacagtgataacgcgggaatttaaataaagcgataatgcaataatttaaatcaacataagtttataaactgggattcaatatgatcaaga

SEQ ID NO: 53586 - DNA, 1501 bp, Oryza sativa
tttgtcatccactcggagtgtcaagacagcgaagccctaatgtttgttgtcccaatattgcaattttctctaaaaggaccctgggtgttgcagcgagagatcttgctatgaatgatagctcaacttggtaaattatctttgagaaaatagtttacaaaatattaaaatccagaagaacaaaataagagtcaggttcaactcaaagccaatttttcgagtacagtatatatatgaaaatgggtactcctagggagtacatactcccgctcctattgaccgtccatcgaagcaagccccgatgaagcccgttaccggatccacacgcggtggacaaatttccgtccgcggtaatcggaaaatcgaaacaatgttgagctcgcatataaatccctctcgacagccctgatcgataaatcaggttgtcaacgggcgattcagagcgaacaacggcgattttgtgacatcaatccatggcacaggtgatatgagattctctttccgtcttctttgcttttctcgtggagcttcctcttgttatatcagtttttattgctcatgcacgagaaacgatctttaatacctgttcgagactagtaatcgagactaaactttttgatgtttaattagtaccaattgaaacaacatgtagtaaagatgcatactaagtaaaaaaaaataatagtatgtgagatttgaattcaacatctcgtagcataactgtacaatactagcagatatattcatagttttattttatttcttcttaacccttgtttagttctaaactttttcttcaaactttcaactttttcatcacatcaaaacgttcctacacacacaaacttacaacttttccgtcatatcgtttcaatttcaaccaaacttccaattttgacgtgaactaaacacacccttaacttaactatacctggtaggcattcttttcatttccctgtcctctgctcagaaattgtactcgagcagtacgtgttgagttccgcacacagaatgtaatacgtgcagaatagaacaatactagtactaccattatgtagatgtggatgtttctgttgtaaccatgataaattcatcatggtttcttcgggaagcatgatgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccactcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtca

SEQ ID NO: 53587 - DNA, 1501 bp, Oryza sativa
agcacggacatcgatgaatacccagcaatcttgaagggtatgtttcttggttttgtagataggacaccaagacctgatagcttcgggagtcatctttgccggtccgtgtattttgtcggagggacaagacttggccgcatcagaatccttcccgagtttgaatgtagtcggtaatccgttctccgtttcaatgggtgggtttttcgacatggaaccgtcttggttcgtagccactgcgttctcgttttcagtcattggaggaccggttgagatcggcatcgtggtgtaaaccgggaagacgatttcgccgacttgagtccataccagcattgttgaagtcgagagtgtttggctggagcgggtgttgacgttgttgtagacgaagcttgatggcatagtagtagaaccttgagtaccaagtccccctacctagcgcgccactgtcgatgggtgatacccgtagaccggatatagagtgtataggggtacgctggtacaaggatctacgtagtacgacatcaagcaatcaaaagacaggaattatactggttcaggccccttaacaggtaatagccctaatccagttgatatgggattatatagcggaaaacacaggttacaaaggaaaagatggaacttgtcagatccggcgagattgtagtcgagttgattcgactagctctcgacgacttggctcctcgcaggctccggcttcatagactgtgtgggttgtgttggctctgagattcgatcccctatgccctctccgggggatcccttttataccataggtctgatgctctccgagtaggactcgaacacaccagacctagcacgatacgtaggtaacccagtccttgtccgagaaggactctttccgtctgttgatttcgtgaaaagtttccttagattatgaaggaaatgtccgcgtacgcgtgggcatgccacgtcgatacgtaacgtatatcgaagggtagagggtatgccagacccgtaacctcgacaacaatgatctaggctcgcgagccaaaacaagtggctcgcgagctagctcagctcggcttatttcagcaacgagctgaaaaggaggcttcttgggcttggctcgtttggcttacgagcagagccaagccaaccaagctcgagccaagcccgagctttttttccacccctagcggcgatgcgccaataaggagaagttagagtcactgctctatcagagaataccagcagttggtgcctggagaggagaaataggcccgtcaaggttggtgcgtggagagagaggaggaaaatgttatggtcaatgacatgtgggccatgcaattactattattttttcactggctagatatgtacgtcagcctcatgtatatcaaaactactcaggtttgaattgaggggtaaattgaacggttttagaagttgagagatgtctaaaaatctggttttgaaatttgagggtgcattttaaatcaacgcaatagctgagggggcgaaa

SEQ ID NO: 53588 - DNA, 1501 bp, Oryza sativa
gtgctactccagtaacttcccaccgtacccaagatcgcctcttcacggttatggctgggagaccttcgtggagatgatgtagctgatgattgcttaaggtcatcgaccgtcaaagcacccaggacaggcctttcatctcggtttacagttgaaatggaacaaggagatccactttgcaccttgtctactgttgagttatctgaagaaaccaaccaagtagagaggctcgcatccacagaaacttccttcttgatagaattttcaggggttgcacctacctttggcactgaatttacattctccttattcgactttttagctggtgctgcttgggcttttacttccttccactgtgacatattctgaaccggattcagcacaggacggacatactggcctctgtcgcgatgattgtttctctgaattagagggctttgttcctctacagaggtactactgctcttaggtgcagggctgctgacttcattgtcattctgctgatctttgtacatttgcaatgagaaaagagactcatgggactcctgcttgatatcttcagtgtacagttcatccttgtctactaaatcaatcttgcagtctacaaaatcctcctcctcctcatcactatcatcaccgtagttgtcgtcctcaccatactcatcttcttcttcttcgctgtctgagcaattccggtaacggtgattctccgggagcagcacatccttttgcatgtgttttccatcttcattttctaccatactgacaggctctggtggttcctcctcttggtcagccggtgcagtgttttcatatgccgtaacattcatgtcgaacgttactttcttcttgccactgctgcggctctcttgtccgcccacctccctatgcatcaagaaagacggcatgttaacaggcacacaagccgaatcattcatacactaatcatttcgttaacctacctgagttctggatcaggagtgcaaacaactgcttccgccaaaggtggtgagtgtgccaccggggagagtggcggtgttacttgcttctccggcagcaaagagcttgctggcgatgccttctgctcactgcaaacagattaacagtaagaaatacaacatcgaatacaaggtgaaggtacagccatagaaatacggaactaaacgtatatggcatttgggaattaggcaattaacagttataagcaggctgccgagcattaggacatgttcatatccatgtcagtcaatactacggtgctgcttctctgaggcgtttcagcaaacacccgagctgcaattctctccctaccagccattctcacgcattcgcataagcattcgagagcaacagcgaaaattcacaggcacgcaaagacgaccacagtggaggctacacgcacctcagctcctttccgggccttgcgccagtgaccacctcctccgcagcctccaccggcatgggcggcggtgccagcaacacatccttcgcctcctgcaacagt

SEQ ID NO: 53589 - DNA, 233 bp, Oryza sativa
tgttggcaggctgcaggtagttcatttcaggctaacttgggttccctgcttaacatgttactacatgcattttccagattgatgtatatattaaatgtgacatcaatctgaaatatgatatcattcacttgactgtatcaaagtctgtttagtcatatgctctgatgagaatttaaatatattagtttctttcctatctaaatggctacaacagaaaatgggtttcacaaacc

SEQ ID NO: 53590 - DNA, 270 bp, Oryza sativa
caagtccaatcttttccattgtgctgtgtgattagtcagctagtacaaaataacactacgagccatgaattgctagagttggataatcttgaaataatattgaatggtccagatttgtataatttgggatcttgggtacctcctaacttacccttcaaagtttcaagttactatcggtttctttcaattgacacaacaaaggtgtgttatcaggttttgtactttttttcaatttgttaattatgtgctcattttatgcatgaagtgagg

SEQ ID NO: 53591 - DNA, 290 bp, Oryza sativa
cagcattacctatcagatttttggaatcatttgctagcctctgttctttggtagatcttaacttaagtggttttgaattccaaatgttgcccgacttttttggcaacatatattcacttcagtatttaaatctgtcaaaatgtttgaaacttgaggtattaccacaatcatttggccaacttgcatatctgaaaagcctaaacctttcatattgttctgatcttaaactgctggaatcctttgaatgccttacctctcttcggtttttgaatctctcgaactgctctagg

SEQ ID NO: 53592 - DNA, 339 bp, Oryza sativa
atatatcactatttgagtttgagtataagattattagatttgtaattagacttagcgtataagattgtgtagggttctaaaatacgacagttacacttagcatacatgactattttagtcttagcatataagattatttgagttttaatataagattattatatttgtaattagacttagtatataattattgactagctagggtcctataatatacgtcacctagacttagcatatatcactatttgagttttagtataagattattagatttgtaattagacttagcatataagattgtgtagggttctaatatacgaccactcttgtatgaacaga

SEQ ID NO: 53593 - DNA, 646 bp, Oryza sativa
ctgaatcttgatttggcttccttctcccttacccagatattgtgcattttttgtctgtaacccgtttttcacttctctgtgatggtgttccgtgccccactgtactgttagggtggtcttgctttttttcttctgttcttcattctttgttggcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcatttaagcatttaagggccctgaatgaaagcaccaattacaccctgtgctttgagctagataagtagtgccatatcaagtttgatgattctacttcactttatttcatatgtaacctagctttctggcatttaattgatctgtattattgtttaagtgtctttccccgtttttgttaataatgttattttatatttgtattcatgttaaattttcagcaaagcaagtt

SEQ ID NO: 53594 - DNA, 642 bp, Oryza sativa
acggacgttccgaaaggctcgctacaaaggctctacagcggacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccccccacgctgatcttcccgggtcagaggtgctgacgagggagtggcagccgaacggcgagcaacagccgccgctcgccgcgccctccgctttgacgacacggagccggtggtagcagcgccagaggtcttggtggcggaggaccgcccaccaacacctaggtgctgccgtgccgtcatgaccaagttggctacgtcatccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccc

SEQ ID NO: 53595 - DNA, 1501 bp, Oryza sativa; identical to SEQ ID NO: 39699

SEQ ID NO: 53596 - DNA, 1501 bp, Oryza sativa
agcggcccgaacctgtatacatcacccgtgtcttgtgtgtttccactttcgcgaacattccacagactaggagcttagaacctcacccagggcccccggccgaaccggcaaagggggacctgcgcggtctcccggtgaggagccccacgctccgtcacatgatgtcaataatatgaaatcgaaatgtttcttggttgtaatgaaagcgttcgaaagttcgagcttgttttcgaatcttatagagaatcatgcactcatgcttcgtatttggcagttggttatactcgctccttccgcttttgatgcataattcgactactgagaaaagttagttaattgctgtatcgaggaaaagaagcaagttagttttatagcaggtacaatagcatactataagagtaagtttaatagtatagtccactactagctccaattcatccatagccaatctaatagctcattcatacaatagttgcttactatactattaatatatggccccagtcatacacacactgtgttttggagtccgtgctgcagctggctacagatctgtagcccgctgctattctttttcattttttatctcataaaaatatgtttatagctaactaatggtatgctattgtacctgctctaagccagctatagacatattttaaaaagataaaagaggatagagaagtgcagtgggctacagatttatagtcagctgtagtacggactccaagaggcaatgtgagtatgacatgtgggaccagatattaatagtgtggtatatgtttctagttaactattgtatgaattactattactcaatccttcccaaattgatcatcatgtaaaagaatctaaaaattcttaaattgatcatcatataactgcatggacacggatttcagcagaatacagttaatacagcatggaagaatgtgtgcatgctatggtgtaagtggcatgaggttttaatcgatgcatggtgggagaatgtgtgtatgttgtattgattgatgtgatttaaattatccttggttttggtgtataaaatcaatttgggaaggaaggagtagattgactatagatgatttagagctagtagttggctatactattaaacttgctcttagcagctccaattctatccttataaaaaaacttagaaataataggagtaatatactactggtatcatgaataaaagtacaattgacattcgacattcttaattccttcaattatttttttggtatctcaaacacatcttctctaacaaaagttcatttgcaaattttgatattctcaaacataccccaaaattttatcttagccaacggcagtcaagccgggtaaaactgttatttctcctccaaacaaaaccccctaattactcttgctccaaaacctccccttctcaagcgctctctcttaggttcgtcgtgtgtttcccttcaccctcccatggcgagcaacccaagcagctccgcggcgagggctgcgggct

SEQ ID NO: 53597 - DNA, 1501 bp, Oryza sativa
cctccggcccatcggctcctccccgagcgcgcgccgctgacaggcgggcccgcccgccaccctcgctgacgggtggggcccacctgtcatccccaaccccgcgccgcgcccgccgccgcccgtgccctagcgccgccgccgccgccgattccgccgcatcccgccttccccgcgcgccataaagaggggcgaattactccccgtgattccctctcccgattccccctcttttccctctctctctccctcggattcgtccgatttgaatcccgcaatcgtcgccggcgtcttcaatggagcccgagaactccgcggccggtttcctttctctccggccgccctctctctctcccgtcgctataaaatcaatccccgagctccgctcctccgtttccgccactcgccgctcactctccccgtcggaatcgagcccgcaccgtcgcactttctctccgccgtcgccgccgtgctccggttcgccgccgccgtcgctccggacttcctccccactcggcgtcacctccatcggcttcgccgcgttcccgtcgacctcgtccgcgcctccgtttcgctcgccgaccgccggagcaccgtcgtcctcgtcgtcccgaaccgcgccgccgccttcttccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctaccttcggccgtgccggcgaggccgccttcgggcgcgccctcgcggctgccaggtgggacccggccgtcagccgcccgagcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagatttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagccttttcttttccgttggtcgtgtagacgctgcagcttcggaagatccgctcttcgtggaagtcgaagccgtcggttgggaaagcgagcaaggcaagtcatatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagagtaaacaaaacctcaactag

SEQ ID NO: 53598 - DNA, 502 bp, Oryza sativa
tcttgttgagtacggtggttgtactcagtcttgctcaatttttcccaagcccagaagaggagctccttgaagatgaaggctttggtgtgtagctcgtgcctgccgtcaagcgcctgtggtcgtcgccctagtcttcgctgtttctcgtttgtctctgtgtgtgctgggccttcgctgcccatgtaataagttaactatttacgcttccgcttgttaaactctgatttgtatcaacttttggtgtaccttgcctcctgggacaaggattcatgcacgcacgtaaggaatgcccgttgggttatttccggtcgtgacaagttggtatcagagcctcccttgaccctaggacgagccgtagatcccaagccttagcaatattttcaaaaataaaaatcctttgttatttgtgaaaactgtctagtctctctctgtcttgctgcttcacttatcatcaaaatctgacctttaaaatgttgtttctctttttgtttttgtttgtaga

SEQ ID NO: 53599 - DNA, 439 bp, Oryza sativa
agcatcgagtaaacaaagccccaataggacagagagttctttcgaggcagaaaacagagagacgtgtagagaagaagcatcctgcatattgcatcaggagcagcgaaatgaacagaagaaggcatctagctaatacaaattcagaaactggcacttccgcagcataccaaaacagaacaaactgaaaagagaaacgaattgatgtggtttaatttctcgagcttgcactggtagaaatagagaaacggaaggcaagatcaagaccaaatagagaaacggaaggcaagatcaagactaacatgttccgaggagaggcgaacgagatcaccatgaagcttccgtgctcttcaacctcctccaagaaactcacacacccaacttcaaaagcatcaagcaacaacaacacgggaaagggaagccaagaacaggaggaaaaaaa

SEQ ID NO: 53600 - DNA, 1501 bp, Oryza sativa
tgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccctcgccacacgcgctcgctctcaaacatctcttcttccggcgtca

SEQ ID NO: 53601 - DNA, 1501 bp, Oryza sativa
cgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtcccttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaa

SEQ ID NO: 53602 - DNA, 1501 bp, Oryza sativa
gcttcgcaatttaattaggtaacattaggtggttttacaactttagactttgggaaatattcatatcacctgggcactttggaattgttggtttattgtggaattggattcacaccgccccctctattcaaaagcccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatatggcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagtaagagaagctttggagaagatgtcttaggtggagtcctggcttataccccagttgagcgcctgtgaagattgagccgtaggcccgctagtccgctgctgtttatttttgattgtcaggccttaagtgcctttgtaataatgtaaatattatcgatataataaagatgtgtcttttataccatgtttgtgtggtgtaccccggcttttcctgggacggggattaatacactagcgttcgggaaaaggcaattttcccggtcgcgacacaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattatttg

SEQ ID NO: 53603 - DNA, 317 bp, Oryza sativa
attcctgcagcccctgaatgaagaatctgatgttgacgtgtgatgcaggaggcaacatcagtttcgctgcaatctgacaaagtggagggtctaaaagttgaagcttcttttatgtctgaacaagacttgctttacttgggatcagttggattgcttggagaatattctcggacaacgagaaaaaggcacaagctctcgcttggaaggccctgctgcgcactggtttctgctgattcatttcaaggatacaagactactgttccttttggctcttggtgcttctgatattatctcagcgaaagaaaattaatccaaga

SEQ ID NO: 53604 - DNA, 280 bp, Oryza sativa
cagtatcactattgagatcataatacatactgatcagtgtgtgaatttcagtttaagtatgtagattagtacacgtcgaacacagcgtgacgctcagtatcagcagaaagattagtagctggacaaacacatgtaattagaccagaagcttattaagacctttccatactgaagcaacaaaaccatcaaaacaccagcacatcctgcatccagccgctaagaacacagcgcaagatatattaacacagataatatcaagcaagtaacagatgcagccagt

SEQ ID NO: 53605 - DNA, 1501 bp, Oryza sativa
aaaatcacaaccaacccctctactatatataatttcagaaaaaaaagaagaaaagaaaccaaaacaaagtgccgctacgtttaggtaattgcggcatcggcacatcgtgttggattggatgccacgtcttccgcgccccgcccgtgattccgcaccgcatcaaccaacaagtcgacccgtcgccgagtccgagactccgatcgccacctctcgccgtcgctgatttgacacgcaaccatgccagagtgggcgaataccatgctcctctctcttctcatgtgaggttgcaactcatgaactcagcaaagaggcggttgatctcttggcaccgatttctatctccgcggtgagcactaggtgcaaggccgaagcagtgctggcagcacctacaagtctccaaatctgcaggtacaagctcccgtgttctctctctctttctctttttcatatctcctttctacaatctgcattgttcttgcctgaaatccatgtgctctgctgtaatatatgcttctactgtgcaatagtaatacaacaccgaccagaactaatgccaaagagatcatagattcaaagttgatctcatgtcgctgctaggtaattcggttctgttttattaacgtgtgtgtactgattcggtgaaacaaccaccgagttgatctactgaaatgtagtgcttgttgatctgctgcagtgcagtgctaattgatctcacccttaaaatgaaattaattggtgtcgaaaaaaagaaattaattgtttatatgtacttctatacattttgtgagtcggaccacctataccctaaattttagatacatcactaatcacgttgcttcgatgacacctccttcttgttccgccgcctaacttccccctcttcctcctcccccaaccccccttcccccctaaccccaacctaagatgctaaccgatcggtttgccaccatcatgccgaaatccccattatctcatcggagctaaagccaaaatccccactattcatcttcctttgatctggtttagttcctaaaattttttttctcaaaaatatcacatcgaatctttggacacatgcatggagcattaaatatagataaaaacaaaaactaaattgcacagttcgcatggaaatcacaagacgaatattttgagcctaattagtccatgattaaccataagtgctacagtaacccacatgtgctaatgacggcttaattaagctcaaaagattcgtctcgcggtttccaagcgagttatgaaattatatttttcattctatccaaaaaccatttccaacatccagtcaaatatgcgatgtaacacacaaaaattttcttttcgcgaattaaatacacatttctttttttttttcaaaaaagaacatgaagaaaaggcacaatgatgacaacagacagtttcccacagaagatccaagacgcctgccactctaaactaggcaaaacacctccgaagtctcagctcagcttctcccctcctc

SEQ ID NO: 53606 - DNA, 702 bp, Oryza sativa
attcctgcagcccacaggcccattcctgcaggtagtaggtattttagttcaaataaatatataccagtacaactacctgcaaaactatcatatcaaacaaaatattctccataagcaacagcaacatcatcctgaaatgttaacatacagggtgtgtttagttcacgctaaaattggaagtttgattgaaattggaacgatgtgacggaaaagttagaagtttgtgtgtgtaggaaagttttgatgtgatggaaaagttggaagattgaagaaaaagttgggaactaaaccaggccacagtatggttttcaatagcacaatacgagcaattaaatctataagcatacatgtagaatttccatgaaaatcataaggtttgcactgataaaaaaaagaaatgtgatactgtgataaaagatcggacatgagtagatcatttgatcacgatgcaggcatagtgaccagtgccatgaattcacccagctatatgacatctggaacgaatagtagcatacatgcaagggattagctatggtccctacctgctcaaccaaacagatcaagtcatacacccacccagcgctctcagacacaccagaagaaaccacactaaaagtgggatctggatcaatttgcgcaaggaaagccttctacaggacaggcatgtacctagcaggtaggggaggagaactgataagtagt

SEQ ID NO: 53607 - DNA, 954 bp, Oryza sativa
ccggcgaggccgccttgggccgcctcccgcggttgccagttggggccgggcggtcaaccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgagccttttcttttccgttggtcgtgtagacgctgcagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattgttattattaccttgttcaccctagattaaacaaaaccccaactagtggacactctactcgtggtatcactagtatgattttaggtagatgcttcgcaatttaattaggtaacattaggtggttttacaactttagactttgggaaatattcatatcacctgggcactttggaattgttggtttattgtggaattggattcacaccgccccctctattcaaaagcccccaaaatggttttaggctgggctcggggtgcatggttttgatggtagcacctcggccatataaggaccggt

SEQ ID NO: 53608 - DNA, 1501 bp, Oryza sativa
gtcgtcccggggtgagccgaggaccgtccttcgctttccctcttctctccgctctctcgggcgccgctccgccgcgccggtggtcgccggcggtgaccatcggggagcgggtgcgccgcctcccgtcggccgtgccggcgaggccgccttcggccgcctcccgcggctgccaggtggggcccggccgtcagccgcccgcgcccgcgggtgcggctgacttgtgggacccacggcgccgaccgccgccagccgcgtgctcccggtccaccgtggaccgagaggctgacgcgtgggccccactcccgtggacccggtccgcgcgccctctctctcggctgacgcaaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgtgtcgcgaccgggaaaattgccttttcccgaacgctagtgtattaatccccgtcccaggaaaagccggggtacaccacacaaacatggtataaaagacacatctttattatatcgataatatttacattattacaaaggcacttaaggcctgacaatcaaaaataaacagcagcggactagcgggcctacggctcaatcttcacaggcgctcaactggggtataagccaggactccacctaagacatcttctccaaagcttctcttactgaagaggggaaagattgagcaagaataagtacaaccacagtactcagcaagccacaccggagatgcataattaatgcaagggagtacaaggggataataatataggggttaagttttgcagtaaacagcatttaaaagtcacttagttgccccaaagccattttataagacaatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggag

SEQ ID NO: 53609 - DNA, 319 bp, Oryza sativa
tttgcaggaagcaatgtaggggcttcctcgtcttcaaatagacttaacaggggtttctatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagaca

SEQ ID NO: 53610 - DNA, 533 bp, Oryza sativa
tgatactcccatgcaaagcaatcaacatactctttaagtagctcgattatcttaaccttataatcgcactctcatatttttgtttacaaaagtcggccttggtttggttccatcacctatgtctactgcctccaacggatcggccgatgtaaacccttgtccaagcttctccacttcatcaaaatcttcaatagtttcaccaatatcgttctttgtagaccgatatttttgcaccctcttttgtaaccactctaaattagcctctttactcattatacaaatttatatggcttagccgtgctacactagccagctttacagagataggtacaaattttccatcggagatactaataaaatcatagctagaaagattcctccccgataagcattgaatattcccatgacgccactcaaaagtagcatcggccattgcaacctcggctgatgtatccgcttgaacaatttcaacatcatcgccgtcccattgaattaaacattgatgcaaggtagaaggcacacaacaattggca

SEQ ID NO: 53611 - DNA, 574 bp, Oryza sativa
ggtgagttaatcatagcccaagttaactgctgcctaaatgagtctaccatactacttagatacttgtgatatcatatcaccaaaagctttgcaatggattttaaaataaatgtgctattttgttctatccttacatgtggaaaacttgcaacattgttcacactagtaatatgaaatctgcggagaatgtgacgatatacaaatgatccttaaaaaaatggtttgaaatggatgcgatgggtaaaggccttgtcatcacaaccaactccttttgtcaggggtctctggaagattattggtttgtgcgaaaaaaaaaaaattaaatttgggttggtccattaaaaaaaaaaaaaaaaaccccccttttgggagttcaatatgttgctctagataaataatgtcaggcaagactcgatggaatttagtacatcatatgcatggtatctaaattttagctatagggagcaatcagtgtgtgtctcactggtgttctaggattgattatcttctagagtcagaaagcaaatgtactctactgaactacagaatatctgactggcaaaattttgacaac

SEQ ID NO: 53612 - DNA, 210 bp, Oryza sativa
gattcctttcagactatccaatccagatctaggtcattggaagaatacctttaaatcttggccatctctagaaaaaacttcacccgagaaaagttggattacatgggttcaagcgcatatcggctagcaaaagagttcattgggacgaaattggaatcggccaagcacttaacctaaccatagcaaactcagccaaggatgaacctctaa

SEQ ID NO: 53613 - DNA, 177 bp, Oryza sativa
ttaacgccgtttactttttaaacatgtttttaacgccgtttactttttaaacatgtttgattgtttgccttattcaaaaaccttttataaatcttatcctgcggccggccggctggatgaatgccgggcctagctcgtcgccggcgactgatgtttttcttcttctccggtggcagg

SEQ ID NO: 53614 - DNA, 238 bp, Oryza sativa
attttatattgggatttattatttaaaaaaaatagatcttctcgtctaggcttttaaaatcatttctaataattccatttaaacaacaatttatatatttaggatttttagggtgtgacaggtcttgagccttttagtggagggacgaaggagatacggaggcgggaaactggaggtgtcacggcggcattcttctgtcgttcgtcctcgtgtgtgcgcgtgcgagtgtgtggcatca

SEQ ID NO: 53615 - DNA, 158 bp, Oryza sativa
actacgacactttatgcgtaatttctgtgtgctgatcgatgaaccaactgctgtctccgcgttactctacgcatgcatgcttttatataaacatgcatatggcgcgcaattgttttcgacgattactatatcgcatgattcttctgcatctcctgaaa

SEQ ID NO: 53616 - DNA, 296 bp, Oryza sativa
cttctgggtgaggcatcacaaccagcacctcgatgccccgcctaggccactggcccacctcgaggccacccgctgactagcaccccaaccatctctctaagccaaagaacacctccgacttcctcactcccgatccaccccttgccccttcccacaacctaccttgaaactctataaccacttcggagctcattgaaactagaaaaggaaatcgtggagaagttctggaggttagaattttgagctattgttcatctagaatatgccaagtgatgtatagcaattctgtatgaaca

SEQ ID NO: 53617 - DNA, 1501 bp, Oryza sativa
cggccggcgaaagggtgcgacgcgaccggcgctcttctccctcctcttctgaagcatgcggcggcgggggaagacgaggcgacacagcacggcggcgctaccgacggtggcatggaggcagaggtgagggcggcgcgtgccggcagcggcctggaggtggaggcgagggcagcgtggcgagcgcgcagaggacgcggcgacggttgcctatccggagctccgcagctagccacccgagatcgcggaatctgcctcggatggtctgcatcgacactggcgaactgcagcagggcgacgcccatggcacgcagcgcccggaggtagaccacatgctccgccgccatgtcccgcctcgccttgcacctcgacaccgcctcctgcctctccagcctccactggcacaaccccatcgccgccggcgccgctgcctccgcgaggttgagatggatggatagagatgagctcgcctcgtaggtgtttgatcttttgcacgcgtgttgcctgtgacacacacacggcagtggagtaaaaacagagcgagaggggcatgacatctcgggcagtgtgcatgctctttctcggccggattccgcgattcctcctccgcaggctccgcagctagccgcacgcgcgtgctccgcctcctctgccgcacgcgcgtgcgccgccgctggccgccgcgcgggcgttcttcgcctccgccgccggtcgcccagtccgcctccacctccgcgtgctccacagccggccgcccgagtgcgtggtatagatggccatgtgggccgcccggcacggcccaggcccggccgtgcctgggccaaggcttgtcgggccggcacggcccgaccgacgcaccgggccgtgccgtgccggcccacgggccgcacacatggcccaacatgactcgggctgtgccgggccggcctgaaggcacgacggtccatcgtgctttttctcagaataagtctaattttcctccctcctcttgggctgtgacatatatagctcaaaaagtctatttaacctccctcttctttgggttgtgatataaatagataaaataagtctattttaggtcccttttctttggaccatgacatttatatgtctatttttagtccctatactttgtgtgccgggcctagcctgccggcccatcgtgccgggccggcctgatcgtgccaggccagcccagcatgccggtggggaggcccaagcacggcacggcggtcgggctgggctagcacgggctcgacccaagtcgggccgtgctatgcttgggccgggccaaaaggtcgtgccgtgggccgggccttcgggcctcgggccttatggccatctatagtgcgtggcctgtgcgcgagagataaccactagggaatgacaggtgggacccagggaattttttatttttttcgctgactggattgctacgttggcgccacgtaagcaagctcaagtcaaaaccactcaaaacagcgttgaggggggttatttgtcc

SEQ ID NO: 53618 - DNA, 1501 bp, Oryza sativa
tgtaggccacccggcacggcacggcccaagcccggccatacctgggctgaggcttgtcgggtcggcacggcccgaccgacgcaccgggccatgccgtgccagcctaatggcggcatacacagcccaggcatggcccaatactactcgggccatgccgggccggccagaaggcacgatgggtcatcgtgcttcctcacagaaaaagtctatttttggtccctcaactctgtgggttgtgtttaaatggctggagaataagtctattctgtatactcctcacagaaaaagtctatttttggtccctcaactctgtggactgtgtttaaatggctggaaaataagtctattttgtatacctcttgtcttgggccttgcattatacgattatttaagtctattttgcatccctatatttttttatttgaccaggccgtgccgtgctggcccagcgtgccgaaggtgcggcccaagcacggcccggctgtcgggccgggacggcacgagcacgaccccagtcgggtcgtgccgtgcttgggccgggccaaacagccgtgctttgggccgggccgcgggccacgggccatatggccatctatacttttaactcagtgttttcatcctcgttttacataaacttatttaagtcaaagttgacaaagttcaggcactcatccttataagccacttcatctcttcttcaatcttccatggtgggggaagctattctaaactcttgaagggacatccctcattatttgcatgtgttctaaatggttatgaaaatatttgaaaaaaaccaataagatagattaatatatgataattaaatcactacataaacatgtaaggtcaaatttaacttctataagttacaacgaaaaaaataaatttgaatgtgaatatacgtttactagccatagtttaatatctttttttgcaacttgcagaagttgaattttaactttcatgtttgtggagtgatctattacatattaatctatttagttgaattttttttataattatttagataacatgcaaataataaggagatattccctcgagagaatccactccctccaaggtgtactaatattttgcactgtatgccgctgctgctgcattgagttgctgctagcttgctgaccggcctgatcttgcgtgcgtgcatgctagcttagcttggcccaaagaaacagggcctactctcaactctctctcctcgctgcaatgggtcaagcccaaacaaaccagccaacttagcccatctattctccttttcctttttttccccttctctagttattgtaggacatttacaccgtcgctgttacttttacttttttttttactccttggctcgatctcccatggtaacctatgctacctcgatacgtcgatacatggatacggtattttccaaaaaacaaggatacgggaatacatttatatatttatatatatattagaaatacaaaaaattaaggattcttttaagaaa

SEQ ID NO: 53619 - DNA, 1501 bp, Oryza sativa
aaaaagtacgaattacccccctcaactatcgcggtcgattgaattacacccctcaactgaaataccagacattatataccctcaactatttataccggacaaataacccccctcaacgctgttttgagtggttttgacttgagcttgcttacgtggcgccaacgtagcaatccagtcagcgaaaaaaataaaaaattccctgggtcccacctgtcattccctagtggttatctctcgcgcacaggccacgcactatagatggccataaggcccgaggcccgaaggcccggcccacggcacgaccttttggcccggcccaagcatagcacggcccgacttgggtcgagcccgtgctagcccagcccgaccgccgtgccgtgcttgggcctccccaccggcatgctgggctggcctggcacgatcaggccggcccggcacgatgggccggcaggctaggcccggcacacaaagtatagggactaaaaatagacatataaatgtcatggtccaaagaaaagggacctaaaatagacttattttatctatttatatcacaacccaaagaagagggaggttaaatagactttttgagctatatatgtcacagcccaagaggagggaggaaaattagacttattctgagaaaaagcacgatggaccgtcgtgccttcaggccggcccggcacagcccgagtcatgttgggccatgtgtgcggcccgtgggccggcacggcacggcccggtgcgtcggtcgggccgtgccggcccgacaagccttggcccaggcacggccgggcctgggccgtgccgggcggcccacatggccatctataccacgcactcgggcggccggctgtggagcacgcggaggtggaggcggactgggcgaccggcggcggaggcgaagaacgcccgcgcggcggccagcggcggcgcacgcgcgtgcggcagaggaggcggagcacgcgcgtgcggctagctgcggagcctgcggaggaggaatcgcggaatccggccgagaaagagcatgcacactgcccgagatgtcatgcccctctcgctctgtttttactccactgccgtgtgtgtgtcacaggcaacacgcgtgcaaaagatcaaacacctacgaggcgagctcatctctatccatccatctcaacctcgcggaggcagcggcgccggcggcgatggggttgtgccagtggaggctggagaggcaggaggcggtgtcgaggtgcaaggcgaggcgggacatggcggcggagcatgtggtctacctccgggcgctgcgtgccatgggcgtcgccctgctgcagttcgccagtgtcgatgcagaccatccgaggcagattccgcgatctcgggtggctagctgcggagctccggataggcaaccgtcgccgcgtcctctgcgcgctcgccacgctgccctcgcctccacctccaggccgctgccggcacgcgccgccctcacctctgcctccatgccaccgtcggtagc

SEQ ID NO: 53620 - DNA, 1501 bp, Oryza sativa
acgcgtgtacggttatatacaccggtaatcccatgtgttatatagtaccactccttgtatcagtagatggtacacacatagcatagtataatatcacaactgacatcgtttacaggtgtttctacaataataatacaagggtaacctcattgggtcccgaaatagaccaaacatggtcacttacaatacaaaataccaaagtactagatagaacagcggaagcgaagcagcggtggtccatcgaactccacaagcaacgactggtgaacctatggtccctaatccatcatcttcgacacgcacttgatagtagcatggcatgaatataatcgactccaactcctttctaaaagatttaattaagcaagggtgagtacatacgtactcagcaagccactactacaaaatgaatctaatgcacacagaggttcaagtatggcttggtttatttgcataaagctagttttcacaattcatttcacaaacctattgacctagcagttttaactgaaaaacaacattattgttgaagttgtaattatccagggttcatccacctctccaagccccgcttggttcggtttaccctcacatttcatcctataccaactctactatactaaccttcccactctttgggcaagtttctcatgtctctcatatctactctaagtagtattaaaatctatgagtctagtcaagggtagtacaggtcctagcgctcattaaccacgagcacggcttttcgaatagtttaatttactcacactgcagtggatgtacgcttttaatcccacactccgtgacgcacccaacacatgagacttgtcacggcccggtttttcagttacccttgcatggcggcacccgctccaaggactatgaatccccattgcacccccggtgccacattcctacctcgagccggttgtgaggggagtcctggcgctcccgagatcagagattacattatacatatatatagttttgacgtcattaaaccacatacttccacatttccataccaatgtccagaacctaccatgtctggggtgccaccccacgagaataacctagtccaccgggtctaaccccactcaagaagtgtggtcgtactcggttcgtttcctgcttagcttcttgacttggtccttaactgaccggggtcagcggcttaccgttcccagaaccacccatattctattcgtgtcgtcccagttgaaatagttttgttgtattaagttttggttttcgcagaaggtttgtgtatggcgggtggtgctcatgtctccacccacaaatcatcaatcactcacatcgagtgatctcacatccataatcatctagcataaatatggagtgtacgtatgtctaccatagcattactaagcatcatcaataattgaccgcatataaataaatgactcaggtaatcaaaggcatacaacatgtataaaggtaatcaatatcaagggtaggcataatcaagcataggtacgca

SEQ ID NO: 53621 - DNA, 1501 bp, Oryza sativa
cgcacctctggccacgatgggagagaggacgccaccatcacaccctctgccgccatgagggaggagacgtcgcctgcctcccctccaccagatctggtagaggtcgctctcgccaccgccccatctaccaccaccatgcatgagctccccttgttggcgccatggacaagaggatccaccgctggagcccgcccacagctgaagcccgggcgactgccgacagtcgaatccaccgccggagcccgcccacgctggagccctcgccgaagcctgcgtgaacaccgaccgacagagctctcgtcgaagcccgctcgcgcctgtgcggcggccgccggtttgctgccccgccactggatctagaagagatagggtgtgaaagagagaatgatgtggtgggtggtgggagagtgggtattggatagataaagataagaaaaaaatataattttgtttcttcatctcattccagtattttttatggatgaccgtttgtaaaaatctatttttataagtgaccttctcaaacaatcgctgataaaaatagacttatttttacaaacagttatgtaaagataaccgcttgcagatcttcggttacagtttcacgagcgttttttattttacccgcctgaaaaataaaaggggttattctaggaaaagtcgtttttaagtagcgaaagtaactcttccgcatattaattaaagcagtagagctagctttttctttgttcaccgccagctttgttttcgttgcttacgatgatagacaactatttaattctaatatgcacaagcatgcccaagcatctgcctccgaggttgaattagatgtatcctcctttgctgctacacattgagtaaacgctgcacttttttcccatttatatacgctaatatgcaggtcaattaaggataaggtctttttttcccaagatttcatgtcaatgtcactaaaattggtattgttaagtataaagtttgcagtatatatatacacacaatgtgtgtaatgttagtttatttaactacaattttgtagttttctatgattttacatttatcttttatgcaagtttgaatttatttttgcatgtaatttcttacatttgtatgaattgtaggtgtattcttgtttaggttagactaatttattgttcaacaattttatcattgaaagaaaggacttctaagtaatactgtattagagtaatgagatccatcgtttgtaatttttggatgggaaaagtaactgatattttttgaaaattcgaggtgcatgaaatcaagacacgccctaagaaaaaaaaagcatagtgttagagtaattgaagatatacacgtgcacttgtgttgtaatttgattttcctgtaggaggaatatgtatatatgtgtgtctaattgaaggtatgaatacttgctactacttttgagccttgggatctgtttagcacagctccagcttcatctctttagcttgaactcaactaaacaatttcagtt

SEQ ID NO: 53622 - DNA, 371 bp, Oryza sativa
ataatgtaaatattatcgatataataaagatgtgtcttttatatcatgtttgtatggtgtaccccggcttttcctgggacggggattaatacacttagcgttcgggaaaaaggcaatttttcccggtcgcgacaagctggtatcagacctctcgactgtaggaaaagccaagtggataaaacctaaggacatattttataaataaaaattatttgcgaaagttcctcttttctccttcccccaatgctttttgcaaaaggtttactccgttcttccttcttcggattttcaactagtactagatggtcaggtcagtgaagaagaggacatcgtcagttgtttgccgaagttccagaagactgcaggatctg

SEQ ID NO: 53623 - DNA, 153 bp, Oryza sativa
aaaaattcataactaattcatcttagctcggatttagttggttcaagtctctaattttttctaaaattgagatctacatgttaaaaatatccacatgtactgttcatgcttgtttatgtgctgttttggtgattttgctcttttctctttaga

SEQ ID NO: 53624 - DNA, 1223 bp, Oryza sativa
gacaatttggaattgttggtttatggtggaattggacacacacttttcttcctctttcaaaacccttaaaacctgttttcggtggggtttgggtgcatgccagttgtggcaagtagcaccccgggcactataaggattaagctcgggcctctgttgcaaagcactacagtacttccacatgtctaatgggtaaggcttagtttgtggctcagtctagtcttaaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgaccctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttaga

SEQ ID NO: 53625 - DNA, 174 bp, Oryza sativa
aattctgcttttaaatttttattttagataatggataaaaatccggcctctatatccacaagtggatatacagagccaaactggtcttaaatttctatctagtgcatttcagttcaactgaattacacggcatgtattcaaactaaatctcaaggatgttctttcatatgcagc

SEQ ID NO: 53626 - DNA, 1501 bp, Oryza sativa
caagtccagaagaggagctccttgaagatgaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatccccaggccgtagctatattttcaaaaaaataaaaatcctttattatttgtgaaaacccgctattctctcttgtcttgctgcttcatttatcgtcaaaatctggcctttaaaatgttgcttttctttttgtttgtagatggccggcagcgttacccgtcgtggtttgcacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgctctggcccgtcgcagcggtagacgagcagttagtaggcttgcgcgtgtgtttttcctcgtttgtctttttgagttgtgtggggcatggttatgccggtgtgtggcataactatgtcggagcctgtcttattttgtttgcctaagcaacttgaacattaatgaaccaatttaatatcagtaataaatttaagaataatagtagtcgtgggtggttagttttatttgttagctccttctctgtttgctggttctgggtggggttttc

SEQ ID NO: 53627 - DNA, 498 bp, Oryza sativa
tccccactgccagccagccgccgccgccacctctgccagccagccactggccaagggaggggtgctcgtcgctgccgccacctctgcccgccagcgcccggccatgggaggggagcgacgcgagagagagggagggagagagacgcgagaagggatgtgatcgatgtagataaggaccgtgtggtgtggacgactagataaggacgtttggtgggtgtggaccatgtggtgctgctgagccgctgatggctcggcttaagctataggtgccggttctttcaaaaaactggcacctataatatattataggtgccagttttttgaaagaaccggcacctatagcttaagccgagccatcagcggctcagcagcaccacatggtccacacccaccaaacgtccttatctagtcgtccacaccacacggtccttatctacatcgatcacatcccttctcgcgtctctctccctccctctctctcgcgtcgctcccctccca

SEQ ID NO: 53628 - DNA, 282 bp, Oryza sativa
aaatttcatatacctggaactaatcccttttaattccctctaatttatttctcatggggattatctgaaaagccttttccttcattgacctggcaatgccatacaagcaatgatgaaagaacattaccaacaatctctgtgcgcgctgtgaaattattgataaatcctcagctaagtcatttaccgactccgacgaccaccttaatataccgcggccgcaacaactcgacgccaccacctcacaatcaaggtcgctaacgcaccggccaccgccgccacagc

SEQ ID NO: 53629 - DNA, 1501 bp, Oryza sativa
ggacggcgaggccggcggcgagctccgatgcccacgggtggcagaagtccaccacaaggcacgtcgggcgagcgtggaggaggaggtggcgttgtcgagcgggaactcggtgaggcggaccgccgggccgagtcaacggtggggcacaccctcgccaccgtggccggcgtggcgacgacggtgcagagcgcgccgtgggtggtgtcgaaacaagatttcggcaatactaaaagggggtggctatcaagctagaaaagtggatgggtttggagacaaggaagtttatacaggttcaggcattcttaataagaagtgataccctactcctgtctggggtttgatccgccgagtgtattattgatcgtatgatctgagagtagaatctcgtatcccaagaggcacccggacccctccttatataggagaaggagtccgtattacaaaatacagcccatatccctaacggaataggtagttacagatatgacctaatcgtaaccaactaggatcctgggtacttccttaacacacaagtttggaacttaacccgggcctcattaaagatattctatctatacatggctccctatacccaatcggattatacatgccgtgtaggtatggggtatccataatctccatagtagcccctgagacctttacagtcgacgaaatagtcttctctcgtaatccgaagcaataatccgagtgatccaactccttctgctctggcctcccgagtactaaaatcaaagactgtgaagggctgaaaataaaagaagttaggtgcatcgactagatgcacctaattagctgtagcccccgactatgtgattagttaaaaactaaacatatagtcaaggtacaaattacatccaaccgagtggtctttcaactgaatcatcaaaagtatcatacagctaagcatatgcgacgctgtgtaaaacatctagccgactgttttagctttaatataccaaaaatgaagatataaagaaacccgagtaagaaatactctaaaggtccataaatcaacacatatgacaagaatccgagtaaaaactctcaaaaagatccatcaaatgtggtttaaatcatgacaattgacgaatccaaatagcctaggctatgactcacgccataataaaaaataagcatataacatgccgagagaatgaccattcaaaaaccagtcatctcaacaaaacccaaacagcttttgcagcctaaaaaggcttacaaaattagtataacacttttccgttgggcacctttttatttgcatcgtagtaattccaaagaattatttaactgcgtcaaaaaggattttagcaacattgggctatattgttgtgagcaagtattgccgaagcaaaaatgcccaagtccctaaggatcacaacttagccacgccgataaccaaattgggctaaagtactgtttaggcctaggcccattagtactcccgaaaccctaatgaaataacaccaaaaacaaagca

SEQ ID NO: 53630 - DNA, 1501 bp, Oryza sativa
ccatcgtcactgcttctgcttctggtgtgggaggaagaacaggagggggcggcgtcaccatcgcacctcccagatcggcccatctccgacctccaacaccaatggatcggccaagccaccagaggaaagtagaggagaaagagaggagaagaagggcatttgtcgcacctgcagcccgctgtcgccgtcagctcgttaccatggaggtcgtcgccggttgatgccgtagccggcggcgggaggagtccggaagaccgagtcgccgtcgccgccgcctcgagtcaccgtgcccttgccaggaagggtgagtgcaggaagaggacggatctgggacgtcggaccgccgccgcctcccctcccaccggaagggagggcgccgccacctgccaccacccatcagcatcgagccctcccgcggccccatggcgagggagaggaggcgagggacggagaggcgtcgctgcgcggaaggagagccgccgacaccgaggagtagcttgccgggctgctccccagctcgttgtgcaccactgctcctgctctctactctctaggcatcattgccgcgggacggcgggtcgtgggtagagggagagaggaggcgtagagaactagagaggagaggagaggatgtgtggctggcgacaggagagagacggggaaagagagagagtaaacgagagagggtggatagagataaggttctttgactagaaacagtcacgatattttctcagtaaagtactgtaccagcttctgtttttcttatactacctccgtcccaaaataagtgcagccgtagatattcgtacccaacgtttgactgtccgtcttatttgaaaattttgtgaaaaaattgaaaatatttagtcacacataaagtactatttatgttttaacatctaatagcaataaaaatactaatcataaaaaattttcaaataagacgaacgttcaaatgttaagtatgaatagtgcaaaactgcacttattttgagacggatggagtactaaaatgaaatctacgacattgaattgaattccgctgaaaaattacagtgggttgagatacacgtatatacttagtgttgttttctttaattattattttttactagcgaaaaaactcgtgtgttataacgggtgaaaaaaatatttaatcataatatacgtttttcactcgtaaccatgtcaataacaatgtttgtatggatcgtttgtagctaagacaataagaaaattggaacatcttttcatgtttttatttaatttttttacggacgatggaaatacttttttctcatgcattttttatttttttacaaaagacaaaacattattttaacgttttttctgacttttttctcacgcattttttaatcgtttttattttctcatgtttttttagttgtagaatgaaaacttctctttttaagtagttatattagattagagttggagaagagatatatactgtctactaaaacgaatagaaatcgga

SEQ ID NO: 53631 - DNA, 1501 bp, Oryza sativa
ctttataatccttcctcccaagcactgcaaaaattatgcatcttaattaagaggccacaagtagtactccatgattccatgtaggttttttttattaaggctcatttaatttcatttcatttagcaacaaaaaacaagaactatactcccaatttgattttattaagaactatttggtagagctcctacttctaaatttagctaaaatgagttgggtctaaaataaagttctagagcaacctaaacacagctccacctttctagttctttttgtgagagcgctacatccagctccgctttcattatagatgaaactgaaattgtttagttgagttcaagctaaagagatgaagctggagctgtgctaaacagatcccaaggctcaaaagtagtagcaagtattcataccttcaattagacacacatatatacatattcctcctacaggaaaatcaaattacaacacaagtgcacgtgtatatcttcaattactctaacactatgctttttttttcttagggcgtgtcttgatttcatgcacctcgaattttcaaaaaatatcagttacttttcccatccaaaaattacaaacgatggatctcattactctaatacagtattacttagaagtcctttctttcaatgataaaattgttgaacaataaattagtctaacctaaacaagaatacacctacaattcatacaaatgtaagaaattacatgcaaaaataaattcaaacttgcataaaagataaatgtaaaatcatagaaaactacaaaattgtagttaaataaactaacattacacacattgtgtgtatatatatactgcaaactttatacttaacaataccaattttagtgacattgacatgaaatcttgggaaaaaaagaccttatccttaattgacctgcatattagcgtatataaatgggaaaaaagtgcagcgtttactcaatgtgtagcagcaaaggaggatacatctaattcaacctcggaggcagatgcttgggcatgcttgtgcatattagaattaaatagttgtctatcatcgtaagcaacgaaaacaaagctggcggtgaacaaagaaaaagctagctctactgctttaattaatatgcggaagagttactttcgctacttaaaaacgacttttcctagaataaccccttttatttttcaggcgggtaaaataaaaaacgctcgtgaaactgtaaccgaagatctgcaagcggttatctttacataactgtttgtaaaaataagtctatttttatcagcgattgtttgagaaggtcacttataaaaatagatttttacaaacggtcatccataaaaaatactggaatgagatgaagaaacaaaattatatttttttcttatctttatctatccaatacccactctcccaccacccaccacatcattctctctttcacaccctatctcttctagatccagtggcggggcagcaaaccggcggccgccgcacaggcgcg

SEQ ID NO: 53632 - DNA, 1501 bp, Oryza sativa
tatacgactccttatgtattttcaaaagcgaacgaaattaaaacccggctcaaatatagatctggatttctaaaagcgaacgaactgtatttttcaatacggttaaaaaccaactcatacacggatgacgtaccagagtaccggtaaaattatcttcaatttttataatagtagaaaagttttagtgattttggtgtcagcaatctctactacttcaaaaatttcaaaacgtttccttcgtccgtcaaaataaaaaaaaaagagcgaaaaaacaacaaaaaaaaagtccgactcccctaaaaagatggaaaaaaccgcagatccgattccccctaaaaaaggaaaaaatagcgaaaaacaactaaaaaaatccggttccactaagtggcaaaaaaaaaccgtagatccgaacgtgaaaaaatctgattcctataaaggtgaaaaaaagtaaaaaaaaagatccaattcccataaaaatagaaaaaagtctgattcgtataaaaggcgaaaattaaaaaaatctaaaaaaacatgtaaaaaagttcgtccgatttcctaagaaagtggcgaaaaatggcaagtataaactaaaaaaacacgcgtgaaaaaaaaagagcagaaaaaaaagcgtggaaaagaagtccgatttctattcgttttagtagacagtatatatctcttctccaactctaatctaatataactacttaaaaagagaagttttcattctacaactaaaaaaacatgagaaaataaaaacgattaaaaaatgcgtgagaaaaaagtcagaaaaaacgttaaaataatgttttgtcttttgtaaaaaaataaaaaatgcatgagaaaaaagtatttccatcgtccgtaaaaaaattaaataaaaacatgaaaagatgttccaattttcttattgtcttagctacaaacgatccatacaaacattgttattgacatggttacgagtgaaaaacgtatattatgattaaatatttttttcacccgttataacacacgagttttttcgctagtaaaaaataataattaaagaaaacaacactaagtatatacgtgtatctcaacccactgtaatttttcagcggaattcaattcaatgtcgtagatttcattttagtactccatccgtctcaaaataagtgcagttttgcactattcatacttaacatttgaacgttcgtcttatttgaaaattttttatgattagtatttttattgctattagatgttaaaacataaatagtactttatgtgtgactaaatattttcaattttttcacaaaattttcaaataagacggacagtcaaacgttgggtacgaatatctacggctgcacttattttgggacggaggtagtataagaaaaacagaagctggtacagtactttactgagaaaatatcgtgactgtttctagtcaaagaaccttatctctatccaccctctctcgtttactctctctctttccccgtctctctcctgtcgc

SEQ ID NO: 53633 - DNA, 1501 bp, Oryza sativa
aagtatcaatctgcagcaggatgtcaatgcaaatatatatgtacacagcgggggggttgcgagcgtacgtacgttgagtggtccaatgattgtgccggtccaggagcgcatgaagatgtcgtcgccgtcgtcgtccatgccgtagctgacggtgccgtcgccgatgcccttctcgccacgctccagctcctccagcaaccggaagttgcgtggcactactgcgatatgatggatcaatcaatcaatcaaaacccagcatccatccaagatatgcaaggaatgatcggttcgggcgcatgcgttgcgtacctacgacgctggaggacgcgccgccgatcgtcatggccgccgattgatatgcttccgattaatccctcctccactccgcgtgtggagagcagagacaaggagaagccggcgggtgtgagagcgtgggcgggagggataaaaaggagggcgattttgtgggtgcggccacttgcggagggagtgcgtgcgtgcaatccacgcaccggccggcccgcccgaatctgtcccctccctcagcctgcattcatatatccttttcggctttccttttcgttcgtcggtgccaggcgacttgggctattacaggggggacatggatgctctacaatgctgcatttacagtggcagtggctgataggtggactcggtcccatatatcagcggctgctactgcatgtgtagtactgcagacaatccccactgattatttgagggttggacttgcacatcaacggctccaatatctcatacaaactccctctgtttcatattataaatatattataaatcatttgtcttttttctaattaaactttgtcaagtttaaatagatttataaaaagatttaataatacctaaaatatgaaattagtttttattaaatctaacattgaatatagtttgataatattttttaaaaaatactacaatatttttctataaatttgataattttgtcaaacttaaaaaaatatataaaaaaagtcaaatgagttgtaatatgaaacgaaaggaataccaaacatcccatgtacacaaactcctgtgttttgccatctctccacttgttaaactgtctccttcctcctctataatcggttttcaagagggtgcgtgcaggtgcagggtttacttccccttctgggagtgaaaaacgttttactagtgtgacgacccagaagatcaatatggtgatttaccataggaaatctcctaggtgcaggaaggggagcgtgatagagaaataagcgatgactatatgaaagttctaacaaaaaaaaaactaatataccgtatgaacaatgtgggggtggctccctaggaccttcaaaatcaagtttaagtctcttaaatcaccacgtaaattttagaggaaaccagcaattgttcagttgagcctcaactcagccataacatttaagagcatccccagcagctcatccatattcgatcctccatatgcctatttaga

SEQ ID NO: 53634 - DNA, 1501 bp, Oryza sativa
gaacaaacggtccgtttggttggagggagtttttagaagggattgggagtttagaaagatgagcctattaactgctttgtttggttgggatacatggaaatttttgcggaatggggatggggaattgtgagaggaactctctccttttcaatacttaggtaggagatggtaattggggggaattcctcctttactttgcctaaacaaaactcagccatccgttttcattaatgaactaatctctaactaaactccctattaatttccatcacctctaccaaacaagatactgggattaaaaattaaattcccatcttaatctcaccatcaattttctcgtgtaaactctcaatctcaggattaattaagtattagctaaaaaattttaaaaacaaattaatatgatttttttaaaacaattttttatataaacttttttaaacgcgcaccatttagtagtttgaaaattgtgcacgcaaaaaaagagtgagatgagttgggaactcatgagaaagaacatactattaaactcgcattttttaaaaaatgtcataatcgcacgtacgattgttatgtttgattctctcgtacgattgctcacggatggtaaacgttacttgttgcggacaacgtgactggcttccgtcgaaaacgttacattgacgagcttcgtacgtaaaatattgttcctatagtagctctctaatcataatcataagaatatatagtagtgtagtacagcttagagcaggtttattagtaccacgagttactggtgacgtgtgtcacatcatctataagaaaattaatagctacactataattttggttatgtactgatataaatgacgtatctataggagagactatgatcaacggtaacattcatcttctcccgcatatcatttcatttcctaccgttaatttcatactacttgcgtcccaaaatacagtaacttttagttataaatatagacacacacttatccagattcatagctaaaaatacttatattttaggacggatggagtatttttgtttcacgtaaaatgagatgttaaaaacgtgtgatttaattattacaaacttaaaaaatggattaatctaatattttaaaataactttcatacagaaagttttcacgcgaaacgtaccgtttagctatttaaaaaacgtatcattttaattcaaaagtttatcctccactttcattagaaacgaacgggccaatggcacattacacgagaatatatccaaactctgtgagcacaatctgccatttcattgccgcaccatttccctagccgtccgatccacatccgtcgatcagaaataagcccagtgacgtgatcccaacgagaggggcatgaacgtaactaccgaccattcgcggggtgctgtccgaaaaaaaacagaacgcagtacacgcagatttgttttcctttcttctcccagcgttgagttcgccgccgggcgccgggagccgaggcccgagagaga

SEQ ID NO: 53635 - DNA, 1501 bp, Oryza sativa
gccgccgtcgccctgtgcgtggcctccgcttcgccagctgccgcccctcgccagccgccgtcgcccggcgcccaccgccttcctcctccgccgcttgccgccgccacccctcgcccgcttctcctcgcttcctccccgcttctcctgcgccgcttctcgagagttcgagtgaacagtgaataagaagataagggacatgtgaaaaaataaaaaataatataaatggatggtagttgaagtatatactattaaaatataagaggatgagatatagagcatgtaatatgaatgatctgttggagttgagagaaatataaaggagaaatcttttttaaatgaccatctaaataggcatatggaggatcgaatatggatgagctgctggggatgctcttaaatgttatggctgagttgaggctcaactgaacaattgctggtttcctctaaaatttacgtggtgatttaagagacttaaacttgattttgaaggtcctagggagccacccccacattgttcatacggtatattagttttttttttgttagaactttcatatagtcatcgcttatttctctatcacgctccccttcctgcacctaggagatttcctatggtaaatcaccatattgatcttctgggtcgtcacactagtaaaacgtttttcactcccagaaggggaagtaaaccctgcacctgcacgcaccctcttgaaaaccgattatagaggaggaaggagacagtttaacaagtggagagatggcaaaacacaggagtttgtgtacatgggatgtttggtattcctttcgtttcatattacaactcatttgactttttttatatatttttttaagtttgacaaaattatcaaatttatagaaaaatattgtagtattttttaaaaaatattatcaaactatattcaatgttagatttaataaaaactaatttcatattttaggtattattaaatctttttataaatctatttaaacttgacaaagtttaattagaaaaaagacaaatgatttataatatatttataatatgaaacagagggagtttgtatgagatattggagccgttgatgtgcaagtccaaccctcaaataatcagtggggattgtctgcagtactacacatgcagtagcagccgctgatatatgggaccgagtccacctatcagccactgccactgtaaatgcagcattgtagagcatccatgtcccccctgtaatagcccaagtcgcctggcaccgacgaacgaaaaggaaagccgaaaaggatatatgaatgcaggctgagggaggggacagattcgggcgggccggccggtgcgtggattgcacgcacgcactccctccgcaagtggccgcacccacaaaatcgccctcctttttatccctcccgcccacgctctcacacccgccggcttctccttgtctctgctctccacacgcggagtggaggagggattaatcggaagcatatcaatcggcggcca

SEQ ID NO: 53636 - DNA, 425 bp, Oryza sativa
tgtggactatggaattggggtttaggtgatgcaaactgatcccatagaaatccaaaatctcccggaagaaacttgaagtcgaaagagaagacccgccataaaagaaatgggagaacaccaccacctcgtgtgtcgggggttggaaacgcttcgccgaatgctggacgccacccgatgatctctttcgccggaagaactctcgccactttccccaaaaacaaagaagtttcgcactgtagcagagaatggggaaagtggcgagagtttcggcggggaagacgaagcgatgctttgtttttggtgttatttcattagggtttcgggagtactaatgggcctaggcctaaacagtactttagcccaatttggttatcggcgtggctaagttgtgatccttagggacttgggcatttttgcttcggcaa

SEQ ID NO: 53637 - DNA, 1501 bp, Oryza sativa
cccgttcgtttctaatgaaagtggaggataaacttttgaattaaaatgatacgttttttaaatagctaaacggtacgtttcgcgtgaaaactttctgtatgaaagttattttaaaatattagattaatccattttttaagtttgtaataattaaatcacacgtttttaacatctcattttacgtgaaacaaaaatactccatccgtcctaaaatataagtatttttagctatgaatctggataagtgtgtgtctatatttataactaaaagttactgtattttgggacgcaagtagtatgaaattaacggtaggaaatgaaatgatatgcgggagaagatgaatgttaccgttgatcatagtctctcctatagatacgtcatttatatcagtacataaccaaaattatagtgtagctattaattttcttatagatgatgtgacacacgtcaccagtaactcgtggtactaataaacctgctctaagctgtactacactactatatattcttatgattatgattagagagctactataggaacaatattttacgtacgaagctcgtcaatgtaacgttttcgacggaagccagtcacgttgtccgcaacaagtaacgtttaccatccgtgagcaatcgtacgagagaatcaaacataacaatcgtacgtgcgattatgacattttttaaaaaatgcgagtttaatagtatgttctttctcatgagttcccaactcatctcactctttttttgcgtgcacaattttcaaactactaaatggtgcgcgtttaaaaaagtttatataaaaaattgttttaaaaaaatcatattaatttgtttttaaaattttttagctaatacttaattaatcctgagattgagagtttacacgagaaaattgatggtgagattaagatgggaatttaatttttaatcccagtatcttgtttggtagaggtgatggaaattaatagggagtttagttagagattagttcattaatgaaaacggatggctgagttttgtttaggcaaagtaaaggaggaattccccccaattaccatctcctacctaagtattgaaaaggagagagttcctctcacaattccccatccccattccgcaaaaatttccatgtatcccaaccaaacaaagcagttaataggctcatctttctaaactcccaatcccttctaaaaactccctccaaccaaacggaccgtttgttccgttttaagtgaggaggattggcaccggggtgtccttgttcttgcttagcgcaatcaacaagcgctaagccgctaaatgccgttagtgtaatcgcatataatcggactgcgatctcctcccctctccgggccccgtcggtggtggtggtggtcgtcgccgtcgtggtggggtggccgggtggggatcctaccagtcaatcttaccggcggcacgcgcatgctcattgacttatcctcctcgaagatattcctctcacttcgctgcaatggattc

SEQ ID NO: 53638 - DNA, 229 bp, Oryza sativa
ccagtcccaggaaacagtgctggtatcacaggaagacagattatcacagcaacagaggtctctttattatagagtaaaggtacagtcatgttgggctgcggacagatcccgagctcacaactgcattacaaaagggaagcggaagccaatacttggaccaaacaacacaggcgcgacttgggaactaggccgaaaccctaaaactcatcatagccggcttgctcctaga

SEQ ID NO: 53639 - DNA, 511 bp, Oryza sativa
ctgtatagagcaatgatttaaatccaagacacgcaagcacttcgcagatgaaaatgctccatcattgagttttgttttgctacaacccaccaaatggagagcccttatctttccatgtaaaatcatggagaattcctttgatggcttgtcatagttggtgatgaatacgtagcggtaagtgctttgcccacatttattttctttcgtatcatctagaacaattaattcatcatctatgactgatcttgccatgtcatgcacaggatcatgcatggtcaatgttacgagtctatcatccttttgactaatctgcacaaagcaagttgtgtatggaaacgtcaaatcgtcaattataatcatcctattatactgttttggtgacttgagatggagatttgtttcaaaagtaatatactacttcaaaaaccttataatatgtggctgttttatcatattagatgtgccaaggcaaaatgattgatgatgtgccaagcaaaatgatccatcattg

SEQ ID NO: 53640 - DNA, 346 bp, Oryza sativa
ggtgggtgtgcggggtgcgagaggtatatgagtgggtcccaccgtttgctcttcctcgtcatgactcatgaggtgtgagggggtgtgcgtcagtgggcctaccaactatctacttatttaaagtaggtagatagaaatttatttttgacttatctttagtgaagaattattgtttttatatatcgggaccatttgaaaaaatatatatatataatatgtgaagatattgcatcaattatacagcaaagatattaatacaaagataaagtagatgagtatatctaattgttaaataacataggtttcaacgagaggggttggactacccccttattaatactctagg

SEQ ID NO: 53641 - DNA, 1501 bp, Oryza sativa
atataatgctcgtttcatactacctaaagctcttatcttattagtaattagtatatacgtcataaagacatgatgatattgctactactggctagcagtgtttccctcgctaaccaccccgagatttggaccggacatctgatgtctcctgcgaacaacatgcctttttcttagtattaagcagccgacatgtctcgatctaaacatttacttcctctgttttagttatataagatatttggtcaaaatcaaactataaatttaactaactctataaaaaaagtaatatttataacactatcattttttcattaaatatataattaaataaattttcataatatactagtattggattaaaaatattactatttttttctacaaaattagttaaacttagagtaatttgactttgactaaaatcaaaacctgaaacgaaggaagtataacatttattagttgatcaattccatcagtgttagcattcctgggtgttcgccatttgggtttgggtggtcatatgcctggttcttttttgattaatacattttacctcgattgttattagcatattttttttgaactgttagatattgtatttaatacgaaaactttttatataaaaattgttttaaaatagtacattttttattttaaataattaaaacttaattagttatacttccttcgtactcatagaggaggtcattttagacagcgacacggtctccaaaacacaagtttaacttgttgtttctataaaaatatttattgaaaagtgatatatgtatatttttatgaaagtatttttcaagacaaatctattcatatattttttacattttcaaattcaacaacttgagagttattcatgatttgtattcctaaggtttaacttaaacattatcctaaacaacttcctttacgagtacggaaaaagtgcactaatagaattatggttttacatgtccaaccttaataatcttagtctacatccaaagcgtgtaaggcttttaacttttttttaaggatttaagctaattcgtacaataataatcccgtaaagtccctgtactccaaatgaccaaacaccataattggaacacaaaactgtttctctcctgtctttcgaagagaatgctttaaccagcaaacagcactaaccgcaaaactaccgcattaagcagcggggcccagctgtcacccgcacatccggggatcctgcggccgttctttccttttcggtttcatacgtggggtctgttggtggaggtgttgccagctcagccacccacccacccgtttttttcccaactcggttcctcctcccctcgcgcggctgcctgctagtacttctcccctcccccttctcgccgctctactcaattccgccgtcaaagtcttcgattgatccgatctctcgtctcgtctcgtcctccccatcggaaccctagccgcctcccgtgcccgcgcccgcgccgccacatggagccgaagccaa

SEQ ID NO: 53642 - DNA, 1291 bp, Oryza sativa
acgacgcggagcagcaggacgccgcctgcagctcgtagcgcatccccgacgacggcgcgccttcctgtgacgacaccgccgccgtgtcaggccacaggatgtccgcttcttggaactcttccatggcggcctggccggccagcgctcgttcccggttaacctggagcccttttcagctgtgaccgcggcgagccggcgggcattcttatactattcgtcttcgacgctcttgctagcggcattgcttgggacccgaagtgacgtagggggcactcttccccccggtgctgattttggaatcttggcgaggtagcaacccatgtggggttacttgctggagcaccttaatgtgagagcttgagcttgcctaagttacagctaattcattacctaaaataaaagttacagctaattaagaggccggcaccggtctgattatctgtggctgtaaaatcaagtcctaaatcgtcttagatatgatgaacatttcttggtcatgctcccacctatctagaacgtgagccgttcgatgatacaaccatctgtttagtactgccgtatgtctggataggttgttgggtgaaaatttcggttcccaagaactgcttttagagcggcggggggaagtcagtgtggcataggtgagcccaaacaaactcaaatattcctagtatctgttgcaaaatttctaccacagaatcctttcggaaattaaaattttaatggtgtagtgtattcgatgatgagtccgggctgctgcccgttgtagctgggcggtggctccgtgctgggtgcaaccgaagtttgcagctgagtgacaaggtagtgtctcctggccgaaggttgagcccacaataattgggcctgtattccggcactcgtggaaatccgtgggcttgtggcctacgagttgtaacctcttcttgtccctacatacatatatgggccatattttgctggcctaattgccggcccgcacgtcatggttctcccctgaattatgtcatgattcctgcttgcggcatgattcccccagcggaacagcatgaagcaaaacggctcaaaacctgccgactcaaaattcacggcgctcacgtcacgagttccgacggtcgacggatagcacagtcatcacagagttcgtcaacagtctcaaacaaaatgctcgttaacaacagcggattgggccaaaatcgccggtcaccaaccgagccaaccaagcacatgcaacgctgtatccccagcactccagcagcgtttctcatcgatcggttagcgcgctacactaaat

SEQ ID NO: 53643 - DNA, 1501 bp, Oryza sativa
cttcctactgtaaggtatatatgcacatatcctccatgtgaagaaagagctattagattctactttctctaacatcaggtagaacaaggaatccttatcgtaaaaagaatgaaagtaaaaaaaaagaacgaaagtaacagtcaaatttggattgcatggctagaatttcatgtgctaggaagaatatgtatgattgtaccagaaacttgtgtacatggcctaaaagataagctgccacatactacctccgtcccgaaataagttaatctagtacgggatgtgcatgtccagatttgtagtactagaaaatgccatatcccatactagattaacttattttgggacggatgtagtatgcttatgactcgtaagctgtttttggcatggccaaattaagattaaataaacatcaacttgggaacaaccactactggaagtttgaaataaatccatgacctcgccctgtggatatgtatcgaagaattgtggaactaatattaatatacaatcagttttctttttcttttaaagaaggttctctacaggatccaactagctacccaccaaaatatacacactagtattcaagattagtcatcaagcctcaagtaaaaaaaaaaggtaccaagcttagttgaagaaaaaagtcccctcgtactgagaatactttagtaccaactatattagctttagaaactacttctgaaacgttcttaataacatgtcccgtttctctttctcaaaaactagatttttgggcaaccttagttgaagtttttctgaatttgtaggttcaccaatgaaaacatagatgaaatttaatcttagacaagcattttttattagaataaagggttaattggtccatactattgcaaatatgcctgattggaaatctactattactattcatgataccgactgagtgccgttccgtctagttttttatcggcacccatccaagtcacccttctccatagatacttatcatttaagcgtctaaaatctgaatactataacatgcacttcagtttcatatatagcatatgaaaaaaagaataacaaatgtcatgcttaacacaatgcgatgataaaagtatgtcatgtaaacataaatctaaataaaaggtacaaactacataaccacaacctacattattctcaaatacagaaagattatacatccaaagataggagccaagtaattagaaaattgcatttgatttctaggtttcctccataaaaccaaaacaatactagcagtaggaagcctttgtggggaaggaattttaagaaaacaaaagctctcgaaaaaaaaagctagcacaactcaaacaagatcccctacatgggagtatggcatgatattagcatccaactttggaaaaagtgattatgacaaccatcgttccctctttataagaagttgaatgcctagactcaatttttccaagtccacattgaacaaagtaataacatgttccagttccacaagagatgt

SEQ ID NO: 53644 - DNA, 1501 bp, Oryza sativa
gataataaaacatgattaatactttatgcgtaacttatttttttattttttttataatttttttaaataagatgaacagtcaaacgttagacacggaaatcaaggtttgtcttttttttttgacggagggagtaattgtttggtacagtactagcaggaagcaatgggcgacattactttcagtgctattcgttttcttttatgccatttgctttgtcatggagttggtcttgagggagatcttaaggagtagggacaaggaccatttttctggttgtttgttggctgagtagaagctgggtagctcagcatgtgggctctctgtcccttttacctgacttgggggcggtgtgctcagatccaagggaatcatgtatccatgtggcattgtggcctcgactcctcgtggtgttccccttcctccagggcaagctttgtctttactcttcacctttctcttgcgtacccccactcctggaatgtggaattttgtaactttccacaagtaaaaatgtactcacgttcagttaacaatgtttttacttgctccgtttcacgatttttgtcgtcttatatatatatttagaattcatataagaaaacgatagtgatagtttttgtcatgataaacactttatataattatatttctaatagttcttttataaacatatagttagaaaatacaataataaaatatgtgcagagactgtatcaatgactcgatgtccaaaatgatcaatgtaaagcagaatttatgataattaaggtattattacagtttatagtgtttttcgcttgtttcggttagccttcaacttataagcataagtacaagtttagattttaaaatttaaattttgatttatgcttttttttcttgcagttttgttagtgtcaacaataaggcatacttcttatacactggttcgttaaatacagcaataccatatacccgatagtatacaagaatgtatcttttaattaaggaaatatggtagataaaaaaaagaaaattatcttctcgtaatagatggtgtcagagtcctacttgggagtgataaggtctccttaagcccatgtcatgtttcatttctccgagtcttatttggagaagaacgtgatctctattacatataaatgacctcacccgtccagaaagggacatcgagttacaactcatagccaaagccacatatagaagcaatccgctatattcaccagatagattttgtcgagccgttctcaacaagttctagttggcatattagtttagtcgtcctattccctattgtaatctgtgtggtattactatccatatatacatacatacatacaaataggagtagagttattacttaacttgaaggctcgaaccaatataaatccttgtccattgttccttagatccgatctcgcatataccctagttctaacgatctccatactctacaaatagcgtttacaggtatagcccgtcgacattttctttgaatattta

SEQ ID NO: 53645 - DNA, 205 bp, Oryza sativa
gcatgtagcggcggaggcggaaggtcggcggcgctcctctcccctcgcggatccggctgcgtcgtggggaaggtgggccggcagcgaccgcatgcagtggctgaggcggcgtggaggcaggaggtcatcgtaggcggtggcggcgctcccactcccagattcggacggcgacttccctcccctcccctctcctcctggatccagc

SEQ ID NO: 53646 - DNA, 151 bp, Oryza sativa
agctccttctactactccaccactgaccactccactccacagctccactccaccttctagaacaatctcagaggctctcccactccgcatagtcttcccatagcaaccccaagaccatcgcacaagcgcaaccgagccgtgccggaaacaa

SEQ ID NO: 53647 - DNA, 1501 bp, Oryza sativa
cctccggagccaatgaccaccaatctctcgacctccgaatcatcatccaagactcctctcgctggctatagcgctgctctccaacggattagctgacatgagaagactctttttctgctttgcaggtcagatttgatttgtttttcttgctgcttgtaggtttgcagctcgaacatctgcactgaatcttctttttcgttggcctctagttctcgaatagtttttctgcttgtctactcaagttctgtagttcttggtcataatttttcctcctagaagaagggattcaagttgaatgccagtaaactgaatccggagcaagtgagcttgttcagaatggctgagcatgacaaggtggacaagctaatgatcactacgtcaatgaacgcttgagagattcctggtgtgctatgtcctgtaattcctatgaattcattatctcaagatggctttgggtggctttggcttgttactgatggccatgttttttttttcaaaactatagcttattaacagcttgtggttttgaaagtgcctatctgtgtatatcatcgtttttgtacgtggttcaatgtatattacttgttgtaattgcaattgtaaagtctacgtaaaaaaacataccggattattcttccgttgccttgtatctgtcattgctggattggagtgtttcgatttgtccatcgtgtgtaatattcagatatataactaatatatttaaattttacatgaaacaatcaagctgaatggaaaccaaatacctacagcaagaaacatctatggaacgcgatgcacaagcgccggcggtggccggacctcgcgatctgcttttctttttctttccctgcgctctcctttttgatggagagcgactctgctgttcgatggagagggatcgagcgacgcttgaccataggacgcacaaatgagaaaaaaattaagtgccagatttacccctattcggttttagcactttactaatttaccctttaaaataaacggtcgagattaattctacttggagtagaatactgcaagtagagggcaccggagcgtctctctaatgaatcagttttcaccaaatcgtttcatccatcatctttttagcatatgtgggttactatagcacttatggctaattatagactaattaggttcaaaagattcgtcttgttatttctcttctaactgtacaattagtttttctttttatttatatttaatacttcatgtatgtgtcaaaagattcaacgtgatgcctttatagaaattttggaaaaggtaaacttggaaaaggttcctgatctccttttcacgcagccgcatcagcaaaaagccaaaaaaaacaaaaagctagctgctcaccctgacaagcccatcactcgaccagccccgccagcttgagctcgctcacttctgctcccaagctacagatcgctcgctgtctcgctcaagcgcgacctaccacagcatcggatcgaagcgagcggcggcggaa

SEQ ID NO: 53648 - DNA, 311 bp, Oryza sativa
ctaagtaccataagtccaactcgtttacccgatccggcctttttttattttacatgaacagaaagtcctttttgactccctcaactatcagctgaatctaacccgtatatctcaaccgcaaaaccggttatatctcgcgtcccctaagtattaaaaccagtacaaaacaacttactcagtgcttcgattgacgtgatgcattgacgctgaccaaaccggctagtctagggcacatagaactagagaaaacaaaagtaaatgttccacgcctaaaaggcgattgcatgtatacctcctcatgaaggttacca

SEQ ID NO: 53649 - DNA, 1501 bp, Oryza sativa
ttttgagtgttgctaacgccagatggtttttagaaaaaagtctagaagattttcgttcacgaaaataccatcaaggagtcacaccaaaataccagaaggatttaccatgtgagaaatttaccaaacaaattgcctgcagacattagcgaagcagagcgttgcgacagtgatgaacgctggctgagatctaccggaatagggcaacaacggcaatagtgctaaagtcagcgaaggatcgatgcgatacaagattgaaacgtaataaaaatcacgaatattttcctaataccaagtttacccctaatcgtagtactaacaaagtactaatatgcccttggaaatcaacggtttggattatttctagttgtagtatatactacaagtagaaagcaccggagcgtcgcccataggagtaaccactaaaggcacattttctccctgcaaagcaaaagtgggcttctttacctatcctgttgggaggttgacacaaagcaagaaaagattattcgattcacagtacacataacaaagccgggagctagaagtttcattccgaaataagcaagatctgttactaaagtctttaatgacctcaagaatgttccatactagcaactggcaccctcattttctctctctatgtcagttcaattagactgaaagtctgaaagtaacacgtcaaggtgaagaagaatgagccaacaagaatgtgaaggtatgcactaaacacctgaaatagctccgttcttggtaattattgctgtctaaagaacagctcaaaatgtacagcggcactaatcaccacccagcaaaggaaaagctccccggatgaacgctcttagcatctagctacaggaaaccgaaatcaagcagcaccgacagcacagatcggcgaatcttgaggagaggaggggtaaaggcgggtcacctcacctgagtggattgccctggttgaatccgaagctagagttgacgatcatggcgacccagaaggccgcgaagagcaccaggaaggccaaatcccggcaccgccggttgtgccgaatgatgccgcctccatctccgccgccgccgccacctcccagctcatcctccccgccgccgcccgccgccgccgggtgcctgcctatgatggcgccgagcggccctcccattccgccgccgctcgcttcgatccgatgctgtggtaggtcgcgcttgagcgagacagcgagcgatctgtagcttgggagcagaagtgagcgagctcaagctggcggggctggtcgagtgatgggcttgtcagggtgagcagctagctttttgttttttttggctttttgctgatgcggctgcgtgaaaaggagatcaggaaccttttccaagtttaccttttccaaaatttctataaaggcatcacgttgaatcttttgacacatacatgaagtattaaatataaataaaaagaaaaactaattgtacagttagaagagaaataacaagacgaatcttttgaacctaa

SEQ ID NO: 53650 - DNA, 264 bp, Oryza sativa
gagctcacgtgtctttttttttctttctggtttttaatatatatatatatatatatatatatattaccaccaataataataattgggacaccatggtgcccaggctccaaaatcatccaccgttcatctgctttacaatttgtgctaggcaaaaccgggtatcagtgaaaattaacgggttcaatgcgttataaagagattcaaataactttataaatatatataactttatatacgtacgtataccaactttatattcgatgt

SEQ ID NO: 53651 - DNA, 152 bp, Oryza sativa
atttacatctccagtgagtaaaatcgttggtttctgtctgttctattattacctaaattattctgtacaatatgatactgttcatgacaatggcttgacatctttgacagaacgaccacatagggggttatcttctatcccaacgctggaca

SEQ ID NO: 53652 - DNA, 322 bp, Oryza sativa
tagttgtatttttgttgatttaattttgagtagataatttggaatgcgatacatgctatgatctatgatttggtattttgctactttttacggaatttgtagcctgctagatgttcttacaaagatatgagaatcatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttgg

SEQ ID NO: 53653 - DNA, 1501 bp, Oryza sativa
catctaccaatattgtattgtacggtatgtgccaaaatcaacaccgaactacgtaagtgctatttcaaggttagtataaaaaaattggaacgtgcatacaaatgtaagcaaactactattcaaagccatggaagcgttgttatcacgacgatcaaccgattgaatatttctgatgtgccatgccgattcattgttgttctcgtgaaggaaggttaacggaagcaatagtactttaaattttgaaaaactgtcttcacatcacatcttttgttacactgtaaaagttttatcgttagtgtggtttatgatgtcacaagttagtggtcggctgataattggcaaggctgtgctaatcatccggtgatctgataatgaacacgctctggtggctttagtgcttgtgatatgcgtccatcattatttatttcataagagcatgcaaggacccactctgattaagtggtaagccctgtagttggcatgaaaaaatgctgctaatattgatgtatgcacaatatagtaaggtgggatgactcggcagtgtgatcttttgggtcagcagctgctgtccgatttgtccacttgatcccgtgctattcttacctaatcctggattggattggcacaagctgctgctgctgcatttgatgttctactgaatttgtttgttttcccatcaacttactcgctgctgctagttgctgctggattgttttgagcagagcggcttcaccttcacatcgctatcgcagccggccacagcttcttcacactactggttacttactgcgcgataatacggaatttactccagcttttgtcactaccgcgtgacataattactttggaagtgacagtaatatcctttaatttgcacttgcagcataagcgtactttgtaggtggcgacaacaaagcgtgggctttaattgtgccgatgtcatgatccatttcaggtcaggttaccccagcttttgtcaatactttgccaaataacaggaagtctggaacttgattattccaacttgatgcgtttttgttccggtgcttacagcacaaatgcgcataatatggtgggtcgactttcttcctttctacgtttaaaaactgttatggttggacgcagaagctagctgaaagcaatttctggcagctacaacaacaaaatcttgcaacaactagttgtgcttggtctaactaatacgtagttcacacagtggtactacttgctatcccttgaaatttagaacaataaaagctcatgtcatagctaactgttaaatagaagctgtttctgatacaaccacatatattactatggtaatacaacttatattacagtatgcgccatataggggcttctttgaaacaaaggatatttggagattttgaatccggtggaaatagtccctatgcatatctttggaacaaatgagtggtcatctcaaaaccatataaattcttatgaattgcctcaattcattagaattttggagggtttc

SEQ ID NO: 53654 - DNA, 1501 bp, Oryza sativa
acatcaaatgcagcagcagcagcttgtgccaatccaatccaggattaggtaagaatagcacgggatcaagtggacaaatcggacagcagctgctgacccaaaagatcacactgccgagtcatcccaccttactatattgtgcatacatcaatattagcagcattttttcatgccaactacagggcttaccacttaatcagagtgggtccttgcatgctcttatgaaataaataatgatggacgcatatcacaagcactaaagccaccagagcgtgttcattatcagatcaccggatgattagcacagccttgccaattatcagccgaccactaacttgtgacatcataaaccacactaacgataaaacttttacagtgtaacaaaagatgtgatgtgaagacagtttttcaaaatttaaagtactattgcttccgttaaccttccttcacgagaacaacaatgaatcggcatggcacatcagaaatattcaatcggttgatcgtcgtgataacaacgcttccatggctttgaatagtagtttgcttacatttgtatgcacgttccaatttttttatactaaccttgaaatagcacttacgtagttcggtgttgattttggcacataccgtacaatacaatattggtagatgacgactggcaaagcatttcaatacaacagcaacaggttcgcaacaataataatgccaccgtgctactgctcatgtggacactttctagatgaacaagtaagcaagagttgctacacatgaggttgtataccagaaatgaaaattcccaatttgatgtaaccagaagacctatgaaatagcttaaatggacaagatagagatctatcagtcccaacagtacgcagattccagtttatgtaattgcttaaaaaaattcaacagggtgttagactgttagttcacctaaggcattctgctaaactgctgccaaacataataaaagtgtccattcgtctcgagcaaactagcatggcttccccagactagcgaacatcaagaacacaggtaaataatactagggagcatgttcatgtacagagaaaaccagacataccaatttatagctttcagatcttagagaacattttgaaacagggaaaagatgcatgaaaattgaaaaggctcacaaaatcagaactctcataactttcttatttcagatcactcaccagctcagtagataccagaaagtaaccatttaagaacaataaaacagaaacagtgaagaagttataacatagactcgcacaaaaccaccaaattttacaagatgtatttagctcaatatcattaacaccaaactgtggtttagtagaatctgaatatctgatgatattcaggaagatgtgacatgcccatagatctgccaaattttcagggatcatatccaaatacatcttgtaaaatttcatattcagtgaaaggcttatagcatggcacagcaacttggttaggcattggagaaatagca

SEQ ID NO: 53655 - DNA, 397 bp, Oryza sativa
attccgtaatttgtattgttattagtctatgttttaatacttcaaatgtgtgtccgtatatccgatgtgacacgtcaaaactttacacctctggatctaaacacagccttaatgtcttgaaacatgggagttcataaaaggtggatggtgatttatggtgcgaaggatctctagactaactccttgtttagtttctaactttttcttcaaactttcaacttttccatcacatcaaaactttcctacacatataaacttttaacttttttcttcaagcttctaattttagtcaaactttcaattttgacgtggaaacacaccctaaggcgatagctgtttggtgtggttctggatagagcagcacaacttgaatgactccaatcttcctggaaacaga

SEQ ID NO: 53656 - DNA, 1422 bp, Oryza sativa
ttgggtttgtaatagtattatcgctgaatttgtaaccttacatatgtatttatgtgacaaatttaatgctaaactagaaaaaatgcccgtgcgttgcaacgggtgaatgctattttaatcttattattgttatacggtttagttaggataaaatttattttagaaattcacttgatattttttttagaaaatcatgatatgcaattaggagtctgattttcatctcaagttagcacgtgagtttttttaaaaatatttcttataagactcttttgtattttccaaaacaaacgaacttaaaatccgactcaaacacggatctgtatttccaaaagcaaataaatttaaaactgactcaaatacagatgatgtactaaaatgccggaaaaaaacatctccaatttttttaatattagagataggtagtttccagtcattagcctttcggcttataagctgctaaaaaaatttaaatattaaagtcttaattttagagttaattcgacggttttttaactgtagtttatattccagcattgtcttaaaccgtaaataatacaaatataaaagttttatttatgaattattattttttcttatatgacattttatgagttatcagtcgcagaccaaatgatttgtttcatggttttgtgatattatggatctaaatatattgttttatgataattttattaaaatatagttacgtagtttctaaaatttactcaattttttttcgatccatgcaaagatcttcggcatttttataagaaacggccgtgtttggtggtgggtgttgggaacccatcacccacgcacggaaaatagagcggtccattagtgcgtgattaattaagtattaactatttttttaaaaaaatagattaatatgattttttagcaactttcgtatataaactttttataaaataacacaaaagacagaggggagctgggaactcctgtatcgaacacatacacagccctagtagatgtgagggctgaggctctactccttgggaaaagtaacagggagtgtcgggcggaaatttgagtgaaaaaaaaaatacatgagtgacatgtagcaaaaaccaaaatgataaatcgaaggcccatgtgggtcttgatctatgaaggccggaaatgacagcccaacccactggagcaacataatgtgtcgtccccttgggccaattccataccctcatgtaagcccattcactatccttccaggctttccagcccaccgctccaccgatctcgtcctcccttttgcggcttgcgaatgtcaacacactgttttcccagtgccccggcggccagatctcctcatgccactcgtgctcttgcgcgacgcctccccgtcccgactccagaggaccaggttctcctggaagcagatgcgcggcgcggttcacc

SEQ ID NO: 53657 - DNA, 1501 bp, Oryza sativa
tcttccaaaggatcgtggaacaatctccaatgaagagttccggaggcaaatttgccaggttgatatcgatgtgttgcgtcacttgagagacaatgttaagggtggcttcaatgaagagaaatatggaccatacattgggttcagttgtctcaagaagtacctggaatctgaacttcagaagaggtacaaagaagcagctccagccaccctggcattgttagagcagagatgtagtgaagtctcaatggacctatccagattggactccaaactgcaagctacatctgatgtctctcagctgagaagatcagcgatgcttcatgctgctaatatctgcacgcatttggtatgcaaagaagacacatcctatacttaccgtttccattctaaaggttgttgctaatttttgtgctggaactaattgaaattttactttcttaccatagcgctcactacttgatggagcagctgatccagcaccagagctatgggggaaaactactgaagaggaacagatgcatagtggtataggcagctggcctggcattaacatgcctgtaaaaccacccaactccagtcttaaattatatggtggtgcagcttttgagagagtaatgcatgaattccgctgtgcaacatactcaatggagtgtccacaggtttcaagagagaaggtatgttttagattcaagcacatgtctacaaaattttatgtgaaagtttgcttaatttgtggtactgatatcatcaggttgcaaacatactacttgcacatgctggacgaggtgggagtagtgggttgactgaggcagcagctgagatagcacgtgcagctgcacgatcatggcttgctccccttatcgatacagcatgtgatcggcttgcatttgttctccaaagtctatttgaccttgcaatggagcgatgccgctatcaagactcaaaatgtacgatctggatgcctgtggggttcatctcacttcctacaattacatggttactattaatcttgaaactgattttgaccatcttttatgattaatagaaataatttgttcagtgtgatacgagcagacaaaagacttgactattagtagtttctgttggccaacacacactactggcaaaatatatattccaattcttttcacaccaatggtctgcaattaatttaactgcattcctcaactctgtgatgtgttttttgctattacttgtgatcacgttgtccatgcaaaatttatatggtcaatcattttcatgggtgtttactggggggttagtattttgttgatattaatatggatcacttgtgtatatgtttatctattcaagcttttgatatttagctaatatatcatcttttcatttttatgttgtaagaactctaagagtatctcattaatttcatcgtttgcatggagttatagctgagccttagcatattttagaagtcaattggagtccaccaatttgttcaatggttctcatacttattata

SEQ ID NO: 53658 - DNA, 1501 bp, Oryza sativa
gcaaagcagcgttgagtggtgctcatcactctggttggatgccatcagagatattgatcccactttcaggcgcacgatgatcgtcatctccaagtttgataaccgcctcaaggtattccttcagaacaatcaacatgtgtacatagggtttgattacgtcttctctgtgagctatgatttgtactggtgttgtggcttatgaaaatgcctctgtcttgaccaattgaaggaatttaccgaaagttgggaagtcgatagctacttaagcgcaagtggctaccttggggataatatacacccgttcttcgtggctcttccaaaggatcgtggaacaatctccaatgaagagttccggaggcaaatttgccaggttgatatcgatgtgttgcgtcacttgagagacaatgttaagggtggcttcaatgaagagaaatatggaccatacattgggttcagttgtctcaagaagtacctggaatctgaacttcagaagaggtacaaagaagcagctccagccaccctggcattgttagagcagagatgtagtgaagtctcaatggacctatccagattggactccaaactgcaagctacatctgatgtctctcagctgagaagatcagcgatgcttcatgctgctaatatctgcacgcatttggtatgcaaagaagacacatcctatacttaccgtttccattctaaaggttgttgctaatttttgtgctggaactaattgaaattttactttcttaccatagcgctcactacttgatggagcagctgatccagcaccagagctatgggggaaaactactgaagaggaacagatgcatagtggtataggcagctggcctggcattaacatgcctgtaaaaccacccaactccagtcttaaattatatggtggtgcagcttttgagagagtaatgcatgaattccgctgtgcaacatactcaatggagtgtccacaggtttcaagagagaaggtatgttttagattcaagcacatgtctacaaaattttatgtgaaagtttgcttaatttgtggtactgatatcatcaggttgcaaacatactacttgcacatgctggacgaggtgggagtagtgggttgactgaggcagcagctgagatagcacgtgcagctgcacgatcatggcttgctccccttatcgatacagcatgtgatcggcttgcatttgttctccaaagtctatttgaccttgcaatggagcgatgccgctatcaagactcaaaatgtacgatctggatgcctgtggggttcatctcacttcctacaattacatggttactattaatcttgaaactgattttgaccatcttttatgattaatagaaataatttgttcagtgtgatacgagcagacaaaagacttgactattagtagtttctgttggccaacacacactactggcaaaatatatattccaattcttttcacaccaatggtctgcaattaatttaactgcattcctcaac

SEQ ID NO: 53659 - DNA, 1501 bp, Oryza sativa
tccatctccctcaccaccctttcggcgtcgtccctcctccccgatctccacagctcctccaccaccgccctcctcgtgacgtcgtcgaccacccttcccgcccgagccatgtcccacatcacacgctccgcctccccagcctcccctgccatggccagcgcactgacgaacgtgttgcacgccggctccgtaggggccagccccttggccagcatttcatcgaacacctcacgggcgttcctcgtccggccctgctcgctcagcccgtgcaccaggtagctgtacgtgagggcgtccggttcgcaaccgtagacgggccgcatctggtggaacacgcgcagcgcgtcgttgaggtgcagcgactgcgcgtagcccttgacgagcacgttgagcgcgcgcgtgtccggcgggacaccctcctccagcatctgccggaacagagcggagacggtgtccatgtacatgtagtgcaccatggtgtcgccgccgccgcgggacaagagcgcggtgaagagcgcgtggtaggtgtcggcggaggggcgcgcggcggggtcggcggaggcgcgcatgagggtgtagacgtggaacgccttgccgatcttgcggaactggcagtagaagtagagcgcggtgcggaggaagggcccgggggacgggagagaggggaggagggagaaggcgagggcgcaggtgcggtcgaaatcggcgtagagatcggcggcggcgaggcgcttgatcgcgacgaggaaggggcccgggtcagggcggaaggtggcgagacgaagggagtgggtgaggaccggaaggagtaggcgggcgtcggagacggaggagagggagtaggagaggagaggcggggtgagacgggacgggagggtggcgatggccgcggagacggcttcaggggagggcggcgcagggttcggggagcggcggctgcggcggaagcggtgcggcgtgcggcgggaggaggtggagaaggggaggcggccggtgagcaacgcgtcggccggggtggcgcccaagaggaggcggcgcaggagcgtggtcatcgcggcggcggcggcgggcgcatttcggcgccggtgcccttcgccttctcaaaatctgatggaaatccgcgcgcgaatcttgaagcaaatctgacggttcgtgcctcctgagtctattgccaccaacgaaccgaacccggttaagctcaaagccgacgcccgccgggcagaggcaaaggggagaacgagcaggcgacgacggcgcccagccccatcggttcctggtaaggatggccgccgccgtctcgttggcgagccctttccggcgagtccttcacgtccctttcgcacgccgcgctatccccacatcgtaccacttcttccctagcggtaagccccgtacccaccgctcggttcgattccggttaggtccgacgattctgacgcttggctacccatggctcgttgtggtgcaggacggtgtcacgcggctctctccttcgccgcgg

SEQ ID NO: 53660 - DNA, 1501 bp, Oryza sativa
tgagatcagatgtcaagcaaaccttggtggttcatattctagagcaagcaaaggattctgtgtgcatgaaactccaactttctccacctgttgaatcaaacacaattcagagtaagctgcatttgcaagggtttgaaataacaacaaaaatacagcagtcaaagttcatgggcagagttagatcaatacaagactaacatgtaactaatctagagagttattctacgatgcaaataacctcaaaaatattggaacatgtgctgctattttaaatgtgctatgagtaaaaaaaaataataaaaaacacagtagcttcagagcttctgttgtctgcatagcatgtaatcaacataagtgaaaacatgtggggtaagataatgttataacttctgtagttctgtgtcatatataggtaagaaattatataacatatataaactcaccttttcaagtgtggaagtcagatagtcaacaagttcaggatcaacaaggacctgagcacctctctctccctgacaaaaaaaaaaaagatcacaaagaggcacctcagacggacaaaagtcaaagttcacaacacaatccagaaattaagcgattgggaaggcatgtgcacctgcaaaagtatatctccaactttatcccttgttattcctgtcccaagaatagcaccaagaaagtcaccatgagaacagggttccaatctgaaattccctgagatgctgagaaggcctcaaagttagcttatataaaagatggaactgcttatagtgcaaatttgagagaacctcaaagcagcaactacatctgggttgcttgtcatacagtccggatgtccaactgaaactcggcatcgctcagcctagataaatgaacaggtgagagtgggacagattaggtaatggaagctaataaaacaatttcctttgatgttactcaaattcacctgtgggtagcccccctgtgctaccgctttgatgtctgctaacttctcaattgccagcatgcactccttcactataggtggagtaagaaaattggtgtggaaaacatctctccgttgggaagccctttgtgcctgcataagttggataccatcataaattcatgaagttcaaggcaccatatcaacatgaaatactgcacttacaacttgaaacattcttattttgtggttagttacaaaagcaaactagttcaatgttgttgaaaggttatgtttgcaatcagcaaaacaatagtgagtgaatctgtctgatgtggcaaactactaatcatatcttgtttaaatgtcccttagctgtttttggctggtgtgttattagggatgctttgaatctggtttctttacctaataatctatgggagtgtatgagtctgctcaaagataggaaaaagtttaaaccttggatctctttaattgggggggtttgttgggctatttggatcattagaaacgactgggtgtttgaaaatattcttgtcaagtctcccctttatgtgg

SEQ ID NO: 53661 - DNA, 1501 bp, Oryza sativa
ctgtatagtttgttgtcctggagctgttggctgaactggcggtacaacctattgccttagtggagtctgttgaatcgaattgacagtagattggaggggcggaaacatagcagccacctgatcctgtgctggccgatttaccgtctgcccgctatgctgtggctactccctcatcaatagccgaggattaatcggctgacctggtgtcgacgctgatggagcaggcaaagaagtcaatggcgatgccatcggctgagccgatagtgcacctggaagaactgcctgagcaagcggctgaacatcagtaatcaaagatcgataattcggaaaaacacctctcggcaagtagaccgggcctgcagcttgatgctcggctattgacccatcggctatcgtcttcatcatgttagacaaggtgttgactaacactccagattgattgatcaaaccgttgtgtacggcgtagtccactcgatcttggaaattgttgaagaaatcttgttgaagaaatcttgtgctgtctcaccattctgattaagatttcctccttgtggctcataagcaccatcaccttgaactgcatgtaccccctgagagccgtcaccctgattctcttgagccgagccatctaaaactcttttttcttctccttccttagagatactggtctccggctcatcgggaatcacctttaccttgtacttttgaacaaatgttccattgcgagtctgtgtgaatgacctgaagaactgttctcgtgcttgttgcatcattgcttcgaaatccttcttctggtcaggtgtgagcttttccggatcaacagccacaatattcccttcattgactttgttaaatcctaacctttggattgtctctttaacagtacccggactagccgaggatggcgacggtggtagcttctcggtcatgaggaagattgatttctgacttctaatttgtcccactgggcgtgccaaaagcgtgttgacagaaaacacgagacctgggagatctgcttaactccagtgcaggtccaaaactcgccttcgggtgtatgagcgtgccagttgatttgatcctgcaatcaacaagaaatagaacaaagaaaccgcaattaatcctataaatgatagccgatcggctaggtgccgatgacatatcatttatttcaagccgatgtcatgcgtacatcgatcgacaaatatcaataagcaaatcagaactaaatctactcgatcggctatagatattaatgatatataatccttatatcgatatatacttaaatcaagtgattgggatggatcggtcgccttgccgagacagtataaatcacttaaatcgaaatatatattaatagtgggattagatacatttatatcatagccgatcaaatggatctagcatgtatcggctaatactccgataccactctatattaagatgttaaagcaagtagaatataccaaacataagtctaatatacctagatgcgacaaga

SEQ ID NO: 53662 - DNA, 643 bp, Oryza sativa
gtaagtttcctgaggcttccccagcaatgcagaactgagagtaagttaaacctcttgtctttataaattatccagtctcagatatttcttcatagcagcgtgagaactgatgaatacagtacattggtcccgaggcagtaaggccccgctatagggacacccaaaaatgtggaagcaactttgtaactggtcaacaggcagaggttgctacagattggagggctcagaagaagacaggaagatgtgggaaagttggaaactcctagagacttgttggttttgcccaaaatgctgatagtaatatgggcaattaagtccaggctgatgtagtctcagatggagatgagaggcctatatggacctagataaaagggccccctcgaccccgggggaggcaaaatagacttctgcggagggatttgatttggaaggatttggattcggaattggactcgacgatagatcggggattgagatttgagatggcacggacactagacagcaagcaaagaaacaaatttcgcaattagggtttttaagagataattttcccgctaggcgccacgacggaacgggcgctacacatatctctaaggaaattacacaaaatatcctaattaatagatacaattgcctttccagg

SEQ ID NO: 53663 - DNA, 223 bp, Oryza sativa
gaaggtgtgtggtgttcaggactggcgcgatcctttgtcacattgcacttccccgttgcatggactgattgttcactatgttcagtatgaggtgttgatcccttcttcatgtcccagcataagagccccaatagggccatgcatccagaggttgcccatcattaacctttggctgaagggtatgagaatgtatgcatttaagtcactcatgctccagtgaaca

SEQ ID NO: 53664 - DNA, 1501 bp, Oryza sativa
atccaagatgaagatcgttgcggaaacagagtaagaatcgactgtagtccaaatcggctaaggtcaggttggcagagttcgagtcgggcggggctagccgatacagccgattccgataatatgactcggcgtatgtcgtcgggttcaagttgatgtgcttcaaagatgactgccacgcatggatagagtcctaggaaggcaattgtatctattaattaggatattttgtgtaattttcttagagatatgtttgggcaaaagtctgccgtaaagacttatggtatcttagagtttgttagagataatagtcgtgtccgttatggacgtatcttgtaattctcgggtataagtagacccgagccctatgcaaaaaaaggactcatccaatacaatctcggcgcatcgccaccctttttgctttacttttatttcgacgagttcgtgctctcgggttgagctgcatcggtttcgatcttcaacaagaggtaaaacttgtcatgacgatttatgttatcaggattagtgcttccatccttatgatactctaatcttgtctatataattcgtcgagttatcatatatctcacataatcttcgataatatctctatctaacctataaccggctaacatctgttaatggaaggcagccgattaggttagacaatgatgttaacttagattatgtgatatatctaccactctatgaaacttccagcggcttgattgtctagatattgttcttcttttcatacttaatgctgcatcagttgagtttgatctattaagtcgtgcttagatttgcaatctctagcctgctttctggttgccgattaggtagtatcggagtttcagccgatcttatctgatttaactacttttattctatatgcttgatctatgtgttaaatctgccttttatgttaggatcttgtcgcatctaggtatattagacttatgtttggtatattctacttgctttaacatcttaatatagagtggtatcggagtattagccgatacatgctagatccatttgatcggctatgatataaatgtatctaatcccactattaatatatatttcgatttaagtgatttatactgtctcggcaaggcgaccgatccatcccaatcacttgatttaagtatatatcgatataaggattatatatcattaatatctatagccgatcgagtagatttagttctgatttgcttattgatatttgtcgatcgatgtacgcatgacatcggcttgaaataaatgatatgtcatcggcacctagccgatcggctatcatttataggattaattgcggtttctttgttctatttcttgttgattgcaggatcaaatcaactggcacgctcatacacccgaaggcgagttttggacctgcactggagttaagcagatctcccaggtctcgtgttttctgtcaacacgcttttggcacgcccagtgggacaaattagaagtcagaaatcaatcttcctca

SEQ ID NO: 53665 - DNA, 1501 bp, Oryza sativa
tacagaaactatccgctccgtttttatcccactgtaaagtatggggtcgcgtcaacgagatactacttggctctaaagaagcaatagagttacagtcatttgaaagagctaccgagggacaggcgaataatttgaaagagaatatacatatttcaactttgaataccaacgatacaacatgtagtatatgtaagaaataccatggcctgctcacaagacctagtctaagtcaacactatactatgcatagaggtcaccccatcattatctatcagtatgtgatgtaaagtactaatcagatatactcccattgtttcatgttgtaagatgttttttttatcaaatatagtaatatttatattaccaaattagttttatttaattaatagttaaatatatttttataataaacttaccatgattcgaaaatattactatttttcctataaacttgaaacagtttgtctttaactaaagtcaaaacatcttataacctgaaacggagggagtatattactatctccatatcattttaagtgtagttgtaggttttggtgtccaacgtttaaccgtccatcttatttcaaaaatttatgaaaaaataaaaaaaatagtcatgtactattcatgttttatcatatagtaataacaataaaaatactaatcataaatttctcaaataaacctgtagttttcaaataaaacggatgatgaaacgttagatataaacctgtaaaactatagtctttttgaaagaggggtagtactaatagtatgtttatgcaacatttgtagttttgtactaccaacttgcctcctgcactagcctagctcacccatcccatcctcgagccaacgcaacaatctctgttagtgaaggccgaaagacagggacacctttcttgtattcctccgaaacctttacttgctcttgcaaaagaaaaagaaaaagacattttattttccatgtaccttcaccgtaattaacgtgtaccactacatgcatgcagtgacgacagtcagtagcgtgctccacgaactgcacccacacgattggtcgattcatttgaccagaacgggcaacccatcggccgcgaacaggtaaccaaatccagccatattaattaaatctcgctcttaattgcgaagcttactccattgaccgtggttaatgatccagtcttcaccaaaccgtttcatccattctcttttctggatttaaatctaagcgaaatcttttgaaacaccatcaaatcttggacaaaaatttgtgcgaaatctgtgaagttggtaaagtttccaggtctcctgctcccactctccttttcacgcagccgcagcagcaaaaagccaaaaaaaaaaaagaaaagctagctgcacacactgacaagctcatcactccaccagccagcttgagctcgcccacttccgctcacaagaagcacaaccgcgagctaccacagcatcggatcgagggcgagcggcggcggaggcggcggaa

SEQ ID NO: 53666 - DNA, 1501 bp, Oryza sativa; identical to SEQ ID NO: 53647

SEQ ID NO: 53667 - DNA, 932 bp, Oryza sativa
agggcctaagtgtgacatacaagtgcaacaagattttatacacataagtacataacacacttatacaagatttttccctgggggagaaaatgcaaccaaattttataaaacagagcataagacattagataaggacagcaataaaattaagctgacatttcatacttgacataagctcttcaaatttctaaaaacttaaaaacaaaatatctgtaatgcatgaagggcagtagtacatactctttaatgcatccagaacgagaaacgggctgagctccttcaaggaagtgaagctcatcctacaaaaggagctttgtgttagaccaatattgttctctcatgtgctagatgcaaacccatgaatttcctccttgagctagaaacaaacccacaaaagtttttctacctgttgaagtaaaatagactatgcacttaacatgagagaaatgacaaaagaaaattttgataattcagtactgcaggctgagtgaccatgcaccacaatggaaaataaaaactaaacttttgaatggagctggattctttcatgttaaaagacacagttgcagaaataaaaagtaaataaaggttgttacttgtaccacatctgcagttaaaacttaaaacccattaatcaaagcctggagtaattgaccagtacgaacggtcccataaaggttcctgctttactgtgtaagtgtcctttgatgttgcacaaaagcgagatcgggtaccaaagcagggactgaccttgcaagaaacgataaaaagatgtctaaagcgcatttgattactactacaaagaagttctctgatatctgaagagcttctgaaatctctgctccttaaaagcacagcacagtgtcaagaacaacacattcttccctccctcgttaaacacaaaatctagcaacatcaaaagcctcaaacca

SEQ ID NO: 53668 - DNA, 1501 bp, Oryza sativa
gcattgagaagaggatgatgtcattttaccaaagcagctttcacgagcggaatcaaatagcttcaacttgcgtctgaggcattctagtataaaccgcacccactcaacagcagatacaacaagtgaacctatagcaactgaaccaaggctgtaacgcaacaaccgcttcaatgaagaaacaactgtaacaaatggtatgtcatgctgcataggaatagctcaaatagtcagtggaaaggagaagtaaactaactgctaaatatagagtaaattttttaagtgcctcaattcacttacggatatttcaccacgtgcccaatagtatgaagcaactgatccagcaatcacggttgaagagcacgcaataaagaattgggttgcccagtaacagccaaataagtggaaaagaatggcaataccaatatgaggggtgtaatggatgctgtacccacagcagttgtcacagtttactttgcccaacttcagatcatatgagcaacaatctgtattgcagtcatttcggagaacttgaccagagctgaagagatggagtgtggcagaaaaccagaacatataaaagatagcgaggataaagtatggcacaactgggaaaataattagtgcctgaacttcaccaatgaccttcgcagcaacctgaagataataatttatcaggttagtgcttaggaactattaactatattcttgccttcaaagaggaggaatggcattgatgctgagtgtcttcaaaaccaagcttctgcttatacagtgtataatagttagctaatcaagcttgtacatccaatgattcacgtaccttcaggacaggtgttgctatcagtatacgacggataatagctatggaggtcagaaatgcaataatcattactactgtcatcaccactgtagcagcatgaaggtggcttatttcctagtaaaagaatgaacaatcaggcaacatgaagctggatattgtaaaaagtcaaaaaattggatatactcacccgcccagttatgtggacatatggatcactttcgccaattacaactgttaagggatcattgcctaaccagccagctgaattaaaatgtagccaattaggatcgtatgtgtgtaacatgttaaatggcatacaatggaatttcccttgctatattttggaattatgacatgcaaaagtgaaccatacctttaatataaaaaaacatggtaacagagattactagagcattgaaaaccactacagttatccatggcgtggcaacaacaaaataacgaatcagaagcaaccagataactgacaagaaaagagggagcagtccaccgcaaacaattaacacaggccatgacttcccaatgtcagcaacgtatctctgcagacgaaggaaatggtaattaatatcttcaaagacaaaatgggactccagtgctatatagatcatgttgcatcaggaatttctcaaaatacttcaaaaggaatatccatttcagttgcta

SEQ ID NO: 53669 - DNA, 381 bp, Oryza sativa
aataggtgtccagatttatcgttagaattggacttttttttttggacggagaggtatctgtcactactctcaaataagcatacaattcaattatcatatgtctttcatgaatttattctgttacttttcgtccatttggcatatattcttggtactccacaagtatagtggcaaatatgcttcacataccaattgacaaacctatgttgaaaatgttcctggaatgttactttcgattataactttatatagtgtgaccgttgtagagaaggtgcttcatttcaattatagcagacaaagtagaaaaaaggaaagtcacgggtggggggggggggtcctataatcagatcatttgagtgacctttaacttattctggcagc

SEQ ID NO: 53670 - DNA, 1501 bp, Oryza sativa; identical to SEQ ID NO: 48390

SEQ ID NO: 53671 - DNA, 1501 bp, Oryza sativa; identical to SEQ ID NO: 53649

SEQ ID NO: 53672 - DNA, 1501 bp, Oryza sativa
aaatagtaacttttacacaggaggattgatttatcgcaaattactacaagtaccttgcacagctccaacagctccaaaggtagtagtagaaccatccatgatacttgcatcgcattccacatgaccactctcagtcaaatttgaaccgcgtccagcatttgtgatgggatcatcctaatcagccatagatgagaatggataaactaagacaacttttgcttggaacaaacaccattagccctttatctacatacaagtacactgtatcaccctcgattcgcttatatctaggaggtctgcaaaccctgcttatatgatctatagaaccactcttcctttttccccccttttgacatatcaaaatgtggccatatatcatacaccatcctatttgtcacccattgtaaaatttgaactaaactgcatagtacgtgtagacattgtaacaatacgtagaaagagatgatccaaacctccaatacttgaatggcagctgcaaccgcatcaaggcttgtgccatttccctgcaaaagtattaagagatttaggaattcaccactgcaaagctacatggacgccgctcgagcattacattttcacactacttcaatcaataccccatctagaacataaatccgctcgccagtcaaaatccattgctcagatggaacacttggtggggatcgcgcgtcaatccgagctccatgccatacaaaaccaaccaagcacgagagcaggaggagaaggaggcgagtggggggtaagtaggggatagggtaaagtacaaaacctcgcggagcactgcggcggcggcgaggcaagcgcgcttcatggctcggcggtacgccttctcgttcgccggcgcgtggaagccggcgccgacgtgcacggccacgaagaacctacggttgggggggctctggttcccttctccttctcctcctcctcctccgccgccgcctacccccacaaactcgctctcgtctcccccgccgccgccgccatcgccgccggccatgttcgtttcgagctcgtcgcgattaggacgagaaagttttggaattatgcgtttgagcccctgaagagttggggtttttcccaaaaaggcccaaaatgggaggtatttttgcagttggacccttgtagaaagatatattagtaaataggttgcgaatccttttcactagcgtggatcttcgtgtatcccgtttgtgcagacaagatgctttcctttttggtgtatttggacccctttttttcttcacggatgattttaattttatctgcacactccagtgaacagcacagtaaggctgctactctatactgcaaatgtgacgtgtgactgatttgatatggattggatatttgggttgtgttaataatcatataggagtagcaatttctatctaaaattttcatacatgaattgtctagtaagtatatttgaaacacaggattaaaaaaacatggatttttatagaaatgcaagtgtaaaact

SEQ ID NO: 53673 - DNA, 679 bp, Oryza sativa
tcacagtatgtttcatggtaagaaccctttaagatattgcacgcttgtaggattctacaatggaatttgaagttcctaagtgcagaaaatcaagaaacattacctattagcaaaatggactagagatttgcatgctagacttagagcagatacaatagcagactattagccaactataaacatattttaataagataaaagatgagagagaagagaagcgggctacaaatctgtagccagctgcagcacggactataagacgcaatatgtgtatgacgggtgggaccatatattaattgtatagtaagcaactactgtattaattggctattagattggctatagatgaattggagctattagtgggctatactattaaacttgctcttaggtgtaacatggaggatccctataggttgtgtgcactgtatgcatgactctcttggttgctacactacaatgtttgacggccacatctgtcctttttggaagctgtgtcactttctcttttcttggaccatcaaatttttttaaatttacggggtatataatagggttcgtaggcattaggaatgcagggtcgagcttgcaagtgaacacgatatcaatcattccacatatatatagtaaaagtagtaaggcccaccatgattatctgctaggttgtgcatcgagagaa

SEQ ID NO: 53674 - DNA, 171 bp, Oryza sativa
attatctttcaggttttgcaagcgctgagttcatcctcatctagattcagacatctgtggcagactcacgggttctaatctggaatctcaaatcatttacaacagcatattcgaattttccaacatggcatcactgggcacctcacagttgcaaatgtaaacaggaaaaat

SEQ ID NO: 53675 - DNA, 1501 bp, Oryza sativa
acgaatttgaatattcttttattcagattcgttgtactataaaatattttatctggttttaaattgctatattataggataccggttgctatattatggaacggagggagtacacgtatagactgtattcatttctctcattgggttctcatgaaaacttttcttttttcatgtcaaaagaaaaactttttttctttcatttttaccctatagtaaagctataccctctagtaaagctactactacgtactccactggtactatttagatgatgtttggattcagtacctgtcatatcggatgaatttaaagtattaaacatagactacttataaaactaattacatataaatgagagctaattcacgtgacaaattttttaagcctaattaatccataactagcgcatgtttactttagtatcatataggctaatcatggattaattaggctcaatagattcgtcttgcgaattagttcagggttatataatgggtcttattaatagtctacgtttaatatttataattggtatcaaacatctgatatgatagggactaaaaaattttaaaaagttttagtcatatataaacaggtcgtacgtgttgccgtgttcatgctaaaattgtttagcgtgccggctgcaaactttgcctttctatcatcgataggtaaacgcgtgtggagatgggggctgaaatttcgggcggcacgccttagcgagaaagtatgaaacgatttacacttccttatttcaatgatttagccctattagctggtcttaatgcaactttccatatctcatagataaccgttatctcatactaggtattgggagagtagaaattttcgttttgagtccatcgatctcatcttattcatgtgtttttcttttgatatattcaaatggatattctgtattttataatatttagttttacacttgcatttctataaaaatccatgtttttttaatcctgtgtttcaaatatacttactagacaattcatgtatgaaaattttagatagaaattgctactcctatatgattattaacacaacccaaatatccaatccatatcaaatcagtcacacgtcacatttgcagtatagagtagcagccttactgtgctgttcactggagtgtgcagataaaattaaaatcatccgtgaagaaaaaaaggggtccaaatacaccaaaaaggaaagcatcttgtctgcacaaacgggatacacgaagatccacgctagtgaaaaggattcgcaacctatttactaatatatctttctacaagggtccaactgcaaaaatacctcccattttgggcctttttgggaaaaaccccaactcttcaggggctcaaacgcataattccaaaactttctcgtcctaatcgcgacgagctcgaaacgaacatggccggcggcgatggcggcggcggcgggggagacgagagcgagtttgtgggggtaggcggcggcggaggaggaggaggagaag

SEQ ID NO: 53676 - DNA, 1501 bp, Oryza sativa
aggggaaataagtgtttaatgcaggcttcaaggagaggctggtgtttttgcaattgattttatttgaactcttttctgaaacaactaagtgagtgcttctcaaacgacacggatgagacagtgtgtctcgtccggtcggagtatgtgcaatgtattagtctttagattttgaaacaaggttggcacccggccaacagcttttcaaacggccacccgggccaacaacttccaaacggccacccgggcctagctgatcccatcagctgcagattttccaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttctaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgctgatactcgcactaggtgcgcgaatatcgagacgcaactagatggttgcaaagggacatggtatcacaattaacaaagaaaggatcaaatgcaacaaattaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagctcgatcctcgaaatcctcgcactgcgggtcttcgggctccgaaactacacgtgaaacgggacaactcaacaaacggcgaaaataaagccctattaatgacctcgaagcgtgccattagatagatctcaagatttgaggaattttggaagttgaacggagtcaaacggacttacggttgggaagatattgaatttctaagattattggatttttggtctaaaggaaaaggatttaattaaatcctttttggaaaataaaagaaaagaaaagaaaagagggagggaatatagacttttctcgggcggctagggcgcggcacgagagaaagggcggctcggc

SEQ ID NO: 53677 - DNA, 1501 bp, Oryza sativa
ttcgcccgcaaggtcgccgtctccatctcgtctccctcgccgccgcctcgccgtggctgcccctccatccgtacgccggttgaatcgtcggctggctgcttcgatctggttccggttcctgattgcttgctccaccgattgaccgatcgcgttttgagggttgggggtttgctttttttggattccgcttgcgcggttgcaggtggtgcgtcgatctgcgtccatatggcggcgacagctgcggcgctcgcggtgacggacgagctggcgttgccgctccgcgcggtgggggatctggcggccgccgcgggggtctcgcgggaggaggtggtggtcatcacgcagtgcgcctcgcttggtgagcttctcctcgtctcgtttgggttgtttgaatacttttcgcctgaaatttgtttgaatactgaatccatctactcggattaggactttgcgtgcttagaatcaatctggaattgtgcctaggctgtgttaccagcgtttgtccttttgctgattttggttttgatttgttccaaccctacaaatcacactagttcaatcgattcatggtagctccttgaaagacctgtttgggattggagctcatttctgacgacgcccccttattatacttcatatgctaattctatgtagattcatttcaccacatgtaggaccaaatagggaacacctgtgagacagcgctattggttgacgaaggaaaaatttttttccatatgctcgcattaatcacgaggggaaaatattggagaacatctccctatatgtctgcattgattatctaaattcatctagtggtaatatgcaatatgcaattctcaccaatgactactaaattccaaaatttggaccctacaaccgacacactgttttgctctgctatatgttcagtttcgatttctgttatgctttagtataccttatccttgtagtatacattttggtttgtcataagctcgttttgaacattccatgttggcatggttcaggtgggaagttaccttttgatgatgcatcagttggttctgttcttgctgtcattaagaaagtggaaaacttgggcgatctgttcataactgaaataagcagggttcttaaagctggaggcatggtgcttatacagagttccccctctgatcaggatgtatgtactgttttgccaatatactttattttgtaatgcttaatttgcactccctgatcttctgatcttctcttcatcagcccaataactctattcagcgcaagctactgttaggaggatttgttgacgtgcaagcttctgctgcaagttcccaggatagcgagcattctgttactgtgagtgatctagtgccacaatatgtgttaatgcttctgtgccgtcatactttctagtgctaactgaatcacatgcagattaaggcaaagaaggtctcttggagcatgggctcttccttccccctcaagaaagccacaaagggtcttccaaagattcaga

SEQ ID NO: 53678 - DNA, 1501 bp, Oryza sativa
atcccgcagtttgtatagtgtacagcttttcttgttttctgctttttctttacccctaggggttgtatttttctcctgctatattcaatgaataagcacattcttgtgctggtacctttcaaaaaaaaagtacttgagtatttgtgtgtagtatcttagaatcagctattagtttgaaattggctgctagcacttgtgaataattttaaggacacagaaagaggtctattttacgttcctaaactttatcgaaactccgaaatgtgccctataatcttataaaactcgacattattcatccctcaattatccaaaccattcacttaatacccctcaattaaaaaatcagactgatttacacgcgcatgaatgcatgatactccatgcatcgccgtttataacctcactacggtagtagaaatcaatctgaacctttgatctcatttgatcgaagggtttagatttatttatattaccaccaattagtggtagtagaaacgtggagagatattattgtaaaaaaagaggtgtggagggttataatcatcatttagcaatgactaaactttttttttctccttttctagctttttcaatgaaatatgagcgacgccagcgcaatggatgatcatatattgatctatccgggaaaaaacataaataacaagtaactccgtattagtaaattactaatttacccctaataataggggtagtataatactaacagtagagagtggagagcaatggttattagtacatcattaatttcccctaataatacaggtagtataatacagtacatctttaattttccctaataatacatgtataatacgaacagtagagagcgattgttgtattttttttcaccctgccactgcaaagcatcacagtgacactgcccagacccctcagcagagcgtctagtgcctatgcgttgggtgcgagtcacgacaaggattgggagagataggggacttctttttttttttgttttttttttctgatcgggatgtcaagtaagcaccacaaaaggttataactggtctggttttggttgaggagtaaaaggtgaactgcttgcaatgttgaatgatgaatatttttcggtttagaagttaatgacaacttgaaatggacttctccttaattttaatggcccaactacaagctaattaccttccaaaggaatcattaggtgtgattgctgtctaaaagaatacaagataccaggtgatataagttgccatgctactagtcatggccttgtgccaattgggattagccaaggcactgtggcagttgataaacaaactatgatcatcagaaggtaaaactagaagttccagcagggtagaatgcaattgcttggatcatctatgtcagatcgagtccaacaaaacattcttgctattatccttgatccatcctaagcatacaacaaagtacatatttttcttaggttatacgcgaaaatcctactgcatctgcatgcaga

SEQ ID NO: 53679 - DNA, 1501 bp, Oryza sativa
ccgacgattcaaccggcgtacggatggaggggcagccacggcgaggcggcggcgagggagacgagatggagacggcgaccttgcgggcgaatcgggggctcgagaggaaagggagagagagtttagttggtggtctggccccaccagtcagtgaccgcgggggcgtcgggttggtgcatccgttggtttttgtggtgccgtggaatgcagcagatacgtagtagtagtagaagatacgctggtattcccattttggtgctttttcaaaaagttactcccccatcgtttggcttttttcttataaaccaaaacggtttattagggaataaaaataaatttataggtaaacgttttatatatgtgttcttggtgacttaaagccaatgctgtaaaagaaactacgttgaaaatatctcaaaatcaatctcaaatttaaatttaaaaattcaaattttagctttttctttggctgtttaggccatcagatgggagcctagatgtagtataaacctggtgtaaagggagattacattttatcaacgtgcattctactcttttgattaggactaataataagatgaaaaggagtccttttaatattcatatgcatcatgatttttttaatgaatcggcgagccgtcaatttcattgaacataaaagaagtaaacaaaagaaaaaaaaagatgtacatgtatcccgggctaactaaaaattaaccaatcatggagacttctcacgccagacccaagttttggcctcctccttacatttgccagtaagctggccattggaagcatgattgtggcccaagagtgaggcctaatcttgtttgggctgggatggctgaaccgtattgatctacatgctgcatcgttcaaaacttcaaatgcaagcacgcgtgaatccctcagccaaatactcccacaaacatttttttttcctttttcaagtcaccactaatcaaatcttatgttgtaaaccaacgcgcctattaacggattaccggatccgttccctgtccctcccacagcagtagagacgtgagatgatgtaaatcacccacgtctatccctttttttttatacaattaggtgaaaatatgcattgcatcaagccagtctccccggcatgttctcgtctcatgagttcatgtgccggttccagctcaacctaggccagaggaggctgctcggctcgtctctttctgcaagataaatgctaggaggaggtcattgacccgtacttaattcttctttttttttaattctcctcaataattaatggttattagtaagacacagactgtcagagtgggccatgctggctacttggccaccttggctggcaccttcaacgacttgctatatgagttggtgaagattactggccatactagcaaaggggaaagtgcctgtgcaacatcatcatcaagaagaagaagagatcaacggcaagaagactagcgactagcgagagatcgatcgaagagaagaggagaga

SEQ ID NO: 53680 - DNA, 829 bp, Oryza sativa
  unsure (1)..(829): unsure at all n locations
cagctacgaatgatgaattataatatcatttatctgaaatgacatatttatggcatgatcgaattaaccctaaattttgtaggttaacccatgcagctttgggcttttgccccatactttgtcggctgggtcggttggtcggcctagcctacccacatcccaattcacggcccatgtaagactaactgcaggattgggcccacaaaagaacggaaatcctctctcaattccttgtgctgcggcccacctattataccgaacgaaggcgacagggccgtanccatcggccgagcagagcgggctagcgaggacacctatgtgggccaatgaatttccgcccaactactgttgcgacctgtatggcccaagcccgtttgatgcatcacaaccatcagttgcgaacttccgatcctgtaaatcaaccccctgtactagatcatataccatacttacaatccatgtccttacagataagttacactatcantttagtcacttacaaccatacttaccttataattcagatacccccatttccatacatatattaacttatcatcactcgtttcttccgttcatccataagcatcatttaagcaaacgtatcacattctccaaattgaacttaaatgatttcattaatcgcaagaaaaaacttgcccatcagtcataaatttaaagctcaacgcataactatctcatttcccatgtgcaagaacatttttctccccatgctctgaagtctgaacttcttctatttgcaggtgaaggcgtccaaaaaaattaataataaaattcagaagcaaaagaattgcatccaatctctgaa

SEQ ID NO: 53681 - DNA, 480 bp, Oryza sativa
cattgactttttttaaatatgtttgaatgttcgtcttatttaaaaaaatttaaagtaattattaattatttttctatcatttgatttattgttaaatatacttatatgtatacatatagttttacatatttcacaaaagtttttgaatatgacgaaaggttaaacatgtgctaaaaagtcaatggtatcaaatatttagaaacggagggagtatgtttgttgaaaatgttttaccttctctcaatcttaataaatttggtcagggcaggcacagaaaaaaaaaaacaggaagacataacagcaaaacaaaaacagtggaaattaagcattgctaattacaaacttttctgatcattcacaccattttcatgtttgatccagctcaaacttcactacaacagcttagaacactcttagctagcaaaagtcctaatcacagccattataaatagacacaagcaattagcctcatctacacac

SEQ ID NO: 53682 - DNA, 1501 bp, Oryza sativa
agcgcggatgaggagggggaagggagaggataccttggattggagtggcggctgaaggggtggaaggtggcggcggcggcgaagaagaagaagaaatgaaatgattccctgcactgcactgcaccctccgtctgaggaaacagtattaaagacgggtgggatgacaatttctacttaactccctccttccaacgttttaatacaaaatgagcccctaatggaagtacttgtgctaaggctagtgcgcgtcttgtgtgccaatctttggactgggagctcccatgttttggcagcaagtgggaatatccaatatcgcccctgaactttatatactcatcactaagggagaaactttttattctttctttgtgatggtagaaaatcatgtccctttcaaggcttttgttttaaaatgttttatttgagaggaattgcttgaaattacttgcacctgctcaactagtacactactgaattaaagttgacctgatgcggtttgtgttggtcatcgcattcgcagacaggccgatcaacattcgaaaaagggctcgggacattgcctgccgagttggttggtagtacagtgttccaatcgatccccatgtccatccatgtgggctcttgtttgacagcgccaagctcagttcaagtggattcgattagatcgcgattccatatttccatgccgttttggagttaactcggtttttggtcggtcacacaggtaaactagaaggcaggttgaccgctccaagctgcatagtccttctcacgatgctcttttctgatcctcaagacgctcgagcatccaatgctctcttctgttgtccgtagtacttctactcagctatctcagctacaagagtggatatcacacagaattttgactgcgtttgttcgtgtgatataggggtgcgtttttttacaaaaattttctataggaaagttactttaaaaagtcatattaatctatttttgatatttaaaatagttaatactcaattaatcatgcgctaatggctcacctcgttttgcatatcttcccaatctccttttcctcaaacacacccttatactctagtagtaaattattaggattttttttatcttattttctttctttcttgcttgcttgtgtggaaatgtgaaaattgagcgtctcgcttacaaatattacaaaagtatgggcgaaatgaagaagcaaaacggcaacggaaaaaaaatgaaacaaaaagaaggtatagtggtcaccgttgtgccagtaggtactagaccttttcatgtcgtgattcagcaacgttgttggagactcgagtggagaaggcgttgttggagtgcagcctgtcgccataagattggaggaaacgcgcagtttgtcagtgtgcggtgtgcctgagttgcggctcaacttgagacgacgtccgaggtaaagaaagcgtcgacagacgttgccggctcacaacggaggtggaggtaggtatgaaaacggagcggatagttt

SEQ ID NO: 53683 - DNA, 1501 bp, Oryza sativa
taagagccttgatcaagtacatacttttgaatgttaactacataagaaaattgatcattatgttgcaatgtagttacatagactggccaagttttgttcttcattaatcatccttgattgtgttcttgcagggcccacaataattttggactgaaatactttggcgctctgaaatttaaaatcctgctcttgatagcttcatgttggacaactagccaacttggaagtgttacaacaaaaggagcagataaaccagcaacagataccaccagttctcccttgaatttcgtgtttttgacgttgtgatctctatctgtttaaattactttcttattaagatcacatatatgatggttttggcaccttctaaatctcagaattagctgggaaggtgtcaaacagcccaccttccatggaagaaattgcaatctggttgagattagttggaagaagaacgatcttgctctggccaatcaccgagcgatgatcaaagcgagcagctgttgcaagatgtggaatgctcatgtgcagcattccaacacttgcatccctgaaactatttacaaaagtaagtcagatgcataatcccgacgcatcccagtccatgcatgatcacctcacattgaggaattcgagttctttgcggttgtgaagtattggtaaaacaatggacatgttactccgatagagggttcaccgggccaatatatagagcagattcatggcacatattgaagaccaaagcaaagaaatctctgttttaattcatacgaatcaagaaactgaatagatttgggaaaatgaatccttttactcttgattttctagggaaatctgtacatatctaaaacaaatccaagagctatatttatataggtgggtagcacttatgacgtaattgatttctaaactgagtaaatcgaattgaatcagcagcagcagtaacacaagaacttccaagtaaaagtgtaaaataaagttggtttgattcttattctgtgatgaataattggcatctgagattattagttttgatatttggagattattgtcgaagtggttttggagataattgatttgcaggtgatgaacagggattgctaactaagtagaaccggtcagatcgggcagtggttgccggttagaccagcgtgtatcaagcggtcagactggccagcttgcgatttgaccgtccgactctgtgttggttttggttttgggttgtttctcaatatatctgtggattattcatgtttatgacttctagatggatactatgcgtatataatattgttgtttgctaagaataagtcaagttgttgagaacttgtgctcggatatggtttcttagttgatgcatgtgtaggtggtcttgatgtctcgggagagtgttgccggtgatggatcgggagtcaacatgggagaagatgatgtctgaacgatcaagatatcatgcggtatgcttaggctaaagatcaatgacgatcaggatatcatgcgg

SEQ ID NO: 53684 - DNA, 1415 bp, Oryza sativa
ttatactgtagctacaactttatctataacttaacaaataccaaattctagtttgaaaaatgcatatattatctttacctaaggcaagcaacaaactccttattcatatgccatttatccctgaccccagaccaatgcccataatgtttgagacaggcagatgaatcgtcaacacaaaagatcatatcacttaaaaccttactccacctaagcaaacaattgtaaaagctgaaagcattcatgaacaaagataatacttattctggaaccaatgttagaactaaaggttgtagcactgaccaataagcacggcccaaaacgaagatacgcaacgcatattatactccttgtgtctttaatcaaagctaaaataagaactaaataatgtgttcaccacgttaagtttagtaaagcacctcatcacattgcaactagggactaaattagtttgttataacccaaggttgcatgaccatgaactgtttcaatctttggcaaatgggcttccttactacactatatttctaaaagtaccacttcatacagttcataattagtgcagctgtaccctagctttgacttttgtgtagactcctgactttctgaattcaaatatgagatgcttgcatgtcattatgtcaataagagcatgcaagttatcaattatatgaacatgccttgttacgaaacaaaacctgacaaaaccttttctataatgttcaccacctgaacctgcaagcacagagcagaagaggaatgcatgctcttttgtgtagactcctgactttctgaattcaaagatgagatgctcattttcgaggaaaaaaaagttgaggtgcttgcacgtcactatggctgtgttctttgcccagggttcccaacccctctccctcgttttccgcgtgcacgcttttcaaactactaaacagtgtattttttgcaaaaagtttctatacaaaagttgtttaaaaaaatcaaattaatccatttttttttaaaaatagctaatacttaattaatcacgccctaatgaaatacttaattaatcacgccctaatgaaccgccccgttttccacgatcactgttccggttgggatcctgggctagcgaacacaccctgtcaacaagagagcacgcaagttatcaattatatggacatgccttgttacataacaaaacctgtcaaaagcttttctataatttttattagctaagatcaccacctgaacaatgtacaagcacagaggaattcagcaaaagagtgtgttgagatatttgaatccataaggaattaagaaccataacacagcataaaacatataatgttattgctgaattaactaagaacatagacacgtttatggtattggaatacctaaaagctattctgtatgtgaaacatgctgaatgaaga

SEQ ID NO: 53685 - DNA, 687 bp, Oryza sativa
ccggttgtttataccaaccgggattaaaaatattaggagacctaccacgtcgtgccaatgaataaaccgggacaaaagatgatctttagtcccagttggtaacactaaccgggactaaatatcattgcacttttaaaccgggactaaaaatgctttttagtcccagttttttaagcaatcgggactattgttgtttttggcaaccgaccaaagatggtttctctagtagtgttaatctgtcattagcacattcaggttactacagcacttatggttaatcatggcctaattaggctcaaaatattcatctcgcgatttacatataaactatacaattagtttttatttttatttatatttaatgctccatatttgtgtctaaagattcgatgtgatgtttttgggaaaagttttttgggaactaaacaggccctcggtacctcaaagttacacaaattttttgtaccacgaggtattttctagtgtaaaatttggtagcttgagttacttcgtatcttgaggaactaaaatttgtgtataaaatatggtacctcgaggtaccaaatgatggatggtaaaattgctcggatccacaataattttggtccgaatttatcgaaaattctggttccccctcaaatactctggctctctgaaatttgaaatgctgctcttggtagcttcatg

SEQ ID NO: 53686 - DNA, 836 bp, Oryza sativa
ttatactgtagctacaactttatctataacttaacaaataccaaattctagtttgaaaaatgcatatattatctttacctaaggcaagcaacaaactccttattcatatgccatttatccctgaccccagaccaatgcccataatgtttgagacaggcagatgaatcgtcaacacaaaagatcatatcacttaaaaccttactccacctaagcaaacaattgtaaaagctgaaagcattcatgaacaaagataatacttattctggaaccaatgttagaactaaaggttgtagcactgaccaataagcacggcccaaaacgaagatacgcaacgcatattatactccttgtgtctttaatcaaagctaaaataagaactaaataatgtgttcaccacgttaagtttagtaaagcacctcatcacattgcaactagggactaaattagtttgttataacccaaggttgcatgaccatgaactgtttcaatctttggcaaatgggcttccttactacactatatttctaaaagtaccacttcatacagttcataattagtgcagctgtaccctagctttgacttttgtgtagactcctgactttctgaattcaaatatgagatgcttgcatgtcattatgtcaataagagcatgcaagttatcaattatatgaacatgccttgttacgaaacaaaacctgacaaaaccttttctataatgttcaccacctgaacctgcaagcacagagcagaagaggaatgcatgctcttttgtgtagactcctgactttctgaattcaaagatgagatgctcattttcgaggaaaaaaaagttgagg

SEQ ID NO: 53687 - DNA, 1501 bp, Oryza sativa
gtcagtcggttaaagaattagttagctttcgttagtcctgacaggacactaattagtcactcctcttacatgtgcagtctttgaaccatttggtatattgaaatcaataatgcctagaagtaacgtgtgaaagcatttgtgctcccggttcgtaaccccatgtactcccggttttgcaagcgggattatgaatccgggactaaaggtgggtatctttagtatctaggactaaaatccatatttagtcccggttggtagatggatagggccacgtcacgattgttttttacttattattattatttttttgcttgtacctattccccacccaaacccacccaaaccattcacaaattatacacaataaaatcatccacaaatcatacacattcacaatccacaaatcatacacatccacaatccacaaatcaatcacaaaatcatccccaaatcaacaaaaaaaatctccaacaaaatatacaaatcattcagtacaaaatatacaaataaaaaaaattcactcgctgccgcccggccgtgcaccgccttgcgcccggctgccgccgccaaggagagttcccaaatgacttcataattaaggagccactcggtctacgatggcgtggtataatatatttctttccaaaccgaataatacaacatgttaaagactatacaatttcatattatatcataccaatctctaaagggtaacaataataatatggtgtatttataagaaaaagactatttacaccttagatgaaacacccaaaggttaaaataattaagaagctcacgagaggagaaataattatcatcaactacagttaggtggagccaggcaattaattgtataacatttaggatacatgatacctttggacccaacttctatctatctattatatactaaaagtacattaaacttcctataaacgctctcgagtcgccaagtggcgcttctacaaacactcctggaccgccatgtggaccgccatgtggcactatctaatctcaccgtcgattttcacttaaattgatggacccgttaatttagaacattagattagatctattattaaaaaggtgatagtttttcctaaaaaatatgcaactggtggctgggaaaaggaaataaaactaaatgtccgtacgtaagtataattgaaaaaaaaacaaataaagcttcccactgttaggcggaagaaaaaaaaacatctactaacgataaaagatgataaagcaaaaaaaaaaagatgactcatccatcctctcctcaccaattcaattatctcctcttcttttttttaactaacataatataactattgttttatttataattaaataaataaatcaagataacattagctatattttactataaaaagttaaaatacattatttgatggtagaccctatcgtttgaatggcaactaaataacaacgaaaaattaatcgaacataatatgtattatgcgatactaaatcactatac

SEQ ID NO: 53688 - DNA, 1501 bp, Oryza sativa
aaaggagattgggaagatatgcaaaacgaggtgagccattagcgcatgattaattgagtattaactattttaaatatcaaaaatagattaatatgactttttaaagtaactttcctatagaaaatttttgtaaaaaaacgcacccctatatcacacgaacaaacgcagtcaaaattctgtgtgatatccactcttgtagctgagatagctgagtagaagtactacggacaacagaagagagcattggatgctcgagcgtcttgaggatcagaaaagagcatcgtgagaaggactatgcagcttggagcggtcaacctgccttctagtttacctgtgtgaccgaccaaaaaccgagttaactccaaaacggcatggaaatatggaatcgcgatctaatcgaatccacttgaactgagcttggcgctgtcaaacaagagcccacatggatggacatggggatcgattggaacactgtactaccaaccaactcggcaggcaatgtcccgagccctttttcgaatgttgatcggcctgtctgcgaatgcgatgaccaacacaaaccgcatcaggtcaactttaattcagtagtgtactagttgagcaggtgcaagtaatttcaagcaattcctctcaaataaaacattttaaaacaaaagccttgaaagggacatgattttctaccatcacaaagaaagaataaaaagtttctcccttagtgatgagtatataaagttcaggggcgatattggatattcccacttgctgccaaaacatgggagctcccagtccaaagattggcacacaagacgcgcactagccttagcacaagtacttccattaggggctcattttgtattaaaacgttggaaggagggagttaagtagaaattgtcatcccacccgtctttaatactgtttcctcagacggagggtgcagtgcagtgcagggaatcatttcatttcttcttcttcttcgccgccgccgccaccttccaccccttcagccgccactccaatccaaggtatcctctcccttccccctcctcatccgcgctatttctcaggacttggatttattttctgtgggttgcgtccaatctgagcggaagctatattacatcgagtttagtttgttgcggatttggtttctgcttccaaagggattgggtggggttcatacatgaccctggatctgatctgagtgtagtaggtaggtgttaagatcaatcggatcaacgactgtatcttgttcggatgctcatctcatggatgttagcctcaggtcagggggttgtatactgtatacagcttgactgtatttagttccggtaggggaaaagaaagcaactttgcaagttgcaactctgctttttgctagatgtttgctcgacctgctaggctgcagctcaagctaattaaaaatatattttttttttcattctgatagcagctatattgatgcttgatctatggttcctattatgatatgatcataggagga

SEQ ID NO: 53689 - DNA, 1501 bp, Oryza sativa
tgtacttgacaatagggtttgaagggtccaatatcaatgattatttttcttagattttgtagtttgttccattttggtattgtacattgtgggctttggcaaatatggtgaaaaagaggagatataccttattttgatgtgaactagtgcaatatttctatgtttgagtagattctgacgacttcatggctgtcttgcaaagcaattagttttgctctattatgagtttatgatgtaaagcgaactttagcatttgagtaaatttttggtctatgttagaggtagcattttaggaaataatgaacatataattttctgcttcaatctaggagttatttaatgttacttccataattgtattatgtccttgttttgcctcctttttttttaattgcggcagtcatcttcttgatgcttacagtgttagcagcaagttacttttgaccgaatacgacttaatcctgtagatgctgcactgaatctctcattccaagcaaaaactatcttctttccaaggtcatcatggtttaacattctaaatgcttatcttcactgattgcttttacatttggttccttctactatcatgctgctttaatgcttatcatgctgaaataggggtttgcacaccaaaactgaattactgaagactgaagttttcatctgcataattaatttctcagtattttctcagattggttgtgcgctgattgggtcacttggagcattgttcaatggcgttcttgtgatcaacctggtaattgggctctttgctgttgttgcaattgagagtagcagccagacacttggtcggacatatgcagtccttctgttcttcgctattgttcttgatgttgcttggtttattctcttctcacatgctatatggtatgtcttctgcaatgaatcaaccactatattttatagttcataacctgttttaatttttgtgtgatggggcaaaagtagtaaaatgcaaaccatgctacacacatcctaataccatcctttggagctcattctagttcaagttgtgccaatcttgattcccttgtttctgtcatttatttgtgctgagaaatagtttcaaattcttttggaagttaagggaatccttcaaattttctttttcccattttgtgacaattgcactggtatcaggccacttgccagtgtagattttgcattattttgttatggaattaagtgtgttatggaagtacctttgtatgatgaaacctgtttggatttatgtgtgatggcgcttggttgcttctagtattccatgccttgcatcaacttataacctgaaaacataagtttgttgttatgcttgctattggatggacatggaaatatttgccaatacacttcttttttaagatacagggagaatattttgatattgtacagagttttaatctaatattatatttatacaggaatattactcctgaagagaagtatggtcaacttttcgttttatcactcaaactagcgt

SEQ ID NO: 53690 - DNA, 1501 bp, Oryza sativa
tctcattctccactctatgttgttgtatcatgccactggtctctctctctcgctttctctgatccctgcttgctttttcattgtagactgactaatgccattttcctgccttgatcgatcatataatggagcattttagctgattgaggatggcccttggggtcgcccaagcgagcatgcatgcactgcacgagcacaaatgcagtttgtttgttcagattaattaaaaaaacaacaacaagggctgcctcttgcaacgcatgatcgattgatcgttgaaaagaaacatgaaaagattgagatttttgccggccagaaacaaaacatcgctgtgctcaccgcacctggacgggatccggatctgactgcagttctcatcaacggatgcaaatcggacgatccagactgtgatcacactgttcatcatcgtactatagcaaaaacatcgtagcaagggatactattcatgctgttactgtaacagtaaatctaaaccatcgatcataaaaataaatggctgagattacgtacagttctcagaatactgtcacaacacttcttttagggaatcatttggcgtgctttattaatatacaaacattgttacaacattcactagaacgtttagaacgttaacaagaaaatatgggcctcatcaaaccaattacaagaattcctaaacttaaaaaagtaagatttgctagaacatgtgccacacaattggcttccctattacaatgctcaacagagattttaacaaaatcatatatcaaaatctggcattcatagaaaattgccgtagccgttgttaccaaaaagcacccatcttacatcgtctctaccacctgtaaacaacctgatcgggtaataatgcagtcacaacacttatctgaatccaactcgacggttgtaacttgtaaagccgccggtttagactactataaaggagatggagggtagtgggttgtacataaatgggcttggcctcttttccaattgtagtggcatacggcccacttcccttttaagccctcccccaaacacccgacactgtactggcctgcatacgggcattacgggcacggacggacaggtggaccccacctgccattggcttccaagtctactccccacggtgggaagggaggcagcaagggatcgcgacgccgcagccgcaacggctttcccgtcagactcacgtcttccaccagcgcctcccttacacgcttcactgacagtgggtccagtcttccttgggacccacatgcatagggggccaccgcgcgagtaggtgaacccaccgtatagtactagtattataatccgctctacagcctggctgaaatgacggaaatgcccccgggctcctcctctgtgttgtgtagttgcgcaccgctatctcggctcggctggctccagttccccaccaaactctctctcgccatggccgcatccgactccgactccgacgccgacgccgccgccgccgccgccgcctcgc

SEQ ID NO: 53691 - DNA, 454 bp, Oryza sativa
aatatctacagccgattgaatagattaagttcttaatatctatttaaaacctgcggatcgatacatatttaacatgggctcaaagataaattgatatgtcatgggcacctagccgatggactatcatttatggatttacccacagtttttttgtctttatttcttgtggatggcaggatcaaatcaattggcacgctagcatacccgaaggcgagttttggatctgcactggagttaagcagacctcccagggctcgtgtttttcatcaacacctcatcacccgccgcctcctcctctcctgcctcaccccggcgacctttccccacccatcggccagcttgctgcttacacataaggagaaaagtgagattgagaaggagggagaggaaagggaagagagagggtgctgacatggcatcttgacatgtaggtcccacgctgagccagccgcca

SEQ ID NO: 53692 - DNA, 1501 bp, Oryza sativa
caagcatgttgacttcctaaccagcaagacacctttaaatttcaagcaatcgtgttgattaaatggagaaataggaagaaccatacatggctgcttgcctctgcctctataagcttctgaagcaaaccatccgtttcctgcacatagtgttaggcaatgttttaatttgtggaacaccttgaagcatagtgtacttaacaatctgattatctaattttatggtttcccaccataagtagtcatgattaaaagttcgaaacataatttgtagagttctgtaattgtgtgaaaaaaataagctataaccatgacgatgctctaagtttacctctgtatcccagccatcaacaacaaacacatcgagacaaaagccatctgatgttgagaacacatgagcttcacggatgttcaacccaatatcagacagtatcgcggatagctgtaaaacaatatctcacagttcaagcggtgacacaagaaggtgtggtattcgtatggaggtctctaaatagaaatcacaaagtacatggccttgccttactgaggagctttggcttgtctatggaagaaaaaataatttcatgaacacggacgaatttcgagtcccttctgcaaaattaagagaatggttatggacaaatcatgtaaaaaatgattaaagatgattgctcaggcaaattaagagaatggttcacgaaaagaaagcatataatacatgagtgctaaactagtctggatatcagaaagaagtccatataaaaagaataggcaaagaagacgttactaatcatttcaaagaattatatgagaactgttgtgcaccgatgtagagagcaaaggctcatatccacaaaactcaacaattcaaacaaggctgattagagcaactagcctgattgcatataactgcagtaacaccaactatttttttttgcggggagcagtaacaccaactataaaggttgctcttaagtatcatgacggaagctttgtaccaaagaggaacacagtgttgttttatggacagaacaacctttcagtcaagttagcacccttctggaaacataatctatgtttatacaaatgaaatggaaatttcgcattcttgcagtttttagatcgaaccagatggttgaaacctgaaactgacgttccggattaattgattgttattatggtatagatatgtcattcgcacagcacaacagcttagtaacaaaaataccttgcagaactggcttcgaagtcatccacaccttttcctctctctagactcaggtcttccatcatcctttcatatggctcggattctgtgaattcatcatctctgtccaatattcacaggcacaatcgatgttaacacgaaagatatactgataagttggcttgatatttacagaagaagaagcatttttgtttggacaaagagataccattccgaacacgaaaagaaaggtacatacactccactgaaatcaactgtgtcctcaactagtaaagt

SEQ ID NO: 53693 - DNA, 1501 bp, Oryza sativa
actgttctgatttcctttcttcttgaaagatgtcttgttaactttgccaccatttttccagaaattcttccctttgttctggttattctggtttttccccttcttaaaggagctagcatttgcttcgggtgctgctgaacttccagtggggcgagacgtatgattttcaacaagtgtctcatcttctccttgcgcttccatgagcacggagaccagttcagaatacttctcgtatttagcctggtggtattgcctctgaatattcacatgattggcatggaaggtggacaaagttttgtctatcatgtcagcatcagtgattttctctccacatagcttaagacaagtgacaatgcggtgaagaactgagttatattgctccatagatttgtaatcttggaaacgtaagtgaagccactcacgttttgcttttgggagcaaagcctttacttgatggccatagcgatccttcagtgagtcccaaaggaccttcggatcttcctcagtcatatactcattcttgagagtagtattcaaatggtgcctcaggtaatgcagtgcctgatttttctcggctgaagttggtaaattattaactcctccagctgatgttgcaatagttgggtcctgaatgcagttcaggagtttcttagcaccaagcatgattttggcatctagtgcccatgtcaggtaattcttgccgctgactgctagttcagcaaaatctctcttagcaatatcagtcattttcctacattagtcatgcaaaattcaataagtactgcaagtaagagcatgacaagtgtgcaaatagtaaattgtctggttatctaaatttagtactgtgtcaatatattcccataattctcccaacatttctcagaattgctgtactattatttatttaggtaccaaagtaattactgaattactaacccattaaatagtatcctgaaaaaataaaacagcttggaaaataaaccataaatatgatgctctctggtgtgtactaaatttcaaattatgagagctcatttcctaaaaaccatgtctctaggattctatggttgattcaaaaattaactaatgaacacttaatacatagaaaatcgagggctaagacaaagaaaaagcattaaacatcttctctgtttcggcataaaataatgcagaataaccaaaattatagtgttccccgtaatttctataatcccgagggattattccgctaaaattccaaatccgcatgaaatcagaaaatattcggaagtttgccgtttttcggggcaaatttcgattcgagcccgactccttttataggccaaaatctttttcggcccacctccatgaaccggccattcaaggaattagtagccggcccgtcagggccgttggcctgctaatggccttggcccacggtgcagcccaacaaaggggagccacaccttatccgattcggatggctagggttgaatccctagccccaaaatccccaattcgg

SEQ ID NO: 53694 - DNA, 1501 bp, Oryza sativa
taaaccataagccttatgaccataaggcagatgtcttcagctttgctattgttctatgggagttggtcactacaaaggtaacctgtggctggcaaggcattgtgtgacgttttcatagttctcaatttttttaacagcagtgaactatggtcagatgtaataaccactaatacatgtgctatgtagataccatacgaaaatctgacacccttgcaagctgcactgggagtaaggcaggtatgtatttgatgccaataagctccaacataacacattggatgttaaaaaaagtaaataatattaacaaataatggatgctcaaggatgaagggatgactgtaaacattgacccttatttaattattttagggaatgcgcatggagatcccaccgaaggtgcatccgaggttgtccaaactgattgaacgatgttgggatgaaaatcctcatgtgcggccccttttctcagagattactgtagaattggaagatatcttacggcatgtcctggtaaatttctgaactttgtacactttaggtttaatgaaacgacgatcggaaaaaaataatgaatttgaagtatctaggttcatgcttgagactgctgaaaagctgcatatctgttgtaggtttccaagacaggaagtcgacatcccaaagcaaagatacaaaagaaatcggcgcgatagagaatacatgggctccttgtgacctttgtgaaaacagcttagaggttttcttcaaaactaccaggctactgtttgttgctagcacggcagcatagaaatgattttgtatatatgtcggatgcttgcatgtataatatttttttactcacacctgattggtatgagttttctgttttgtcatataatatgtgtactaaatttagaagaacgctgaacaaggcggcagccactgggatattttaatacagctctagtttttgtgtttccagcctgtgcaattttggctcatgtacatccggcaataacttagttgagacttcagaacttcagatgaagaaccatatctcttttgctgaattccattttgatgcttgtctataggattggagccaaattgttggctatgcccaagcttaatttggtagcatcccaaacccttgtttatactctagttagatttggcacctaactggaagcaattcaaacatattaaaaactagttcctctgtttcataatataagtcattctagcatttttcacatttatattgttgttaatgaatctagatctagattcattaacaataatataaatgtgagaaatgctaaaatgacttacattgtgaaacggagggagtagtatgttttgacacgggtaaagaaagaaaatagcagtttgggctgggcctggcccagttagttgcttgggccaaaatctgatgagatcgaaaactgaggaggaaaaaaaatccaatccatccatttcctttccagtggtttcgcgatggcgagcacgccggagccggagacga

SEQ ID NO: 53695 - DNA, 1501 bp, Oryza sativa
gaatgccgccggtacttctcgagaatctgtcaagaccggcggatgagaccgaaagccgagcactacgcgtgcatggtggacctcctcggccgcgccggcgagctccgggaggcgaaggagctcatcctcagcatgccaatggagccaacagtgggcgtgtggcagacgctgctgagcgcgtgcagggtgcacaaggacgtcgcggtggggcgggaggtgggcgacgtcctcctggccgtcgacggcgacaacccggtgaactacgtgatgctgtcgaacatcctggcggaggccggcgagtggcgcgagtgccaggggataaggggcgccatgcggcgcaaggggctgaggaagcagggcgggtgcagctggacggaggtggacaaggaggtgcacttcttctacggcggcggcgacgacgcgcacccgcaggccggcgacatccggcgcgccctgcgggaggtggaggcgaggatgcgggagcggctggggtacagcggcgacgcgcggtgcgcgctgcacgacgtggacgaggagtcgcgggtggagagcctgagggaacacagcgagaggctcgccgtggggctgtggctgctgcgcgacggcaccggagacgatggcggcggcggcggcggcgaggtggtgagggtgtacaagaacctgcgggtatgcggcgactgccacgagttcttgaaagggttgtcggcggtggtgaggagggtggtggtggtgagggacgccaacaggttccacaggtttcagaatggcgcctgttcttgcagggactactggtgaccatcaccatctttctctcaattcaattctacttgcattaccgaattctgaattggagcgaccgtgagaggtagcatagaatgtcatgtacacaatccccaatttagagagtgagtagctctttgacgcggaagacgtgtaaaagtatcatatggttcaacaaaattttcagaaaccgaccttagctcagttggtagagcggaggactgtagtgtttgcagataaatccttaggtcgctggttcgaatccggcaggtcggatagtttttttttctctaacaacttgttcctattgccaagttttcggcaatcctgaagatgctactgctacaccttttcttttggcctgttcttgggaaaacgcgtagtatcagttatcacgaaagtctttctaccataaaattattagtggtatttttttttctaaaaaaacactcatctaaaggattcagtgccaagttgttgttcaagatgtgcagaactccccgtgtttttttcttggattgtttactgccggcaacgctggctgtagctcctagcttgatggatcatcctgccaaggtgatgatgggctgggccttgattgcaaagtatcatctgccgcagcccagttccagcgaccaggcccaaactgggccatatcggttggtttttgctctctacgtctccacggctcgaccagattgtcgtcagtcaccgtcagaca

SEQ ID NO: 53696 - DNA, 170 bp, Oryza sativa
ttctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgcccccttcta

SEQ ID NO: 53697 - DNA, 1501 bp, Oryza sativa
ttctattcatcttctttgccctactgttcttgttagttttgcttatgttcagcgagttgtgttacttcttccaagtagcctatgatatcattggtttatgtcggggtatttggattttggagtgtccactattcagtttaatactctaggctctacaatttttgcatcgcgtaaatggtttgctttgcgtttggttttagagcacagaaaacaacctttttctttacaagaatcgatgcaatgtcatcactgtttagagtttaagtgtgctgaaaaaggtggctcagttccaaattgctccgcgtggagcacatgaaactgttcttcagaccaacttgtctcagatttggtttccaataacattgttttccacctgttattgcagtagtataagagatattcctgatacatcattaacccacttcatcgtgtcaattattatcatcctgagcagatcattaccgtccatgctccttgcacggttgcaccatggtttatattgtttttgctctacagatccttgcattatatctgttcagataatttcgatcttattcattctccaaaatatgagataaaaaacggagtctgttattctcgagacttggttgagaatgtgtgcttagtctggactctggagataggttctctaatcaaaagagttattgtacatttcatcagagacgttgatacatatatcggataatgataattagaacagatgtttccagtgcttaaacatttttttagctgggttagtgcttaaacatttgatgttgtatttctatggatcacatcagaattttgagaacctacttgacatattcaggtacttggagttaagaaaagagaagtttctattggttctggctcaaaatcgagggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaatttgcctagcgagtttacaagatgaaaactttggtcatcgcatattttatcacgagatggtggtacagcaaagggcaaaattatgagagctggtttttagtttgatatgctaaaactctctctcatgatttacgctggtgactctgcgttgccactctcaggtacaatctgatcctgatatttcaatcggattgtacctttcgttttcaaagcatgtccagtttgggcgtttggagttggaccttttggatgtcgaatttgaaaacaaatgacagcatcatttcagaacgtatgtcttcttttttggatccggtaagaaatggactgatttgtatgattgtttgcatactaagggcccctttgaatcgcaggaatgagaaaacataggaataggaaaaacgcgggattttgatagg

SEQ ID NO: 53698 - DNA, 1501 bp, Oryza sativa
  unsure (1)..(1501): unsure at all n locations
atgcattcttgccaatcccacattgataattgatggtggggaagcacaacttaaaagatagtctcatccattagacaagtcttttgggttgtatagtcttaagacctaaaattgtggcctcagtcgagcctgtggaggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatctttttccaccaaaacttttaccatttaccatttgctattccaaatgaatcaaaacggacccttagcaaaaattatgtaccgcctaatcatacttgtcaggcggcagctgcaaatcgaacaataaatatcccgccttgctgaccaggcaaaaaagtagggggctggttggttgctgccctcgcctggagaccattggtcaagcaggtcgatccgaccgcaggcgaccgaaacggacgcctgagatcgacgcctgagccaggcgcgaatctgagggcagcaagcaaacgcgccctagaactcatctgtaggcataaaaaaaatctcaggtatgctgttcaggataccatggtcaggcggcagctgcaaatcgaacaaataaatatcccggctgcgcaaaaaataagggggtatctgggagagaggggctaaactctcaaaaacataagtccttcccataggaacttatatttttgtgagagagactaaattgtttagccgcactttagtccctccaaccaaacaccaaataaaagctatctgtcaggcatgaagaaaagtgtcaggcatgggtgtcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgcttttaagtgnttgagatcaatgcccattaaaacgccttgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacg

SEQ ID NO: 53699 - DNA, 1501 bp, Oryza sativa
attggtcaaaaagattaattatgactagatgtgtagtgcattttatctgcttccttttatggctcttcccatatagtttaattagtattacctgatatagcaaactggccagggagctttctctaggaacgatagccagggagcaacaggggcagtcctacgagatgttgatgggaggttcaaaggcggccgggctagatggcatcctcatggcctggatgctttgatgatggaggcccttgcctgccgggatgggatacaacttgcccgggagaaaggagtcttaagaatccaggtggagacggactgccaagagctaaccaaactgtggaagcagggtggctctcaaagatcgcatgttgcgtcgattatcagtgatgctatagagcttagctccagttttcatggttttactttactgtacaccccccgatcttgcaatcatgtagctcatgtattagcgaagcaagtcacggctgatgacaggctgggtgagtggcagtcagccccagcttgtatcgagcaccttgtgactgaagattgtaatcctgctgttccctgacgaatgaaatgagcttcctatcgcaaaaaaaaaaaagatatagcaaactggccagtacctaatgtgccactttatggatgcataaatttctctttatatgtatactacttgattgctacacatataatgatgttttggctgctataataaatatatcactttcattattatagttccagtaaaccactaattactttcataaatcagtttgaatgatgtcagcctcttctgggccatcaacacctaaaccagctcgcaagcgcaggcaacccgagagagcttttataccttcaggttagctccaagccatataaatttttatttctacatttgaaaccattttcctattgagctctcctatttgtcaacaaatgattctgttgtgccatatctatttcctggggaatattcctagcgatggcgttgttctgctggctgatgacgccctctcccatgttggtgatttccctacaagttttcatttgccatcaaggcgctctatacgtcgaagactacttgctcagtctgctggtataatatttgttgttttgattatttttttttcgttctaattgtctaccctgttgttttccaaatgtatggcatttctttccatttattatgcataatcatcactaccagttcaacctaccgcagtccacatttacatatcaatttcccatgttattaacctaattcttttttgaccgaaaattgttgctcatattctaaatcaggatttccccacccggatcctataacagctgctcaatcatgtcgaaagcgtaagctctctatggctgccaaatcatctagaggtttgattatattctttatccactcacatgtttatctacatgtgcactttcatgccttatacaaaatttttttttccctaacacgtgttgttttctctagaaattaatagtaccactgaaa

SEQ ID NO: 53700 - DNA, 183 bp, Oryza sativa
cccggtgatttttttatgtgcgaatttttttaagagcgccagtgtaaatcaattttggctggcggttgattaagtgggccgccagcaaaaataattgtaacttgctaccggactatttacccaactgccagcaaaaattatccatttttgttagcggctcatctaagtgaccgccagtgaaaa

SEQ ID NO: 53701 - DNA, 1501 bp, Oryza sativa
gtgtaggaaaaattgccctctttgctgttgtgtgcgatattttattttattttttaaacattgttctagtgttacagttttacatagttagtaaaaagggtaccgttgttcggaaggggtaaaaataactatgggtcaacacacatatggtcatatttatgggacctgcccaattcccgtttgtaagcggcatccccccctctttgggtgatgtaggttgctgtgattgctggtaacttttcaagtgtatttgtcaagtggtcttaatttgttattactgctaccgtatgtatttatgcggttgtcattaccctgccttttttgttgattgagctgatgtttcttgtcgaccttgctgtccggttgtcctgcctgtgggctgattcgttgctgcgtgcgttgtcttctttgaaggcagggtatttactgggggtgattcatgtgcgtgtcgacctcctgtggtatttactgtcctcacaggttgtgctggcgagttaattcactgtttattggtgtaggtgtcggcttgcatgtctattgtttgttgtatgcgtgtccatgcccttgcttgctgtcccttcttgcccctctcctttatatggttactctgtgcatcagtgcttgctcttctgttttcctttctacgaccggttcgttatttgtttcttctttgttcttttttttccctcccgacgcttgctctgttctttcatttatattgtgttaatgttgtactgatcgtacgcctccttgtttctgtaaaattatgatatccatgttcttacttgtgaaatcttattaggcactgggtatacttacttggtcgtattggtttatgctgtctgtatcatctgctagagctcgtcgtgccgcaatccttcgtggtaggagttcttcctcacggccagcatgtgaatcaacacgatcaacaggtaattgccttttccttcgttactatattcatttttactccccttttgcccgaaatgtaaacgtcacttctctagatttgaatttgtctttgtcctttgcttttggaaagtttgattatgttaccttttttttagctacctcgttcaattctggcccttcgtaccagtctttggtcattcggaggaaaaggaaattggcaatcttgcgtcgccggttgtttgcttcaccaggttggttctttagccgtgtttagttgcaaaatttttcttcaaacttccaacttttccatcacatcaaaactttcctacacacaaacttccaacttttccgtcacatcgtttcaatttcaaacaaacttctaattttggcgtgaactaaacacaccctaagggtccaggcaatgaattgcttaagacccctgtactgtagctctatttatccgtacacagtactgcacatgaatagatgattgcctctgttttttttttggtcgaatgctcaggaggccagtaatacaatatgcttttagatttttttctggaaaatattctcattgtttgcgataagt

SEQ ID NO: 53702 - DNA, 1501 bp, Oryza sativa
acccaatatatcatcagccatggaatttcgtctaactgaacttgatcttgggctcaagaaactatttcttccatcatagtttacttcatgatatgttggggtgcttgatgaaacccccagcctatacatctggatccatatgaaggaagacaaaaaccttactgaaaacccaataatttgcatccacaacgctagtttgagtgataaaacgaaaagttgaccatacttctcttcaggagtaatattcctgtataaatataatattagattaaaactctgtacaatatcaaaatattctccctgtatcttaaaaaagaagtgtattggcaaatatttccatgtccatccaatagcaagcataacaacaaacttatgttttcaggttataagttgatgcaaggcatggaatactagaagcaaccaagcgccatcacacataaatccaaacaggtttcatcatacaaaggtacttccataacacacttaattccataacaaaataatgcaaaatctacactggcaagtggcctgataccagtgcaattgtcacaaaatgggaaaaagaaaatttgaaggattcccttaacttccaaaagaatttgaaactatttctcagcacaaataaatgacagaaacaagggaatcaagattggcacaacttgaactagaatgagctccaaaggatggtattaggatgtgtgtagcatggtttgcattttactacttttgccccatcacacaaaaattaaaacaggttatgaactataaaatatagtggttgattcattgcagaagacataccatatagcatgtgagaagagaataaaccaagcaacatcaagaacaatagcgaagaacagaaggactgcatatgtccgaccaagtgtctggctgctactctcaattgcaacaacagcaaagagcccaattaccaggttgatcacaagaacgccattgaacaatgctccaagtgacccaatcagcgcacaaccaatctgagaaaatactgagaaattaattatgcagatgaaaacttcagtcttcagtaattcagttttggtgtgcaaacccctatttcagcatgataagcattaaagcagcatgatagtagaaggaaccaaatgtaaaagcaatcagtgaagataagcatttagaatgttaaaccatgatgaccttggaaagaagatagtttttgcttggaatgagagattcagtgcagcatctacaggattaagtcgtattcggtcaaaagtaacttgctgctaacactgtaagcatcaagaagatgactgccgcaattaaaaaaaaaggaggcaaaacaaggacataatacaattatggaagtaacattaaataactcctagattgaagcagaaaattatatgttcattatttcctaaaatgctacctctaacatagaccaaaaatttactcaaatgctaaagttcgctttacatcataaactcataatagagcaaaactaattgctttgcaagacagc

SEQ ID NO: 53703 - DNA, 1482 bp, Oryza sativa
atgccttgcatgatttactcatggtggaagtatgggatcatgatacgtttggaaaggtataatgtatcttttttacttttccacactgtttcattgtactatgtttcaattgctctcctcttgttaacattgtataagtgctccattaatccttaaccattactccctccatctacttttgataatcatatttcatcttggcacacagaccaaagataagtaattctacttattatccatttaaacatgctactaatcattcatcgtaaacaagcgattcattaatatttacatttctcgatgcctatgtaaccaatcttgtgtggaagaatgtagtcacgcattaaatccgagaaagtaattaataggataggttgttggattgaaatatacctatcaaaaataaaattttcagatttggaaatatgcctatcaaaagtagatggagggagtataatattggttggcatttgttgaattcatgtgcattttcatagcgcctcagtcactaaacattgttctagttattgctgcatatctacataaacttcgtggttgtactaatactgtagttctaatgccaatcttctacctagtatctggtcctgtagtcctgttattcttctgatcttgtcacactaactttatttattcaaattgcaggattacatagggagatgcatcttgacacttacgagagtaatactcgaaggcgagtttcaggatgagtttgttttgcaaggtgctaaatccggaaagctgaacttgcacttcaagtggacgccgcagccaatttatcgtgatcgtgatcgggaccagtgaaatctgtgtagatacatcacgtcaagcagctgataaatatttcttcccctacggtgcctgtacattagtttttctgtacagttaattcacttatcttgtagcaacaaggtgtaatggaataaaagaatggtggtttcatgttccgacggaaatgcgatgtgctatgaatggagggttgcagaaagatggatggtaacacggggagatgggttacccaagtatggaaacattaagttcatcatgcaagcagatactttatgcatcttctactggtaaaactaaacgtgtttgtctttaaaatgcaacttgtaatataattccttgtactaacaattactacctccgtcccataataattgcatttctagaaaattggagacagattaacaacaaacacaatttaccacaataatcctatttaataactacactgcatgtatatattccatatgtaaacttgattaaaaggaaggttgaggaacatatttcatatgtaaacttaattaaaaggaaggattgggtacatattccatttgttgcgtcccatcttatcagaaatataatctttctgggacaaaatttgaatggtagaaatataattattatggggtatcagaaatataatctttctgggacaaaatttgaatggtagaaatataa

SEQ ID NO: 53704 - DNA, 383 bp, Oryza sativa
tgtcaggattatggataccacatacctaatagtagttgactaaatctcggcaggacccaccacataccatgttctatacggaaataacctgcgaatataggaggagttcccgataaggaaagacaaccagagttctacatgtaaactacaaggactactcggattgtttccatattggtttccctaattttacttaaacagggggacacctatgggtataaatataaggccccctaggagggggggacgatcaacatggacattcaacacccaccacaatctacaaaacaacagaagccaacatacgccaagacaagacgccggatatcgacttcagggataggcacggctagtcccctacggtgtctctggatactgatagg

SEQ ID NO: 53705 - DNA, 207 bp, Oryza sativa
gtttgatgtcgcgattccagtatttgcatagtatggggatcgttggtgctagggtatacgcgagactgaggtaaaagagacggagacgatgatttttatacaggttcgggcccctgaattgtcagataataaccctacatcctgttggccgaagccgatattgctcttattcaccataatcacaccagtacaatatttggggtagcc

SEQ ID NO: 53706 - DNA, 1501 bp, Oryza sativa
ttccttcacccacatggttcgtgtcccaagttcctaagcataataaaatcatcattcgaaaaagaatttgtttgaataacagggaacaattttagttgtgttcaagctcaagtcatgcattggtctttgttatgcactaggtatgtttgtatcaattgtaggatgtcctcatcacttgggctgcaacgaatgagaatatattttctttatgttctaattcgtaaatattgagaaaacttgtattataataagtgaatgcacattctctgtaataattggttgtaactctcttgagcaaagacagggatgttatattccattattaaaaaaaagtgaatgcacatatccatctaattataaatatcataactaaaatactggtagctaaagtcatgcatatacagttacataaaaagtataatagccaacttcaattgtaaacatagaaatatgaaaaatgtcatttttatttgattatatgatgagggtttagggtctaggagttctagatgcaggaggaaggaacacaagactacaagagtgtgttagtctaaaacttatttgttaatctgaaatttgtgtagtgttgtactaaccttgttactgatatttaccactccatctgttcacaaatataagtacttagagtattactttatcacccaaccacctttcattatcctcatgtaatatttagccaatattatcctcccacacacccctaatttaatgggtactcccttcgcttcatattataagttgtctgacttttttcttagtcaaatttctttaattttgatcaagattatataaaaatataatagtattttcaacacaaaacatacatattatcaaaatatatttaatattaaatttaataaaattaattagataatttagatgttgctaaatttttctataaaattggtcaaacttaacaagtttgattagaaaaaaaagagaagtgacttataatgaaatggagggagtgcatcatagttccatcctaattttgaaaataaaaaaacttaagttcttttatttgtggagtaagggagcatgttgtaacatgtaatagctattctatagattttgaagtattgaaaattcaaatggtttcatcaattattgttaaacgggttctttagaattactatattatttccacataatacttaggctctgtttaggtccatttggaatagcaaatggtaaatggcaaaagttttggtggcaaaagttttggtattgcaaaagtattagttggtgtttagatgcatcctaaacttttaccattctagcactaaagtgagagagagaaagagagagggagtggtcccaaagcactttttggcacaatttgctactatggactagcaaatgccaaatgccaaattgctaagttttgttactagtgtttagatccaaaatagcaaaaagtgcttcaaaatggcaaaacttttaccattttggaggatctaaacagggcctttaactcata

SEQ ID NO: 53707 - DNA, 982 bp, Oryza sativa
cggatttaattactagggattttagccatgtgttatatttaatcatttagtcatagactaaattaaatcgtataatatttctaggatttcgtccgacatttagctcgcgatagaaatttctaacctattatatggatataatgctcgggtagattaaattaaaaacttaggacaacaaaatatttatacccgcaaaatagtttaggatattaaaactcgaaattgggtttgccttagttcgcgaataatcgactttcgcattcgactttcatttgaatttatttggatttttatttgaattctaaccgaattcaaatcaatttttgcacgtaactatagcgcctgagggagttgcggatccaagcgaaggccaagacccgcaagactttgagcaaggcaagtcatcactattccttgaacatgttgatcccaattgcgaaattattttgtttacaaataaaattgcatgcaatgatgaacatcccacttgtgattatgccatgccttgattattgttaacccttaaatctttgtaaccatgtttacgtatgagtctctattcaactatgacaattgcttagaaatgctattctagaatcatgcatactcatatttatcaaatgctatatgcttgggcaattaccttcgggaaggtaattgagatgcggcatgtggagacatgagcgccacattaccatgatgttgatgacatgatttgtgaaaggagaaataaaattaaaacaactgttttcgactggggcggatggaggatttgggtggtatctggaaaaggctagtaccgtccccagttaattaaggaccgagccatgaagttaagcatgaaacgacccccgtacaaccgtacttctcgaatgggtatagacctaacagattagatagccgagcggaggcagtatccctgcatagatggttcacccctgagtgaggcaggtgcgttacgatgggacagccgttgaggtag

SEQ ID NO: 53708 - DNA, 1446 bp, Oryza sativa
ccgtgcaccacggtctccgcgtccgtcgttcgccgctcccacaaccggtgagccgccctcctttccccttgcgtccaccgccaccgctcgggtgggatagagccgagaaagagagggagagaaaagagagaaaaagaaagagagggagagaaaaagagggaaaatagaaaagaagaaaaggagaaaatagaagggaaattgggggagaaattaggaggatttaggaaataaaaatggtcggggttaatcatagattatttttggaaattcctcgagcgtaatagtatttcggtcgaaattccgagttaattataaaaatatgtttcttgatcaaattagattaaaattggtagtaatttagatataattaataactaaacaattagatgaattcttatagattattatagattatttttggtaatctctataagtcatcggttcacggtagaaattcggatttaattactaggaattttacccgtgtattatatttaattatttagtcatagactaaattaaatcgtataataattctaggattccgtccgatatttagctcgcgatagaaatttctaacctattatatggatataatgctcgggtagattaaattaaaaacttgtgagaacaaaacatttatacccgcaaaatagtttgaatcgaaattgggtttgccctagtacgcgaatagtaaagttaatataaaagaatcgactttcgcgttcgacttccatttggatttatttggatttttatttgaattctaatcgaattcaaatcaatttttgcacgtaactatagagcccgagggagttgcggatccaagcgaaggccaagacccgcaagactttgagcaaggcaagtcatcactattccttgaacatgttgatcccaattgcgaaattattttgtttacaaataaaattgcatgcaatgatgaacatcccacttgtgattatgccatgccttgattattgttaacccttaaatctttgtaaccatatttacgtatgagtctctattcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccaagccatgaagttaagcatgaaacgacccccgtacaaccgtacttctcgaatgggtgtagacctagcggattagatagctgagcggatgcagtatccctgcatagatggttcacccctgagtgaggcaggtgcgctacggtgggacagccattgaggtag

SEQ ID NO: 53709 - DNA, 1501 bp, Oryza sativa
aaacggatgaagtatttattatggacacacacctattatcgtcagtactcggtagctgctatcaaaatttgaatttaaaacttaaaattcttgattatagtcagttttctagtttttcatcctaatcattttaatataatcttttacatgcgtttgtaatacatgaaaattttcttcatctttggtcagtcatgaccataccttggagtggtaatgggccaaggtttatacgcatttcgtatcccatctcaatctttaaatattctttaatcttaaaaatctactaaatttcagtctaaccctttttatccggtccttatattttgtaggtcaaaaaattgggctcgttaccacttctatccatactacgctaggacccatgtatccttaattgatttttttatacgtgcacccaaacacaccacactcgctgattcgcacctccacaaatgcatcctctaacacatgctcaaagaaatgaaaatctaaacggcacatccctggtctaactaaatcatattgaaagtccaactgcatatgcgagtaatattgaatcccgtagaaagatcatcaacatgtgcataatattcatgaacataagatttaaaccctcaaggtatcatgcatccacgatttcaccgcccatgattccaccaccacaccactagtacttacccatccattattgatttctatttgcacacatatacaaatggttaaaaccacaaaggatatctctactaccttaaaagtggagttgttattctttggtcacctcctcccattttgcaccgcccacgcatgcttagtgtactacgtaggtaaccaccggatcaatgttttatcactaatattcttacaacatatggacatgttaatagtctacaaataataggcagtcatacgatcttggatcgacagactagattaaactctagtacggggtaaatgtttgcaaccaattggggtagagctaacttgacatacgatattttacacaattttcattgtctaactaagatagcgtttaattataacagcatcatcatatttttacaactactggcgttgtaatctatacttaattaaaaaatacatgaggctttcgtaacctttgtcgtctttcatcgtctctcagttggccccgctccgtttctcccccctcccccaagcctccatctctctccctcttggatcttattccgtatttttttacaaggattccgttttcttagaagtccaatccattgcacgcatgctgtgcacacctccagctgccgcccgggccaaaccctacaccgctgacacatcaatctgcctccccgtgagtttcctccaattgattgcggattcgcatcgattatgggtgaaacaaaaagaggagatcgagtggatcaaaaacccttaactggttttgggagatcgagaaagattcgtccgaatttgatggggaggatcgactttggcattgtacgggcacaaggctgtcgtccggaggtta

SEQ ID NO: 53710 - DNA, 1501 bp, Oryza sativa
tagtaatctagtatacttaaacaattgatccccactaactgtaatcaataccaattctttgttctctggtgtaatcaatagtaccaattttttgttctatggtgcagccacatcatcttactttatgctaaccgttggatttaacttgtgtgtctagattagctcctaatcaccaagtagcaaccagccatatttgatcttctgttaatgttagaccaagcctagcccatctacacttctttacaccggccggttcctcttctattgtcatgcatgcatgcaaccattacaacagatgatcaattgatctcctgaaactgccttctttcctcttctgaaactgccttctttcccctatgtaatacttctggtcattaagtgatcttcagagattgcagttactttttctatctcttagactataaaaatagttagactattgcataaacttctcacttcaaaccacatattgccctccgctttcccttcaatgttagtacatgtgttctttgtctgacttttatattatatatgcatcaattcgatcacacgataccattgatttggtgagttagtctcagattttaaagatgttctgtttttctccccatttgagattgctcgtgggtgtttttctttggcaaattggttgcttgattttattttgtgcggttactcattttgcttaagtgcaacacactctatcaagtaggtttacattttggtacgaacatttgggtctgtcccatgcaattcattttaattttgaatttactatatttttcaaccattcttacatgtttacaacggtcaacgatattattatggtagtttgccttttaccgcattaatggctaatgcactaaactttgacagggaattttttgtttaatctgtaatgatgtggatatgaaaaggatatatgaaaggacaagaatcagctagccctaacgaagaacatgggttatatagatcacagatttgttatccacaatcaattttgtttctttggtacggagtatgttttttcatttagtgtacaatattgagtgttgtggagcataattaatatttttccatatgttcatcctatagtgccgcagcaacacacatggcttttgactagatttaacttacaacttaacaccgatcaagatacataattaggtctatttcctaatgtcaattaatcgagagtgctaaccgaattataaccaaattaatttcggttggttgaagagcctaacaaaaatttctgtctatgagcaagttttatagaagaggcaaatgccacccctaattttatccatgtaagttaagttgtaactcctactctctcttttcttctcccctccaccttaccatattagtttagatagcatattacttgctctaataagagcatctccaacaaaattggctatttttgtggaagagggtattaacctgtaggctgtaggagtcggtgtggattgggcgacgatggcagggctcttgatga

SEQ ID NO: 53711 - DNA, 239 bp, Oryza sativa
acaacggcgacatacggccgtgatccaatcggagcatccgactttgccgcgcacgggaccacgtcccgccctccgggagccagctcgtcgatgtcgttgtcctctcttcctcgagccaatcgttgtcttcttccccaccgaggctctgcactgctcgtgcctgttgaagggtttctttccacccatgccgccgcgtgcctccggtctgccctctgatgtcttctccgctgctcttcagg

SEQ ID NO: 53712 - DNA, 1501 bp, Oryza sativa
aataaataccaagaacattccaacaattctgtgtaaacgagcattgaaaaaagagatggatcaagtcttccatagaattaactggaaagagcacataacttagatcacagtcaggaggagcacaatgcttatgacccaacatatattttgtatttagtctattcatcaatagcaaccacccaaagactttaactttcgaaattgccttgcactaccataatcagagaaaataagaaggtggctgcatagctctaattaaagttcaaagcataggatttctgagaagaatacttcaaattaccccaaatgtattcccagacatctctatcatgagacagattcacatcatttaaaatgactaacaaatagttcagctcttgaaaagcttaatgagagaggggtaaatgaaagttatcctcaatatacgtagagagaaagttatgcaaacctttttcaccctcgctttcatatcaactacttcctccgtttcacaatgtaagtcattctatcattttctatattcatatagttgttaataaatttagacataaatcatatagttgttaataaatctagaattattaacaactatatgaatgtgagaaatgctagcatgacttacatcgtgaaacagagtgagtatattttagagtaagaaccacgtgatttcatgtcctcgaaaaaaaaaagaagaaaatccacatgctaacatgccaagttcaaaagagacgtacacttgcacatacattacatttcttttctttagaaaacaacattactacattcttttcatatgccctatacattgctccaactcctgtgtagcgttgtttgctccgctagccaccacacacacacacacacacacaaattaaaagaagaaaaaaaaacgcctcaaaatgtactccctccataaagtaaatgtagttttataccggtttattgtgctaacatttggaccggttcgctatccccctttcattttctccgtttatgtctaacatttgaccgttcgtctttcttgaaatttttttatgattagtattttttattattagataataaaatattaatagcactttatgtgtaactattttttaaaaaaaaatttctataaattttttaaataagacggacggttaaacgttggatacgaataccactgctgacggcggacacctcagccgatgcagagatctccgcacgaatctccacgcctccttatccccgacccaaacatcgtctggctcgcacccgcacccgtaccaaccccgaccgagcgagccgcatacgcattccgtcgaacacctcacccgcacccaccaccaccaacctcccaccccacaacccacatccatgtgcacgcgcgccctcctctcctcctccgctatatatcccctcctctccacccctccccaccactcccctctcctcccgcctcgccgccgcaaccaccgccgcctcgccgcagcatcacccgcagccgccgccgccgccgcca

SEQ ID NO: 53713 - DNA, 1501 bp, Oryza sativa
tggctaagcattttttacataaaaccctaccgttgggggcatgttgtatcctacaacccatatttctttgctctcctcctgccaccggttacatgacctcattccctatttccacaatgaggatgcacttctctgtgctctccgcatcgtcgctaggcgtgaagtattggcgccaacctagcatatttcctgtcatttctctgccctagcccaacagcgcagtacgtgatttaatcgatgcctaatgaatgatcaaggagacctatatgaagggagaagagaagcctgttctgaacttcgcagcaggtaataattcttttcccccacttatttaatgcagatttggctatcttaacaaaccataattgtctatatggatgatggatttgaaatttcccctctaattgcaagtactatgctataaaagtacttattatttatgttacgtagcatccactaagctatatactctgaagacatccaaataatctaccatatcttaccatcctaaaaaattggtgattttctagaaacttttgcacataacaatatataagaatatttggcattggtagcaaaccaagtaaaacccacacacttcaatcctaccaaattttggtgttgaaaggttaattctagcatcaaactgaacaaacccttaatcttttaagttgtactctctatggtcataaatatttgatggtacgaagatatcatcaaagttttgaaatttggccatcaattcatattacatctaataatttttaatgttatttaatattttttaatataatatgcttataccattttttttaagaactatgcactttgagaagttattgataacataagccttaaaagttcgccctaacctattctaaatatcaaatattttattatcactaaagagaataatatgtaattataataattttcattatttactcaattaataaacaatatgaaaacaaattctattacttaccattctggccctattgtcccatatttccgtaacacaattttaccggtataattttcatgcaataattccacccatctccagcctatatagaggttaaaaaaaaggggaatatttgcccaaccctagtaaaacgtacaaaaaaaaagcacaatatcaaacggagtctattattcctattccaagtacaaatagagtggtattatttcccttcttcttcttttattcggcaacggattctatgggctcggccggccccacccagcgtgcggcccggaccatcacacccaatcgtggccgtccacacctccgcatccgacggctcctccgccctccacgtgtccccacgcagccctcgccctcccatttctcctatataataatatcccccacctccccacccacccccaatccaacccccaatctcgccgcaatccccatcgccgccgctgcgaaagctagggtttcgtgcgattcacctcctcggcgacgaccgagaccgcgagcgatttcggaggg

SEQ ID NO: 53714 - DNA, 1501 bp, Oryza sativa
atcgccgctatggaccgccatgccgccaccgtggaccgacgcctcatcgctgtcaccgagccctgcaccgagctgccgctaggagagccgcctggatcaggatcgttctagggttagggttagaaattttcactgtttcatctctctttttcttttaccataaaaactgggtatattctgcactgaggggaaaatggtcattgttaaaaaaaaataacggttgtaatggtgttgaattgacggtgatggtatttttgggagaaagaggcttgtgcaatggcatttctagaaactaggaagttgcttttatcgatggcattaatatctcgatgggcaactgaacaccagatggaaatggaaaatgcttcgtgtcgcgcgtccgacgggaagacaaacatcggacgccagcttcctcctctatactagtctaaaattgatttacctttcctggtgtttttcctggtttctctttccaagttacttttactcagccgtatgcatgcacaacttgcatgcaagtatataggaacatgcaaattgagacatgatctttaaaactatttttcttccaaactaattatgcgattcatgatccgattattgtggtatatttgttgttattaaatcttgcatgattatattctgacgaaaaaaatatatatgtttctactgttaaaattcagtgtttcactcaatgagaaacaaatgtttcaattagatatggactatgttgcactttaaagtttttttttgttgcaatgggtttttgaaatgtcacatatagctgttgttgcaataagcatttcatgatgtttcagtagttttttatatcaaaatatagccatatgagatcttgttataaagattttattataacaaatctaatgatgcaatcaaattacatatcaaatatatattttaagagaaaagagttcaaagaataaaaatatatgtgtacattataatatagtgctagtagccgtacatgctgcatacacaggctagcacatgtagctgcatgctcttgcgctttaaatgtagtgctaggtgcgctgctactaagggctgtgagaggcggccgatatttcgttttttattagacgtccgatgggtaacctcctccgatggaaattggagacacttgaaccagctaaggagtctctctgttgtggtctttaaccaaagcaggattatacctcctcggtgcccatggcccatggcccatgggaaaccacgcagccacgcaggtggttgcgaaggttggtgggggttcggaattttcttctccgacccccgtcagtcgtaatccgttcggctacgaatcgagatttcgatggcgagtaaggaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggcc

SEQ ID NO: 53715 - DNA, 190 bp, Oryza sativa
acttttataatgtttgtaagacgtggatctgtatgtcgactttgtcgtttgtgtaccccggccggtcctcgacgggggttttaatgcacattttgcttggaattctattcgggaatttctgggcgtgacatcctgttttttagacagcacagttaattaattagtgacaagtgtatttttatattgtagc

SEQ ID NO: 53716 - DNA, 1501 bp, Oryza sativa
ataagtggtttgcaagtcatcataaaactttgaactttagagcttgcttatttgagacacggttatacaattttaaattttagagaataattttagcattaatataaggttttttttgtcctttttaattgtcatttggcattggctttagaccgccaaaaaaaggcacaaaagttttacactaaaattgcttcatccgtcaaccgagagagatgtgagagttgaagggatagcagggagaactcaccaatgactacgacaatgacttcctatgtgagcctctagatgtcgttggcatatgaactctggcaaagcatgtatcaccaggttaggttttcagggttggtcgatagaggggcaacaagggtggcttttgagtaaactctgaggtggctgaggaccaacgttagatggtggagatacgaggacgagcgatggcactgaaattgtagagatggaagagagcagtgaatgaggttggaaggaggggcaaagaatgcaatgtggttaggaggaatgcggcaatagttgctaagcagcgaggagagaatcgaagtgttgcgatggatggttacagagagtgagaagagttgactagtgttagggttatatgggatgtatgaatagagtaaatcttggcatttaaaaaagtgacttgcatctaaaatatctttagggtaagtgatcaatgtttttctttaccgcagcttgtttttagttggcttaatcatgtatctttgatttataaactgcacccaaaaaataccttccaaaacaacttttatggtgtgtttgaaactaatatatgttatcaacttctactcacttgtttttcacgcgtacactttaggaattgtttaacagtgtgttttttaaaagaaattcataggatagttgatttaaaaaatagctaatatttaattaatatgttaatgagctaatccgttttcgggaccgagcgcaccctaatctccacagagtgacagaggtgcaccgcaaccagtaagtatgagagcatcagcatgcaatttcaagctccagcaaagctgccgtcacggcgtgattctccgtgtctgctgctctgctccacgtattaacgcattgcaaggcacagagaaccctctacctcatttaaaaatctgaattgtgcttctccttttccccttttttttttttagaaaaagataggtccggatttctactcggaatccactaaaatggccattgagcaggagcgcaaacattttcggaatatacgaatccagcgttgcactggcccacccaaagtggggaccaccttactcacacaaatttctttcacagagaatcaccgaaatgcccctgcccataaaccctataaattgactgataagcaacggccatttcagctcagatcagctcaattcagagtgtgtgcctctcgatctagatctctgagttcttgccatctttaatttgaaaccgaaatcatcagctgcaatcttcgagattaattaggaag

SEQ ID NO: 53717 - DNA, 632 bp, Oryza sativa
ggtgggcgcgacgtcatcgctgccagcagctgaggccacccccgccaccactttggctgtgcccacatgacaatacaatcgcaacagggctaaacaaaactacctcggcaatcatacccgtagggtaagacgtcagtgcatcatttgtaggggggggtttgtagggctaacaaaggtatgttattcccataacctacaaaatatatgtgcgactaataggtaggtccaccggtggcgttcgccaaccgaggccaaacaatttaatgtgtaacctatgcaaacaacataattttccacctattggaggcaatattgtcaaaggtggcttgccttggtcctgcggtggttcttcctcatcgagaacaacttccggaccgttctaaggtttggcaactatacgcgtaaaaggagaaaatcaacacaaaagctaataaagtagctaaaacagtgagagatagaacttccattagatagatatcatttttataaaaaatatgaaagttgaacggagtcaaatggagttacggtttgcaagatatgaatttttgaagtttcattgattttttgtacgaaggaaaataagtttcttttattggaaaggaatattccttgcggggcccgctttcaacagc

SEQ ID NO: 53718 - DNA, 1501 bp, Oryza sativa
gatttaggtctttttcgtggggttgactgatcccacagttttttaaaaaacatcctataaaccttaatttttagatataaataaaaaaataaagaaataacgtactccaatataaaccactagtaattgatctcatatgttttaattccccgccactttatacacgaatcgcgccgggtggctgtggattggattaactgaactacggccgtccctgtaacccccgcacgcgcgcgtgtactgttaacttatctacctagctgtagctatttggcttccaactgcaacatggagtgtttgctatgctatggaacgcccaaatatttaaagctgctagctacctatacatattcattcaagtataatgtgtagtactagtactaatgcttatttgttttcttcaattccaaaccttaaatttcttgcttttcaaactgttaaatgatgtatttgttataaaaaaattatatagaggttgtttaaaaaataaaaaaatcattttcaagtttatataattattaatacttaattaataatatcttaatgatatttcccatttcgcgtgcactgaaaaactctctccaacttctggaaagaacgcagcattaagaaacagatataattcaaaaccttagggataaacgcaagctatatattctttttttttaagaacaacgcaagctatatactcgatcagatcatatcaaactaggcggttacgacgttggatatatacttcatatcctagctactcgatctagcggttgaaaacaattcattggcttctgtcggggttaaactgctgaacatccttcgtgctaattactattgtatacatctatatattctacaaattaataaatgtaaacagtgagagtacttctcactcatgcacacacacatatatattttttactacagttagctgtgcacaaagaacacatgtgcaatatagatcaatgaatagccatttcactatggacgaagactggatgcatgacactcgtgatcgactgtttttacatggatatggatcagtcagtaatttcttctcgttgtataataactagggataaaacgaaactaaagtgaaacttaacgggcattgccaggggtagagtcgtaaataaaaagatgggcagcagcagcaggagagagagagagagagaggtcagcattggagtgggcagaagtagtacgccagacattgggtacactagcatctccgtggtgggcccttgtgttccccggcccatcaacctctctctctctctcgatcgccttcgccttcacttcacacgcccaaactgtgaagctaagctaagcttctccgcttctccatctcattgccctgtagctttcgcctccctcttccagctagcgttgcttgtttccatttcctctctctctctctctctctccagctagcctatctctctctatatcaatctcgatctccatgccattgcactcgagcaggctcagctacctccttataaac

SEQ ID NO: 53719 - DNA, 648 bp, Oryza sativa
ctttcttttaatgcttgtcctctcgatcgtaacgatatcgcgagctggatttgcccgcggctatgtggtgtgtaatagtagtggaatgtaaggctaggaattcatgtgtgggttgggatctgcattgggatttgttggtttggagtgcctgcgttgctactgattcagagttgttttagagctttcccctggatagggttttgaattcctgtttcttttgcaaggagtcgagtatgggtttcaggtaggactacttctgcggggatgggtttagacaaaccgagtgcagttcagcttcatgatatgcggattgatttggttgtatatgtgctgcttatttcaaagactctggttttgtctgagtccatcggacataagggctttggatttctatattaggcaattaggcatgttcatactgttacgcataaggccataagtacaataattgatttcgtatacatatttgagcaggctgatggtgattttattattcatcattgttcccattgtgaagattagctcttttgtttgacctgcctgccttgtgctagcctcattctttgcacttggtgtgtttcccaacatctttaccacatttaacatgaaatgatcctagaacgcaaatgaagattaacctactagtcc

SEQ ID NO: 53720 - DNA, 1501 bp, Oryza sativa
ttccgttctcatctctttgggctgtgtttcatatggttagaataagtctattttatccctcttctctttgggccatatcttatatgaatgaattaagtctaatttagatccctcgactatttttctttgaccatgccgtgtcggaccggctcaccgtgccaaggcatcgccctaggcacggcccaactgtcgggtcgggctggcacgggtccgacaccaatcgtgctgtgcttgtgcttcaaataaccgtgccgtggaccgggccgtcgggcctcggagcttatggccatcgtcttcttgttcgattcaaactcttcgtgctctgcccgcacggttccataccctactcgttgtgttgttcttcttctacgtacgtcttcgatgcaatgcatcggtgatcgtcgaagctcgaaggaccttgtgtgattccggacggcgacctctatggatttgttcctgtttcaagggccatggacaaggtcgatgtaccggctgtcggtgtttgaaaatgacacagttggacatggcccatggacaagtggactttgacacagatttgtgttgcaatattcggcaaacatagctagcttactgtaaatgtgtaataaatcatatcgatttacttatagtccgtatgatcgtcgccgaggtctgccgtgacgacgtcgacgaggaagtcgaagagatcggtgttctgcacggcggcggcgacgtcctccttgtgcacagtccggcgcttgccctcgagcgtggcggcccaggcgcggcgcgtcagctcggcgatgaacagctcgcacgccttggagaacaccaccggcgcctccccggagatcatcctcgccccgccgccgccgccgccgccgccgtcgacgacgctgctgtcccccgccgaccgcttcatgatcttcttgatgcgagccagcggcagcgcgtgcggcccagtccgcgccgacacgccgccggcgaacatcgccgagtagggcctcgcctgcctcatctcgcctccttaattactggttaaccaatggtgcaatccgctgccggagacggtaacgatggaatggatatttatacgcggccatgcatttgactttgcgaggagcgtgcgtcgccggcggaggccggcaaatggaggaggccggccgttttgacagtgatcggtactttgcagagattatgaaatttaacaaagtacgagatgtttaattaggaacataggattgtgtacgttgctttcacttgcactgtgcagtcaaatttttggcccttgttgcttgcatccttgtgttgcatcattgcttgctagcttctcctagcctccttgtgttagtgcacatgtcattcggatggtgagttattttctaatcaaagatctagaggctagctatgtggcgcgtttaccagtattcgaacaaatattttttagattatttaccaatagaacattggtatagtcgttgatacaaacaagctatttttgattgaaattattgttactgtt

SEQ ID NO: 53721 - DNA, 400 bp, Oryza sativa
tttgtttgttgtgtatcccacagatttgtcagaggtaggcggcaggtggtgacagccctgaatcccgtccaagtaatcctaatcctccacgttcggatacatcatagagctatagccgaaacaatgctagcagactagcaggggtcggcacccgaagcaacaaataggaaattacctttgcttagcttagataattaaaactcatagaaaatcctctctaacctagcctacctaccatcagttgaaaaattacctttgcttagtttagataattaaaactcatagaaagtcatctctagcctagcctacctaccatcagttgttgtccttggatagtcttagccttaggtagattacacacgttccctgagttcgatatcttttttgggtcacccgaagg

SEQ ID NO: 53722 - DNA, 1501 bp, Oryza sativa
gacaggttgatgtgatggaaaagaactgaagtttggatctaaattttagatctaaacacagcctgaatcttttctcttctttggaagctgtctgaatcttgaattgcacgtgaacattattagctgtaaggctcctttcgtttcacccatttctgatacgttgagattaacgttaagagtgggtcccttgatttgcaaaccatatatgcagaattggaattggattcgatcgatcctaccaaaaattgtggtgtctcatgagattaaccatggctgccatgcaagcagcaggaccatggtgtgatagtaggcaacaacctggacccaaatttgcaggtgactaccaaacaaaaaaaaaagccactgttacttaatttgtttccaattctctttcagcggctgatcgatgccattgtcaaccaataatttctgaactgagatttttcttttctgcaacacgaccatgcattcgaattagaagaagagacatgaagaacatggagtatataagtccaagtgcaagaggacaagagtcaagacaaactaattactgaaactgccgagctgtcttcactccctccaccgctattactgcagcagctacgtctcatccttatccttcctctgtttacaaaaaatctaaggctcggtattattacagcggattatatgttctattatagcgataaattattttttgtaaaaaaaattaaaataagttatctaagtttttttaagaaaatgaattttcaaagcgtagagtaaatactatgtttagtaatttagtgaataaactaaaaagagcatgacttaaacacacgtccaagatgtaccatgtagcagcagcattctagcaatataaaccatcttaagttcttaacagtatttcagctaacggtattgtttttgtgttacccaatattaaatctgttgtagcctagttatcacaccatatgctgtaaaaataacatgaccttttttattatatcttgctaagtcaccgcactgtaattaagagagaatccaagaacgcagagaaaatggagggaccacatgaaaaaacaaagggaggacacagcgttgaacggtcagaaacaccacacccatttctgaagaaccccaaaataagcttctcctaaagaagttaaaaaatatataggcaaagagagttaagagacactgcaaacagcacaagagcagatcaaaaaaatgctgctaatgacattctataaccagtggctagtcttaaaataaaaggaagatgctccctaacccctaaattttcttttgagatgcttaatctctaacactaatgctaatactcagtaagtggtgggggtaatttgttaattaattgagtggtacttaattgacaaattaatagtgcgcgtgataactaatcggccaccgcctccccccacccttgccattttaattgctcgcactaaattagcccaacattctcctcgcttcctcctctttctctctctacgccctcgtc

SEQ ID NO: 53723 - DNA, 559 bp, Oryza sativa
tttatcaatccaaatatatgtctgacggcctagtcttaaaaggtgctcgtgtgtatatcatctacattgtgtttcacaaacaaaaaatatagcaaaattattgtcgttacttacccatgttccaaaataaatggattcctagcatccagaaaaagtataaggtgaggattaataaaggaaaaacaaaatgctctgaattaataggaaagtagtgctgaacttgtcggttaacagagaatacatctgttcatctaatttcactttttattctttccattctatagaattttaggtattttcctcgtttgaagtaaacattctagattgtatttatttggaggctttcgattgtcctaacacaatccttgctgctgctatatttttttccatttaatttcactattttttctaattttctagaaacacatgatgctaacatgaagtgactttccctcatttgagtaattgtagttgattgcataatcctattatttttagtttttctccttttctttttattactattattttgttctatactggctctatacacttcagt

SEQ ID NO: 53724 - DNA, 1501 bp, Oryza sativa
cctccacctccaccgccgcgctcctctccgctcctaggattgttcttttttttaaaaaaatatacatttttggccccttctacagcttcttccctttgaattttttttcgaaaccgaactcttccatcaattccttcattgcttcttttactcgctttctgaaacaaacaagagtgtaggtgtatcagttgtgtgccattctcgtctcttctccgcgacgcgttcgctttctctcccacccaaaacccccagagagggaagagaaacgcctccctcccctctcctcccccgacccaccctgcacctccttcctcgtcgacgccatggcagcaccggagtgaagcagccagccagccgcccggatttcaccatttggtcccgggtttcgcccggatctgggtctctcttcaaccgtcttctccaatctggcggtgctatagctcgccgcgcccggttggggacaaggcccagtaggcgctagccaaacagtgttgagcgcctcctcccctcctcgcgcctcggcgcacggccggcgagaaggttttgaggggcggcgagcttcttcaatctgcctccatctcggtttgaatcggtatgcatatactagcatctccctgtagactgtagtaatacgaaattgtactagtagtttatgtatgcgtcgccgtcggtttgatctccagaaccatcgctgtcagcgagtagcattagcacttactgcgagcttatggtccctggggatctagtattagtttgtggatttctccatttgatgttgacatgctacagtatctccttcgcccatcatactactagaagcgtttctttttgcgcttttgtcgaatggaaaagatttgtagtttttttatgtgtaaatcaagtttgatttttattttttgttcacctgcatctgttatgaaaaattgttgtttttcccttgttgatgctacagatgttctatgactgcatcatcaggttcataagtcctgcttctaatcaatggtgctaacagatgtttctgttttgtacagagtggtgtagcaaataacatcattttcggaggcaatggcggcatataagttgggtgtggaggttgcaagtgctcatgacctgatgcccaaggatgggcaaggttcagcaagtgcctgtgtcgagcttacgtttgatggccagcggttccgcacggctatcaaggacaaggatctgaacccagtgtggaatgagcgcttctacttcaacgtttcggatccgtctaatcttcctgagcttgcgcttgaagcgtacgtctacaacatcaacagatccattgatggttcaaggtccttccttggcaaggtcagaattgctggaacctcattcgtgccattccctgatgcggttgtcatgcattatccactggagaagcgtgggatgttctcacgtgtgaaaggggaactgggtctgaaagtatacattaccaatgacccatccatcaaagcttcaaaccctctcccagcaatgg

SEQ ID NO: 53725 - DNA, 683 bp, Oryza sativa
agatgaacagtatacgggacgcaattagactttcgtcttgggctggctgaaaaacaaaggaaagaaagaaagagaaggggagctcggctgggccgacttgggctgcacagcacgcgcgcgaaggagagagatgttgggctgaaatcagcccaacggcttaggagaggatttaacaactttccaattaaaataatcactgaaatgatctttgaattgttaaaaatacttccaatgctcaaatagtttcaagaaaaatcctgaaaatacttggacactcaaagtacttaaaaaaattataagcagaccatttaatgattaatttaatatgtgaataattactgaaatgttctttgtatggttaaaattaagagttgagctccgaaaaatccgaaaaaattccagagaatataattaaccatggagaatttaatagaaattaaatccagccatgctttttatttagaaaattttatttcccacatttaacttctcttgtaaattaatgaacatttaatataacttctaataataatttattaaataatttataaatcctgaaacgaaaatcaggatgtgacaggaggggagtgagaatgacatgttgggcccacgcggacccctccattttaattattttttgttgtaactgacatgtgggcctacaatttttattattttccaga

SEQ ID NO: 53726 - DNA, 1501 bp, Oryza sativa
catcaacctgtatgtatgtattttgtgtagatccaaaacaattcaaagattgtaacaacaactttggcggcgatcaaagtttgtatgcatgctgtagttgctcatgcagtactagaccccctcaaaagaagagatgaaaacagctgcgtctgatttgggggggacgaagattgacaacagaagtagagcatcactgtctttttgatgcaaattctggcacttcggtggtaacggttttaaccgaaaaatgatgaagtgccagagattaacatttgattagtgcttttggccactcatggcgcagttcatttcacactttgttgtggattagtagtactccctccggtttcattttaattgacgttttggacaatggcacagtctacaaaatgtacctttgaccttatttttctattataatatacacaataaataaatgcatgtttacttttataatagtgttttgaaagacaaatctatatatgtttatctagttttttttaaactaagtagttttgaagttattgatggtcaaagttattaaagtttgacctcaaccttgttcaaaacgtcaattattatagaaccggagggagtaattaatttcactttcttgctcacctggctttaccattcttctgtcggagtttggattgcaacctgaagattggccgagctgtatacgacatacctacatgcaaatatgcacaaaacacatacttgagagctatagatctaattgttgactatatccattgctaaataactcccaaacaacatactccaagcacattggagaatccgataatttcctcaacagagccccgtgtggccatattggaaattccgaagtgtatatcagaattccgattttttctttttgtccaactaaaccacttgtgtgaccatatcacaaattccgatattttcttcaacagagctacagaacgtcattttagatattccgacataacattggaaattctgatctattgaaaattccagcaacttgaaagttttgaaaggaactctgcaacatatttgagcaccaaattttcaacgctagatttcgaagtgatatcactctttatagtagagcttttcctatgacacaaataagagaaaaaatttaccataggagtttttcccatacacttttcatttccaattggatttgctgaaaccaatctttccataccatcaaagggctaaattcactgtgcacattctcaacaaacttgttagtcctccctattcgattgccattaactaccaaaataattaggggtctagacgcactttcaatctccctttttttttgtcgatcacaattcgattagaatgtaataaaaagatatatgtaaaaagggttttgggtccaatgatagaagtttagctcccctagaattgtgcataataggcatgtagagagctcccctaaatcttcacataagattgcttgaaagtatatatacatgacatagcagcattcacacatatg

SEQ ID NO: 53727 - DNA, 1501 bp, Oryza sativa
aggacgaaaacatatttaacacagtttttgagaattcaaatttgaaacagtaaattcgagtagaatttagttcaaatttagcaaaatttgcctaaacttatcccgcggtcgctcgtccctaaaccaaaaaagggtaaaacactgctagatagaaaacaaaaagaaaagaataaacgtgagaccaaatgggctgggaaaaagaaaatttttcaatgggcccataggacggaagaattcttaatgggccgaggcctgagaagaatccgcttctggaagtctcgaggcctctctctctctctctctctctctctctctctctcttctcccccgagttgccgttcaacttccacctcttctctctctctctctctccacacgcgcagctttttgcttctgcaattctctctcctcccaaatcgcgagctcgtcggaagctagggcctcccgctccgatcagatcgccgcgccgccgctgctccaggtatggatggatggttccgttcctccacgagtccgtacgtgcgaatccccccccccctcctgttgctgttagtgttggggtttactcgtgttccgcggcagttttggatcgcgttgctggtagccctctcgatcgtgttagctagtttaggttgctagattttgaagcgatccgagcccgagcagtgtccgcgattgttagggccttcttttttcccatgtggaatattacatggtgaaatgacgcatgatagttgatactcctacttgatagttgatactagctggtcggatggcagtaatgcatggctaactagcaatttccgttgcttgattggtataaaattgatgaagagggaacttctctgcttttttggtaggagtatatggatatggtgtgccagggaaatttttgtagctatacttgctataatggaccataatggataaatgagataaattagttgctgttttgtttcctttaatccctttatgtcattgagcgtgccttttttcggctggtcactatgtttgattctgtagttgatttctgtttaaactttagagttcaaccaatctttcataagtgtatttatttcactatatgatgttaagtaataatagtcctctgtatactttgccatgtgttaagggatcacgttcacatgtgtgtcgtgtgggcgtgtaaccttgtattagaacagatagattagtgctcaagcatgcaggcaaattccaaaaattcagaattgtttggtgtcaggttttcttctatatcctacttattgataaccttgcaatgaaaaaaagctgcatgcctacaatgtgcaggctaattccaaaagtcacattgtatgatgtctggttttcttatagatcctacttattgacgacctaatgatttcgtctaatatatcatataacatagtggtttgtataatgaatatcttttaactgggcagggtacctcaaaaatagaagatgcaaggggggagaggcaggagggatggtttcttcggtt

SEQ ID NO: 53728 - DNA, 1501 bp, Oryza sativa
attttgacttttgtgatcgattgccaagtcagaagcatactgtattcgctactagtaacagtgatgtttatctagtttactatcatttgaactgtggtcaaaccaaacctgcagaaaacgcaagttggatagaataaaattacctgctggtttgttgtagtagcgcacaggcacacagatgccgcatatggagtatattttttatacgaagatttggtccccgcatatcgctcactcgcacgtactgaggctggcagaaagagaaagcgtccgagtctcttttcatcatttcgtctgccaacgcaaacgtgcgtgtgcacgagtcgagaacaaattaactagacttttctcatcatcatcatcatcagatgcaacctgctcctcctacctatagcttccaagttccattccagctcgtatatcagctagctgggagtatgatttatcaggagaaaaaccagtacaagcaaaacaaaaaatataaacatttagtacggcttttatactttttttttgatagatgcggtggccgtgtgtgtgtccagcccggcgacggcacgcagcggccggcgtgcggttactggagcagcacacgaactaccacgaatagtcgcgcttcccggtgttggaaacgcacccaatttggccaacttgcccgtggcgttttactgccaaacagcagagtaggtaattaccgcgcgcgggattaaattcagagctcgtaatcacgacgcaaccaaccccgttgtcccagttacccagtacagcgcaggcatgtcggtataaataaataaataaataaacaaatgatagtaatagttaaataactaattgattaattaataatactccagctgcagcaacggcaacgataatattcccggcgaaataaaccccattcattagcaacggggttgtagcggtattagcgaataatagttgctgcagcggcggccacccagccagccagcctcaaccccaagccctccaaccccaagagaggccgcgccgcgagagagagagagagatccaatccaatccggcccccgtctccccccctcctccacgccgcggcgccgctccggttgcttgctcaggttggagtggtcgcgccgccgccgccgccgccgcgccgcgcctctcgattcggccgcgcgagcagatccgagcacccaacggcggccgctgcgcgcgggggggttcgaattctgcgccgctgccgttgcttcgcgtctcctttctcagggtgtgctgctctgttcgcttcctgcaggggggcgggctgctgatcgaaatgggcgggcgcgtgtccaaggcggtggcctgctgctgctgccgctcgcagcaccatggagtcgtcgtcgagagctcggagaagacgggtgcgtgatatgcttctctgcgccttccagaatgctctatctatccatccatctatctatctttccccctttttctgctgctatttttggagctcgctttcccttttccagaagctgtg

SEQ ID NO: 53729 - DNA, 1501 bp, Oryza sativa
attaatataagtgaggtattgtttgccatctcttttaattcaccgtcattctgcttgtggcaggtgttttggtgtgaacaatcattggacatggaagcagctgttgttcatttgtcaatttggctaggggtttctttaaccttgttctgatttgcacgtgcggaaggtcgtccctcgtccatatgttcatgtaggatgtatatatggaagaaagcgacagcagaggccctgaaagagattgcaaagacattgaaggtgaataagtcctgcagacacgacattgatgggggaagggcaaaacttggtcttggttcctcctacccaagaaaatgggaaaacgaaaaaaaaaaagggattgttatcaaaaggcgttgttgatgtacatgtcaatcttgctggtaggcgtgtaaacttgtacagcaagcgttgtgttttctccaggtcatttttcttttctttttggttttgtttcatatgtgttagcccccattggtatattctagagaaaatcgtggaattcttgtcaggcggaaattggcagtgttgaagggcttggttcatttgcaaatcttggacgggctcatcacccccggtccagtttaatgctgtgctgctcaatttggtactagaatataacggtcaactaaaacctctgatgtgtgcgtccctttgacgagtaaaccggtaatgccgcttgagcttcggtaagaactggagttgctggtggtcactaaagctgggagacggcattgctggtggtggcagcgtgatcgatcgaacggcaaacacaacgaaggtgtagagggcgctgccgcatctaaaaccggactgcgttactgtgttagctcgccacggcgagattggtagccggatcctgcacagacgcgctgcgtaggcttgagtttagtcagtatgacgtgctcgaaattcccccagcatgagaggctcaggaaaccgagaaagctgggagtttttcctagctcggcgctggagccaagcaggacagggtactcctacatccaggcttacggcaatattgcggctgccgctgccagcgcagcgcacaatgcacgcacgaatgaaacaccattctgctgcacttgcaatcgatttcggtacgttactactgacccaaagcttttgtttattccgtgtgtcaacgaacgccactagcgactagtgcatctgttgctactatgcccggccgcttcgcgtagcagttgtcaaccactcttaactcggcaactccgctttatctcgcacactcactctgtccacgaaccacaccaccctacccgctgcacaaacctctgcacaaaacttacctataaatccatctcatctattcatgcagatgcaactcgtgcacagctctcatctcgcagccaaaaccactttactatctcgcagccaacctgtagcaaaagctaatcaaactagctatcaatcatgagctccggcgagcctgccgccgtcagcatccccatccacgaccaccatg

SEQ ID NO: 53730 - DNA, 1501 bp, Oryza sativa
cttatatctccaggatccaagtttctttcagattccgtcagttagctattgtaaccagtcccttggccagacctcacctctggttttatttggagcaaacgaaagtaccaactcaactcaaagatattttggaattcatggctggtaatcaaagaccgattcaagttaagaaattcatttctggattttccagatagtgagcaaaagaaacaatggggcacgacaattgcaggcccatggtaggaagcatagcagaagctgtagtagggccaggagcagtgaagtgagaagcttatctgccctgattctggcagcagcaacaaagtgccagaagtccaggagtgggtgagaaaggagaggtgggaagtgggaatttctggccatggtggtgctgctcagccagaaaccttagtggtgctgaccagcgatgaaagtatggaactaatgtgctttgtgatcatattatccatggaagctacaagaatgaaaccacaccctttcctctcattaatttctgtatgttccttttaaatatgcatatgcattgatgtttaggtgtatgagtatttttttgggaaaatgacctatctgcatatcactgcattgcatatctgtacagtatcggagtatctgggaaacacagatgatgaagttacttgatctgtggatacaactttgtatcatcgaggatggtgtcaaggaaatgaggaagagaaaaaataagcatatcgctgttatcgggccacaccaccctgtggactaaaatggaggcggttttagctcagggatgtaatttgcacctgttttgatatttggaagacctgtgataaatggttctaaagtttaagggtgaaatactgaaacgtaaaattagactacaagaggagttgagggaccagagatagatgtattcataatttttattttttctatctccccttctgatctgatttttcctgttttttgcaggagtgtggctttaaaccatcaataatctcttatgggtgccttcttaatttgtatgtcaaggtaaaagtaattctgttgcgtgctttcttgtcagttttcctgtaattttgtgtgttcccttagtagaaggaaacaaaaaattgtgcatcccagacaagtgtttttttccctcgtaaattatgatgtttaaacactcctttctgcaccattgatttctattcgttatatgactagtattctgaatatctaagagtccttggattcacctttttctgaaagcctaaggcaagggaagctttatgtcgagtttcttatacattgaacatgacaatcttcaactttgaaactcaaacctgcccctttattattaattgtaagataggttacttgagacaactcttaacagtgatcactgatgttgctctggtttcttttcttttctcttttcagataggtaaggttgccaaagcattatctattagcaaagaaatggagtcttgtggcatcaaacataataataaaacatactcta

SEQ ID NO: 53731 - DNA, 1501 bp, Oryza sativa
tgttgatttcggccatgatttgaatgccaccgtgacgaggcattgaagccagtggcccagggatttgattactcttcttgcaggttgacgatctactgtgccacactgccgctgcaggggtagagggtagtgtgtttgatgatgagagaattgagaggtcagaggaggcgcttcagctctggcattaaactctgacgaacatgcatgttcagattcagagtgcagagtccactagtatttcggaatgtaaaaaacattaagcccagtttagtttcaaactttttcttcaaactttcaactttttcatcacatcaaaactttcctacacatacaaacttttaacttttccgtcacatcgttccaattttaaccaaacttttaattttagcgtgaactaaacacaccctaaatcccctcgaaattttggtgaaaacttttggattttgaacacattattgacaaattcaggggaagaaaagtaggaacttatctagctggaaacacattgttagcaactttttgtgacaagtcaacgagcacgattgtagcacctaacgctttgcggtgatcttaaagtcgccaaacacctcaatctagcaaaagctaaatcaagatgggttttgataaactaaactggctagcaaagccgatttagatgaaactatggataactacctgtctcgtgagcaaaatggaaggtttttaggacaaatctacaaagaggtgtcgcactctcgcagcgacagcggatgatttacagcgcaaatcgacaaagatggatagactaaactataactagaagtaaaagaacgattcgattgattgatagttgattgtgtgtttacaattgaaccggccttttcccttacatagggggtggtcttgtcctctacaggctctcctccaatccaactcaggatagaatccaaaggaaacccgaaacatgccttctcgagtaaagaaacctcgagacccgacgaaacggattcggacttggactctgccgatcagaccggccaccagtctgaccggcctactggtggcggtcagaccggcctacccaaaggaaaaccggcagaactccaaactttggcaattttccctattctattcctaggtgtcaaatttaggtgtaaacacacatcctacccaaacccacgtatatataaacccaaaattttgggaatttcgattggacggagagcgttcagtagttgatgaactgggaatttccacatgttctgaattgaacccatgacgccacatcaaattttgatttaaatttcaatggcaaattgttagcccttgattgagtggctggtgctccacgtttcccgccaaaacgtgcaacgcggcgcgcgccatcatgcacggatcgcgtggccaatgggaaatttttccccgtttccttcggatcgcgcgcggccactccaccggactccccgagctcgctagctcctccggccacccatgtcgctggcgccgccggccgccagggtgc

SEQ ID NO: 53732 - DNA, 1501 bp, Oryza sativa
tactctatccgtattttaatgtatgatgccgttaactttttgataaacgtttgacctttcatcttattcaaaaaaaattatgtaattatcatttattttattgtgacttgatctatcatcaaatattctttaagtatgacataaatatttttatatttgcataaaaaatttgattaagacgaatggtcaaacgttagttaaaaaatcaacggcgtcatacattaaaatacggagggagtagtattttattgttattaggtaataaaaataaataataatatatgtgcgacttatggtttttttattttttacaaaatatgtttttttattttaaataaaacaaataattaaatttaaacacgaaaacttatctctacgtttaaaatgtgacgaaggaaatatagctctagtagtgccgagcccaacgcaagcagccgaatcaaacgtgaagatgcagtaccactgcactgcacagaagccccagcgtagtactcctgcattgtgcagctactgcatcctgcattgctacgcgcggctagtaggaaaggaaagggaacacagcacagcacagcaaggatcaatccacgtctcatctgcatgcctcgggatttcatacaatttggatccaccactgtagtaccgtactatacactactactagtagtacacagctttctgacaaaagcttcagcgttgcatatgcgtccagatgagacgaccctactctaatgaggaggagtacttaattgctaatgatccagttttcgaaattaagggggcgtgcatatcccatcgctgtcgtcaattaaaacatgcaatcctcttttgtctctttcccacttgtacatcacccttcacctccacgatcaagtttttctgatttaggcccactttgattcaaatgaaattcataggaattttagaggattctatttctataaaaaaattttctatatagctctttgaatcaaatgaatgaatcctataaaatcctgtgaaattcctatggaatgcctaaacacatgcaagttttagagaaaatctagcatgaggttctacctcatggaaactttcctatgagtcttcaggcccctttgaaacacaggataggaaaaacacgggaataggaaaaatgtaggaattaaattggtatgttttcctaatcctacaggaatgaaaaacacaggaaatatgaagagggtccctttgatagcaccataggaaacaaacaaagcaaaagatagtttctaagaggttgaacctcttgcttattttcctatgaaattgagctacaggaatacaatcataaggaaaatttcctatactttcctatgaatcaaagggtttcataggaaaaattccttaggaaattaaatcctccaaaattcgtatgataatcctccaattcaaaggggcccttcatatctcctttaggccccctttgaatcgcaggattgagaaaacgtaggaatatgaaaaacgtaggattttgataggaatg

SEQ ID NO: 53733 - DNA, 1501 bp, Oryza sativa
cgtaaaaggtttccgactttcggagagagccttttgcaacgtattatgatagtgggatatgcacataaaccaaacagatgcgatagcactagttgcaggatggatgttcatgccgatggtctgaatacgtgtccgctgctttcaggactacatgtccttttctactgcaggtattacaacaatgatataggaaatattgtgattcatagcttatacttagtccgcttatgcgaatatttggtacttcgtgctgccaattcatcaatcatcaaatgcaatgctagcattgtcctcgtggacttctgaagatgatttagtgagttctattggagttcacgtgatcttgccggatcagttttggcaaagacacggtgtctaagagacactggatgtttgctgcttcggaagcgcatttatccatatagtaccaaatgggagccacatatattcttcgcaatccggttcaaggatgttagaactatatgcagtttatgcattgatctcctgtcggtgcattcttgcacacaaatcttcatgatttagaaaaattatgcatatatgtgctatgaccatacgagttgtaatatttattcttataattctaagaccgaaaatagctgaaaatccattgctaaaagggtgtagcccaaatcatcacactttttagagagttcaaaggggttgacggacaatatatgcttctataaagtgcatgattgttccataggtaatatgactgtggcgcattctaggccgacaaattcagttcttgctgctagcaacagtcataatatttccagttctatgggtctggaaataactctttctcttaaagtgttatttgtggttatgcggaccacaattcatttttcttttatgtttggacactacacaaaattcaaagcattataactatgtgctagaaaggagcaacaaaatagtaaatgccttaaatatgctattttatactggaaataattctctattgcagggaaaatgtgtgctctgcttgggcaagaaccatttattcgatgcaatgctctattcaaaaattgcaacaattgatgacgaagtgtattgattcaacaaagtattctggtacatcggattcaattaacttcatagcgagcttcttgctcaacagctatggcactctgacataaatttcagggcttatcctatctagcataggagattctatgcccatagtcatgaaaataggctaggagctctccccctcaattcatgatgagtgtgctattaggattgtccttttctttttcatgttcatagattattcaccttgacatgtgttttactccccccttgtcctcttttctcattgaggtaagtgcaccgggctagctgctcgtgttgaattcattatcaactgtgctagttggttttggaagataatgctcttgtagtgaacattatcctaaacgttacgcaattctattatcgactagttaggcatacttctttgtatgtacactagtga

SEQ ID NO: 53734 - DNA, 1501 bp, Oryza sativa
ctggtggttcattgacaatttcttgaataaactgtttagtatacggccttactgtgcttgggatggcaatttgcttggtgtatatgatgaaatcaaatcaaaggtccaaacagtaaggcagcaatatgaatgaaggttgtaacatgacaaaatgcctgaacaatcattctgccaaatttttgctgcaccagaccttcagaaatcagaactggtgcttccctttgccctttctctgggactgacattatcattcagctaatgataaatatacatagtaggcaaaacaaggatgacgcataagcactttcccttttcctttaaccaaagaagcaaagcaaagtaaagatgacataatagtaactgaaacctcaactgttagagttgtggaccgaggaatgtatagttagaaccccaaaagagaaaaatgttaatgacagagacatgcaaaaaccatatgtctgacaggccaatacatacatacatacatgctgctagctagttacttactatcatatgacagactctgatcatgaccacgttctccacaagtggctaggttaccttgagtctctgccatcatggcttgctgatcagctcatccccatcaccattctccggtccaatggcgttgtgccgctccgacgggccggacggcgggatcagcttggcccgcggcaggtagccgaagagcctccccgacctcatcatcgccgtcggcgccgtggaaggcgtcctgttgatgtagctcgcctgcatggttcttgcaccgtcgacgcagcttgcgacgaatgtggcggcgaggaggaagaggagcgcgatggctatgcatctgcgcagctgagccattgattgatgatagtatctttttgatagtttgggactgcacagtttgaaaggctgatgcagatgaggttgcaagagctggtttgggaaggaatggaaggggaagtgcagagtatgcgtgagcaagatgacaatggtgccatatatatgctgcaagtctacagagagaggaggcgaaggtgagggtgaagtcgccatactcgtacggcggctagcttgatgggacgagagagatgtgtggtctggaacgtgaggtaaaaattcagaagaatgagaaagtagtaccaagcatgcgtgtgcaagaatctggataatctgatcctggagaggataaaaagggtgctagcttatcgcaaggagtagactaattaattagagtaattaagtatggcgtgaatgaagtaagcactgcacgcggaatcctaacagaatgttgaacagttgaaaagtggggaattcattggtgagcagctagtcctaaacaggatatgtactccatgtactgctgtgttgtgctgttcgatcagcctgcacaccttttgggccctgcgtttcaacctgcaggtacaccattcggattaactgtgtacagcattcgcttgctttgtatcggtacaccggttaaaattacacagtggaatcaagaatgaaatatcgg

SEQ ID NO: 53735 - DNA, 674 bp, Oryza sativa
atatttaacttctacatagttttaaagatactattttaattaataatatctataaaagtaagatgttttaaataaaaagagttgcatattatgatatatttttaatgataaatctaataacatcatttttacattattgattttatttattttttctattaataatcaaagttaaaaatgtttgacttgtcactattctaaaaatgcttatattttgggatagagggaatatgtgttacgtgataccatgaaaatatggtaattagctgctgaacatcaaacacattattttatatccgatataaatgaagaaagaaatagcgtggaaagtaccaatttgctcatgcgtccatcggtttgtaaggtgattgggtcttgttcgaaccagatctagatgattcttactcccatgatcgatctaagtggcggagccaacaattgatcacgtctagggccgagcagagctgagttgatgtgttcttagcaaaactctttatatcttcagctttttacagtattttgcataagattttaatgggaatttggtcatcagcctagagcgcaagccttaattgccctacccttatctcccccctgatcgatccagtccattctcactcctttggacaaacttgtcttttcaaaaagtagataataaaaataacacgttcacg

SEQ ID NO: 53736 - DNA, 1501 bp, Oryza sativa
tcagggacccatgcatcacacacacccccacaacgacctcatctgaccggcctagattgaacggcgatgcaaaatgcaaatgggcgccattttctcttggctggaacaagaggccattcttgtctggaacaagtggcaaatcttccatgtggaaggcaatgccaatggcaatggccgggcagagagggagttaagcagcctagctggtggggctgtgctcttcaataattgccgtgccactgccgctgctgccccaaagaggagtagagaagacacaggcgagaactccctgtgccaccacatggcgttcatgctgctcttcacatgcaaagcctcgtgcccaagctcacacttgtgttattccatctcatctgcctgccccctcttgtgatcttgtccttaccgcttcttttattaacaccgagttggggaaatggcatgttatctattcctctgcagtgtcgtctacatacacagacgcttctttacatgtctgtatgtatgcactagctagcagtgacttgacacctgctttggtttggaccagaaactaagtttagctcaggcagctgctgataaagggataagcaatcgtgtaatgccaatcgtaccggtggcgtttgagtattttgctcctaggccttctctacgtgatgcagatgtgctgcctaccttacccccgtgatgaggccgtggtggccattcaccggctcacgacaagagcgtgagagctcttggtcacagattacggactgtccgataccaaatcacatagagcaacaagttcctcttcaaaaaattcttcagaagattatcccacataagtactatttatttctcacgatgtactgaacaattacacatgggtgtacagcatatacttgtgcatagtagtaagtagtccccatactgcgacgaaaattttgcaatgatatgcccgtacagtagatacaatcaagcaatgaagcaagaagccatgtatcatgtatgtatacagatgtagtaacctcactcaaacaccgacacatctactccgtcggccacaaagttaatgcatgctagctggccatagcgacacatcattaaacaacaaatcgattgatatcaacggtgagtcctcaagaaagaatgacacccattatctcgatggagtctttgcagtcattgtcaagccaaaaatctagagaacacagggtttaggtgtcacaactaaccacactaaccatcactagttttacaccaattctacatttgtacagactctattggcgttaccagatcaccaaatcagtggagcacaaccactaagaaaatgaatagtactagcatgctgcaactgcaaacaaaattcaggaggaagctcacactttggcctatctctgcaagctcaccattttacctgtgctctagtaattgttagataatctagcatctgcttagatcatatagaacattgataattatcaaggcatgatgcaacctgtgtagagtttcagaaaag

SEQ ID NO: 53737 - DNA, 1099 bp, Oryza sativa
tttccactaaagaatgagcatttgaatataatgttcagtttatacctggggcatatcatggcactaaatttataacttcgtaatcaatatcaacaacagtaggggaagcaccagtggtgtggtggtgtatcgtgggtgcatgactctacccatagggtttaaatcctgatgcctacgaatactatgtacatgcaggtgtacttttaacatgattttagtgagatcgggaatgtgtcattggttttcgtcttagagcatgtgttagaggatgcatttgcgggggtgagagtgtggtgtcgcgcgtgtagtggtgtgtatgcgtgtgcatttgttgtgtaatcttaaaaaagaatatcaacaacagtaagattgtcatatattatagtctgaggaaagggattggtcattgtcaaactcttataaattcactaaatagggcatatgcgagatcctgcaggtccggaggatcgtatggaagatacgtggggtacgcatcaacattccaaggtcttcgtacatgactagatccttagacaaaaagatggcaccaatctttgcagcttctacatcagagggatatgttatattttgtagaggagggaacctgcactctaatgttaagatatgacatgttaaaagacccgagtcataaatataaccattctattttagtgctaagtgctggcaacttttttaacaagttgacaagcacgatcgcaacatcttaaacgccttgcggtgatcctagagtcaccaaccaccctaatctagcaagcactaaatcaagatgggttttcataaactaaaccggctagcggagccgatttagatgaaactatggataactacccgtttcgtggacaaacggaaggttttcaggacaaacctacaaagaggtgtcgcactctcgcagcggcagcggacgatttacggtgcaaatcgacaaagatggacaaattaaactagaactagaagcaatattgaaaaaacgattcgattgattgattgtagaatattttttacaattgaaccggccttatccccttatataggggttggtcttaccttctacaggctctcctccacatccaactcagga

SEQ ID NO: 53738 - DNA, 304 bp, Oryza sativa
cccgccccctcggggagacagagggaggggtgaccatgtcaccctcgggcccgacctccccgagggggtcaggccacgggggtgaccgcggctactcaagcctctagtcacgatacccccggtcccatgtcaccgacagtagcccccggcgttacgccagggcgatcgcccccctcgagggaagcgctcgggcgtgacgccactccttaggcccggtgacaggttgggccggtctctacaggcgggcagaaacccagcggtcgcaaatcgcgcgcatcggcaagggaaaaccgaccgacaataa

SEQ ID NO: 53739 - DNA, 1501 bp, Oryza sativa
ttaattaacgaattaaaaaaacggagtaaaattttaaaaccgaattaaattatcggggtattaaattagtgccgcgttttggtaaagaaaccgaaattgtcgttgtttcgtaggagagagaggatgcgtacaaaagcggggccgagtttttaatgcggaaatcgaaaaatgcccgttgccttttgcttgccggggggggcaaaacgggaaaaccactttaataccggattaaatataggataatttcgaggggctcatgggtaattagccacgaagctattgaagcgagggggtttgaccctgggtaggggttggaattacgggttttgccacccgtgtctcatcttgtcgtcttgcagttgcggcgggtcaaacgtgtcaaagcgtacagacacgcagactacagtgtgagtgagtggtgacagtagggagggagatgagccgatccgtgtggaagcagctaatcttccgggttttttttcaacgggttgtccggtgggaaatggagcagctacgctcacaccggctttccaacagttcagtgtcgtagtatttcatgcctaacttgtcttgtgatgggtggcgagtgacgaaggttgtgttctttagcgggagctgggaacacgtagaacaaagtgatccattagtgtgtgattgattaagtattatcttttttttaacaatacatcaatatgattttttaaagcaacttctgtattgagttacttttgcaaaaaaaaaaaaatacacagtttgatagttcagaaagcgtacgcgtggaaaataagagcgagatggaaaagctaacagaagaacttagccgaagtatcattagaaaactatgtgtttgtttcctcgtgcgagaattgttaagagaaaaaatgatgtatgtattgttttaaagctgtaccgaatagtagcttcttttatggatcgtttagagtagtgtattgttgctatcttcttatgatggttttttttagtccctacattttgtgcaccaaaaccagaggttatctgagaaaggggatatttataagctacatcttttataagaacagcataattttttctctatctaacaaggattttttttgtctagtataatttgatgtaatattttttgtacaatttttttggcagagaattccaaaaaataaatcctttcaagccatgaagaaattcctaatgtaggtggtatgaaaagaatatggtggttggagctaccacctttatgtttataagtttttgcaaaccacatacattagacatatccacccttttgtccaaatgcccaacatgttgtgcaagataaaacaacaaaacaaaaatatagaaacacaatgaatacgccaaactctccactagagaataaaagccgactcacaagcacaaagtaactactcttaattatgatatccttatcttgttgtatttgttagagtccaaacaagtttaaattagtacgaacacttgtaaaacaaaaggaaaggaaaagaag

SEQ ID NO: 53740 - DNA, 1501 bp, Oryza sativa
ccgaggcgacgtgtatgcagcttcaaagttaaggaacaagacatgcatttaatgcaaagattgtaatacttctcgacgaagttaggttgttgggccaatgtggtaaccccttgaggtataaaaagaggtccaggcctagtgagagagggggggacttccgagcgaaccggcacttgggtctcgcaaccccgagcacttgtgttctacactcaatcaatcaagcacagtagtagggtattacgctacttagcggcccgaacctgtataaaccttttttgtctcatcgtctttgggggatagaaccccctcaagatcacacagcttcgctcaccaagccctcgaatctcacacgctgcccccggccgaactcacaaaggggggcttcacggttccctggtggaggagatcactccccgacatctaacacacgagcagcgcacaggtgcactacccagtcccatcggtgattcgaccggtcacagaccggttgagtacactgcacgccacattaaatgcggcgtggcgcgacctctcgggtcgccataaatacgggtaggtgggcacctgtaggcggacacctaacccaccgtacgtggtgacctagagagggggtcgggctcccccgacccctcgggggagggccatgtggcgcctggggtagccttctccctctagtctcgatcagggagtggccgccaccccacctcgggcctgactccccttgggggagggccacgtggcattggggggcaacctcctccctctaaacatgatacccccgggcccatatcaccgacaaagctattagcgcgtgattaattaagtattagctatttttttaaaaaaataaatcaatatgaattttttgagcaacttttatatataagctttttgaaaaaatacaccgtttaacagtttggaaagcatgcgagtgaaaaaacaagctgacaggagcggttgcccgcaggaacgagcgcacccaaaatcaagggaaaatttgaaccatgccacacaaattttgatatgccaccctgacacacatgtcattgactcatgtgggtcctacatatcatttagatacgggtggtatatcttaaattttaccgaattaaggtggcatgattccaacaaaccccaaaatcaaagaggaagaagcagtataaaccgcagggacacagcctgctgcgctgtacgtgtctgattgcaacggcggggggcgcgcggcattgtttatctggggcgactcgtcaccgttgaaacgttcgcttgtgccgcgcttgcttgccactttcttcgattcactcaagcccacgtcgctcacgtgtcgctttcaatatagatttgtttagcgtttcaacgggaaatttcgtccaaactctaccgggtattgagctgtttagctcaaacaagcaatcgtttcgtagtcaatttatcgcgcaaagacgcgtgacgcgtgaagacttcaccacgaattttccttttcctttgattaataactagt

SEQ ID NO: 53741 - DNA, 1501 bp, Oryza sativa
ggggccttgccctcacgacgctcctgcctcctctcctcctcccacttcctcgtccgctcagccaaacttttgaccacggcagtccgcgaggtcgtggagggaggtgttgtgcacggaacaccacttgccggtcgggcgctccctgctgggagcgccggcctccttctttttgtcgctcgcaggcctcccctttcgggtggcccgcgatgcgccctcgacggcgaggacgtgaccctcgtcgtcggaatgggccgacctcttcttcctcctcctgtcccgccgctctgaccgagcggcggacccgggggcggccggagctgccacaccggaaccggaggagttccaggtccaggcctcctccttgcgagccacacggtccgcgagctggaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccctcgctgtaccgcatgcaagtctgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaatttgccatgaccctgtcatcacccccggcggcctcgatcccggtcgtgtagatctgaagaaactcggcggggttgacgcttccgtcgtatttttcggtgatggtgggccggaaccttgggggccaacggacgttccgaaggctcgccacaaaggctcgacagccggcaccgccaaccggggacacgggaggctggcccccgtgcccggaccgaagtggcgctccggacgaggaagcgcccttcgttgcatgggcagcacgacgaccattgcgccggcgctcgatattgaggcgggcatccggccccccacgcacatcttcttgggtcggaggcgttgacgagggaatggcggacgaacggcgggtaacggccgccgctcgccgcgccctccgcctcgacgacctggagccggcggcggcagcgccagaggtcccggtggcggaggaccgcccgccggcacctaggcgctgctgcgtcgtcatgaccaagtcggccacgtcatccagccaacgtcgggctggagtctctggatcggagacgacgggcgggtgacgcaggagcgcgcccgcagcctggagcgcgccctggggcgtgccgccatcgccgtagacgaggaggcgacgctccccgtcttgccgtccttctccattgcccgcgggcggcgaagtcacggatctttcgacctcctcgagcgcctcctcccgcccaagatttcggcgagagggggacggtggagtacgagctcgacggcgcgggttctgctccccgtcgtcaccgcta

SEQ ID NO: 53742 - DNA, 601 bp, Oryza sativa
ctggtcatgtcgtcagcagacagccatgttcccacgtcgcgcctgcttccggcggaagtggaggtaggtatgggtcgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggatttttttttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactagaagcttaggatctcacccagggcccccggctgaaccggcaaagggggacctgcacggtctcccggtgaggagccccacgctccgtcatctggcgcgccaggtagggggctctgcgggtatttttctaagctctcgcattctttcgtgtgcgccaagcttttcctgttcagcccaa

SEQ ID NO: 53743 - DNA, 1501 bp, Oryza sativa
tacaacaaaaagaacagaaactgaatttattctgctgctggtactactagatgtttttgaaaggaaaaaaatgaggcccatgctaagatgggctcaccatattcttgtagtattgtgggcctcaacagtaagcccagtatttctgaaggaaccaggggaggcccgtagtacagacagcccaaaaggaggagacgaggccgaaaggcccaaaagaacgagaggtacaggtccgcttctgtttagacagaacgtactttctctctgtgaatattcttctgggtgtttccatctcgagcaagtttttttggctacagaaaccacagtttcgaccgaccattctgcaattgaacagcctgcaccataaattcagtggctatatttacagtgggagagaagcacacaagaaagatttttttggccatagaaaccagaatttcgaccgaccatactgcaattgcaccgtctgtaccataaattcaatggctatatttacagtagaagaagcacacaagcgatttctttgcccccccccccccttttgtcatggtatagttattaccagccttttttgtgtttctactggtgtttaggtaatcttatcaaagaaaggaataaaaaaaaacaggtgagctgctcagatgaggttttagttgcatcctatctccatgtgattccgatcgttgtcgttggaatttagcagagcaccggggcacacacgtttatgaatgcggcatatatgcttttcgctgtcctgcttgtcaatcgtggtcgagtgctggagaattatccaaccacttcttaattaatgattttcacgaataatttcaccgagtagttttgatttggttgcctgcttcacaggaaatcggtaacgcgctatcgtgctaaagcagctaaactggcaaactgctactaacctgaaagccgggtgttagttgcacaactgcacaagtgccctgacttagaaggatatcgaattcagaagctgctggcctgtcgcgagtgcatccgtcaatgaaaacgacgatgttgtttgtgtctctatgcttggatgacaacgacgcaaacctaaataaaaacacaaaagaatcgctgtcaccacgcccacacttggattagttccaaccattagaagaaaggaaaatcctcggcaagacttggatagatatccatccaccactccaccagcaccaaggagaggagaggcactgaaaagtgaaaaggagatgctctttctgaaacaaacgattttctttctttctttctttcttttgaaggtaaagttttgaaactttttcattatacgattatgtggggtgctcacctgacctgtgaatttcatcacgtcacggcttgcccgtggcaaagatcaatccaacaaatgaaaaaaaaaagcagagaagctctgatgtatgaacaattgaacactggtatctcagtaagaaggcactcgtaataagtggcacaactcagaatcaaccaaggaatcataatagatgtc

SEQ ID NO: 53744 - DNA, 1501 bp, Oryza sativa
ccgctgttccgtgctctgctcactgcggcactagcccgccgccgcttcatctgccgctcgctgccacactagcctgcactgccggcagcctcgctccctgaagtagacaagagaagagaagagcagaaagaaaatagaagagaaaaaagaagaaaaaagagatgcggtccctacttttttttcttctcacttatatgtgggccccataatttttttttgctaaactaggatgccacatcagtgtaaccagagatccataccgctataggacctaaattgcacggttttgtatattttaggagtgggtattggggattagggatgtcatacagactcgacataaagttgagggatggctggtgaacttattccttttttgggaaatatgagtgaaaataattgtacaactgaaaaccatatctaaaaggaataagtccactttgactcccttaactagtggctgaatctgattcttatccctaaactacaattctggatatttcgatacccgaacggttttggagagcggtttcgctgacgtggcggtgttgacctgtcttcgtcccatgtggcgttgacatgacgtttatgtagcagtagaatttataaaaacatgtgagacccatttttcatccaacaaaaaaattgtgggacgcactaacatatggggcccatatgccgtcctctctcttattcacttcttccccctccttctctctcccccttatctctctcttactttcacccttgtgcgtttgttgtattttgtttgttttgtggtggtgatagatttccggcactaaagatcatgtcctttttatatagcttcctcctctagcccaagccattgctgcaaagtgaaaggaggaggaagagaggtgctgccaaaattttctgtgaaaatattttggtgatatgatacaaatcgaagggaactaaaaggttagcaacttcatcctctattaatgtatggttaacacattacatttctagctatgttttaatacatcattccttctcaaaaagttatatctaaaaagatgagagataacaaatttttagagaaaatatgggtacttcttaatattagaaacatttggataaaaatatttaaaaaagacaacaaaggaaaaatatagaaaatgaagacaaaagaataggaaacaaagtcgatttaaaagcactaaaatagttagaaataggtagagtgcattaaaaatatgtttacaacttcaaaataactcttaaaaataattaaaataaggataatacatgaaaaaatatatgtacaattttttaaaactggtagaatttcatgtaattaaccatgacttcgattaagtccatttaaaactcgttaaaatcattataaataagatgaattcattaaaaacgtgtaccgtcagttttgattttaattatgatgttttaaattattatatgattatttaattattttcacttttgtggacttactctacatttgtttatttgatgtaga

SEQ ID NO: 53745 - DNA, 1501 bp, Oryza sativa
ataattaagagtagttactttgtgcttgtgagtcggcttttattctctagtggagagtttggcgtattcattgtgtttctatatttttgttttgttgttttatcttgcacaacatgttgggcatttggacaaaagggtggatatgtctaatgtatgtggtttgcaaaaacttataaacataaaggtggtagctccaaccaccatattcttttcataccacctacattaggaatttcttcatggcttgaaaggatttattttttggaattctctgccaaaaaaattgtacaaaaaatattacatcaaattatactagacaaaaaaaatccttgttagatagagaaaaaattatgctgttcttataaaagatgtagcttataaatatcccctttctcagataacctctggttttggtgcacaaaatgtagggactaaaaaaaaccatcataagaagatagcaacaatacactactctaaacgatccataaaagaagctactattcggtacagctttaaaacaatacatacatcattttttctcttaacaattctcgcacgaggaaacaaacacatagttttctaatgatacttcggctaagttcttctgttagcttttccatctcgctcttattttccacgcgtacgctttctgaactatcaaactgtgtatttttttttttttgcaaaagtaactcaatacagaagttgctttaaaaaatcatattgatgtattgttaaaaaaaagataatacttaatcaatcacacactaatggatcactttgttctacgtgttcccagctcccgctaaagaacacaaccttcgtcactcgccacccatcacaagacaagttaggcatgaaatactacgacactgaactgttggaaagccggtgtgagcgtagctgctccatttcccaccggacaacccgttgaaaaaaaacccggaagattagctgcttccacacggatcggctcatctccctccctactgtcaccactcactcacactgtagtctgcgtgtctgtacgctttgacacgtttgacccgccgcaactgcaagacgacaagatgagacacgggtggcaaaacccgtaattccaacccctacccagggtcaaaccccctcgcttcaatagcttcgtggctaattacccatgagcccctcgaaattatcctatatttaatccggtattaaagtggttttcccgttttgccccccccggcaagcaaaaggcaacgggcatttttcgatttccgcattaaaaactcggccccgcttttgtacgcatcctctctctcctacgaaacaacgacaatttcggtttctttaccaaaacgcggcactaatttaataccccgataatttaattcggttttaaaattttactccgtttttttaattcgttaattaatttattaatttatgtcccctctctctcctcttccttttttgcttttagttttggctttttatttcgcccccatttccattccttccc

SEQ ID NO: 53746 - DNA, 767 bp, Oryza sativa
ctgttgtcttggctggccaatggaatgctttcgaggggaaggaagtgggcatggtggcataggggcggcgacagtggcatgagctcggctcacactttccgcgaggacgcgtgactgcgggagctggagcacgaaaacgcgaggcggttcaccgagtgcatcggcgttggtgcggcacggacaatagggaaaaagacagggctagggcgaggtgtcgtgcggctacagtttgggcggcatcggagtggggccagcgtgatgatgccagccacatcagccaacatgagtggtgtactgggaggcgaggaagtcggattttgcgggcgggaaggtggaggtgtgtccgggattcgtcgtggagcggcatgacgtgatgcagcacaactcgggcagtgcatgacgttgtgtgccctttgcagcgcgactcggtgcgtcgctcgcccgcctcgacatttcgtcgaacaagtggcgggcatgtgaagctgcctgtgtggggaagaaggaataagttcaccggaggtccctcaacttaacagcgagattttttgaggtcccttaaccacaaaaccagaaatctacacccctaaactatacaaaacccttcactcaaggtccctaggcagtatatataggtggtttcgctgacgtggcatcttagtcagcaaaaattttttaaaaagtatgtaggaccaacatgttagctgcacatttttttcttctccttctattctcttttctctcttccctcttctcttcttcagtgagga

SEQ ID NO: 53747 - DNA, 1501 bp, Oryza sativa
tcgccgtcgccatcctccgcatctccggccatcaccgcgatctctctctctcccgtctcttttccttttctgatggctacgcaacctcctgtccgtcctctcctcgttcttgcctgcgccttttgcctttctatatcagacgagcactaaccactgattgattgattgattgatcagtatcagtgtcttgagtacaagttaattaatcgatgagtagtaccaagtcttgatctcgagtagcagtgaatgtgattgaatcatctgattgagcgaaaagcagcagcagcattgatgcctccgcctcgccgtccaccagcacccgcacccgacgaggaggcactggccttccgcgtccgtccctaactcctctggcggcagcgcgggacgaggcggttctgcgccaccggcgaccgccgcgtcgacctggcgtgggacctcacccgcgcgcgcttcccgggctcaggttcgcccgagccttcctttgtgtgcagccgacgagccgccgccgcgccgtggtgccgccccgcagccgcaacagctatgcggcttgaacggcggcgccggcctcttctcctccggtgagtatagatggacggactacgtcaacgtcgtgcgtgcatgcatgctgcaatcttggcgtctcagtttcgtgcatggatcttatgaaggtcgggggatgacggcgatgatggagtgccacgacgtcgagatgccgttcttgcgggggatcgacgtgaaccggccagcgccagcggcggagacgacgacgacgaggggggcatctttagcgaggaggacacgaggagtccgacgcgacctcccccaacagcacgctctccagccggcagcaacgacgaggactccggcggcggctgcggatctagtgtaccgcggtcagggcagggacgggagcagcaacagcagggagaagaaaagagaagaaaataagatatgcagctgacatgtgggtcccatgtgctttgtttaatatttttttttactgactaggatgccacgtcagcgaaaccaaccatatatactgtctagggaccttaagtgaacggttttgtatagtttaagggtggggatttctggttttgtggttaagagatctcaaaaaatctcgttgttaagttgagggacctccggtgaacttattccggggaagaaagagggggcagctgggctgagttggccgtccaggaatgggagagggaggtgggctggcctaggtgagggaagggactggcctaagcgaagaaaaaagaaaggggcagcccaacggaacaatgatatttctcaatttctaggaatatatcagagtttgaattttggagagtattgttggaattgtaaatagattgtaattggaccgtggactccaataattctaggattgtgtatggccacatttggatgaatgatttgagatcttcaatggcacaaaccaaaattcaaataagaaccaacttttgaaaatagattttgtatttaaattggg

SEQ ID NO: 53748 - DNA, 1223 bp, Oryza sativa
ccccccccccccccaatcccattcgattctcttcagccgccgccgcaccgcagctcgccccgcgccgctggctaggaaaaaacaaaaaaacgagtcggctcacctcacacgcacggcgcacgggccgggcagcgtgtggcccgcgacgaccgcgaccgcgaaagcagcaacctgcggatggagcagcggctagcgcttggcgtgagacagcggcgaggttcccttccctccctcgtcccagttgcggttttggttttccagcaaagcacagcacagctgcacgtacaggtacagggatgggggaagaaaaacgtgtactagatggccaccgccaaagtgagagcgacggtgcggtgcctgcacactagtgtacggcctaccggactaccggtggactaccgaacgcacgcatacgggagggaggagtcggggaccgggtcgttgctgctcctcggtcggtcagcctcagcctcatgagtgatgatgactagtctactggagtagtactagtggcctcgccaagctccattggttttgttttgcaacttcaccacgtcggcaattaccgcaacaagccgacctaacggagggggtgggaacatgtatgcaccgaacctggtgcatgtccacgttcagcgtactacctctcaacttggagcatctctgcttattagtgctctgttttggccggggtgcactgcacccaaataccaactagcaccaccagaaatgtgtcctccctatactttatactctaccagccgactagagtatactagcactactcctactttatccgtttcacaatatagacaatgctagaaagtcttacattataaaacatagggattatataattataaatgaaaaaaattactaataaaatattagtacagaattccgaatgcgtacgtacggtatcgcacatccgctgcagcagctgcggaattaaacaaaccgggaatgcgtccacctcccttgaactcaatccaaataaataataataaaaaagaaacccacaattccgggcagatgcctctgtgtctgcaacacggtcaatccacgcgcgcccctaaccccaatcattaaccccgtatgttaacgcacgccataaacgcagacgcacggccaccgtccgttcctctatgcgcacaaatctcaaagctccccacgccgctttcccctcacgctcctgccgccttccgcgaatggatgcgccggtg

SEQ ID NO: 53749 - DNA, 1501 bp, Oryza sativa
ttaactcggacaggcgagaccactccccgaatcaccgcgttgggcatactccctctggttctatattaattgacattttggacaaggttgagatcaaacttttataactttaaccatcaataactttaaaaatattaatttagtttaaagaaactagaacaacatatatagatttgtcttttaaagcactataataaaagtaaacatatatttatttattatgtatattataatagaaaaataagggttaaagatatatcttataaaccgtgtaattgtccaaaacgtcaattaaaatgaaaccggaggcagtagccaatgaactcacgtacgttgttaactagcggagagcgaaaggacatgccacgggatcggctaatttaattaatatcgatctatgcacgagccagttaattatggcaaaaagacgataccaaagtacgactgataactctgttaattaatcggtaatgaagacttcacaggctgcaggccaggctggccagcaattcaaccaagcgattaggaaagtgactaacccacaaattcacttatatactatttttaatctataagtgaattcgcaagttagctatttacatccataattatgcatgatgcgtctgcatgcatcttaatttgtattttcgtacttctttcattatttcacaaaagatcttgatatgctgttatgtgcctttacgtcttgtacattctatttgtgctttgattaatttgttcgttcccttgtgacctatactccatgcatccgtccaggaaaatcttaacttagtaggagatgtgatccgcagtgtaaagattcattgtactagtaagagttacatctttttctaggttaagtttgtttagaactgagaagtaaaaattaatttgtttccttgcagtgcagatggcatgcatccaacgtgggcacacactgccagcagtgcgacgtatagatttaattaatacagcttatttaaattttgaaacattatctttcgaaaaaataaaacttttgagtcatgccccgacagtagagggacacaacacagagaatacaaaggatcgtccaaatctacttcattctctagtttaagtagatcaaaggtcactgggatagtagaaaagtgggccagctagtgcacattgcgcaagctgaattcaattaataatacgagtaaataatctcctaaaaaataaacaaaatgaataatggtcattaattaaactgaagaggccggcggagatctgttttgccactatgcgtaatcatcaagatctttgctttcctacttgctgggaatataatatcatattcatttggctgaccgtcgtgctcgtgcggttgaaaggggatatatatgtgttgtttttctgaaacaaaaaagtgaaatatgctttttctttaccggttttaaaggaatatacacctgttcaaaaattagcagaagtataccgtagtttgttcgagtaaagatatgaactcatggcgagtttg

SEQ ID NO: 53750 - DNA, 1501 bp, Oryza sativa
attgacttttaagtcaccaagaatatatatatatatatatatatatatatatatattacctacaaatttatttttacttcctaataagccattttggtttatcaaggaaaaagccaaacggtggggctgttagttttattgtgagatgaataaaagaagagtttaattttagaatggagattgtattttcgccatggccagatggagtacggcgagatggacaaaggggccggcagcatcttaccggatttggagctgtgcattggctctaaatttgtacaatgctgctacaactagcattaatttggacggttattagtagtgttgatatgggagattagttaatctgacaaggtcccaatatggttcttaattactcgaatatgtggtgtatattcctggtcggctttgccgactttggctgtgtctggactctggagtatacgctaatatgcccactgctgggttgtaacgtagtgcgatgttttgtttactgcaaatcatacgtttctacatctatttcaccactcatgagaatatacgatataggaattctagcttacaaaaacctattagtggtctgataacatgtagtgaaagagcttgtctagggttgtgtttgagagaggttaggattcttaaaaacagctgtttaaactaaaacacccagcttctgacttataattcatcttctgaattatagttcaccttttgaattctataatgatatttttttcaaagttacttcatccttctcgaaatatcatattacaacgaatctcgacaggctcctcctaggatgtgtcacatgagaaaaaatattattttggagatggagggagtatgtgagaatctagagtgtttgatgaccgggagattataagagaagctatatccgatgcaaagctctctaaacaatattttgagaaatggttgcttggtaactactatctccgtcttaaaatataataacttttagcttgtccagatttatagctaaaaataattatattttgatacggaagaaatatttcatgagaatttaaaaaaactggacttttaaatttctaactttatttattttattctacatctacattttcttataatctgtaaaaaactaaattgttcggagagttttagtttttttttaaaaaaaagtgtcggaagctctgccaaacaggtgtggcacgttcgttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 53751 - DNA, 1501 bp, Oryza sativa
ggaggccgccgatggaatggcagatcccgtcgatatcgacaaggtactctccctctccctctccctccctccctgcacccgccgctgcctccatctcttcgcgccttttaccacctttctttctcccccatcttataccttgcgtgctgctaaatgccggcaactatcattgattgctgcaaccaaagctctagcctttccttcgctccgacaatctctgtcgttgtagccttcttgctggtgttgttgtagattcaccgcggattattgaggaacacgcacttttgacttttaattcaatgccaacaatcacaacgtgggttgcatgaatgtagccaatgctgcccctgctctctcaaatgttggcctgcctatttgcatttggagatccttccagggttatgcttactgcaatgcccaattttgggaggggaaaaaaatctgttcttttatttttttaaaaaaaaacataaatggaaggggaaattgggaacgaacaaaagaaaggtttgtcaagttccactccacatacttcgaaattttcgatgtgcaattgcaaaccgccgattgagctgtgctgaattcaattattagtcggatggaggattgttactttcactggagaatgctgtggcttatcgagtttgaggcttttttttttgtttaccgaaagagtttcaggccttgttccccctgctcgaattatcttgtgctatgcacagatatagaaaggaggagaagctggtgcattagattagtttctatatatcaagttgaattgatgcttatcgtttctagttgccattcctttcttttttatgggatcctattcttatggggtctctgatgttttgattttactcttattactccttttttttaaaaaaaaaatcgttactctctctggataatgaaaacgacagaatccctgccttcttgctaaaaagaatcatgaagttgaatttcagggtcttgtttacctacttggttcagtgcttaagataaataatgtgtgccatttgtgtgagagacatacaactagtgatgaactcagttttgtcttcttctttttttttgttaggagttagcactatctcacaaatctcatcatttaaagcatcactatctgggcaggttgtgtgattgtgtcctagaaatcttgacgatcaggaaaaagattttgagtaatcttgattatatgtatatgactgcgatgtctgctttccttcagatagatcctactcttgttttggaatctggataactgggttcttggagctaaccaaaatatcaaaatcaaaattttaacaatgtcaaaatgcaatggagaaaacaaagggacaggcagacacttccattagttacttttgttttgagggaatagacaagaagacacttggaattttcccattagcattgatgctatcgaagttttaattgtcaattacatttccaagaaaatgttctaaactctagtgatctgttattgaagttttttgct

SEQ ID NO: 53752 - DNA, 1245 bp, Oryza sativa
ccacctaactgcatttaaagcggtctatgcaaccgcatcatgtcacatttaatgcggcgtgctgcgcatctgaccggtctgtgaccggttgaatgaccgatgggacggcgactgtgtacccccgtcctgtcagtgtgtcaggcggtgagcggcgtgctccgtcccgtcccatcataatgatgaggggcttcacagcctcttaccccagtcagagctggtccaaccactctgaactgacccgggttcccgttttctggtgtgaacgagaacctggaagttctcatccattaaatgacgaatgacaagggcgccatgcatgatttgatgggccccgcgtagcaaccgacgtgcagatagcttctaggctaaggcagaagacatgtaattaatatagagaatattttcccttctccctaggtagcactcgcagcacatgtagtatcctcttagagtataaaaggaggaccatgcctagcgaggaggggggatcggactgaggatccctgagccaaagcttgtctaaccctagcttgcataccagggattcagggactttctaagcacagaagaatcataaacacaggagtagggtattacgcttcatagcggcccgaacctgtataaacctcttttgtctcatcgtcttggaggagcctccgagatcaagatctcacacagtttcactcaccaaatcctcgaatctcacccgctgcccccggccgaactctcaaagaggggcctcacagcctcccgctagagagggtcacccctcgacaactatagtatcccccactttatcaaatttcaatgaaattattcttctcattatccactcccaatgcatttatcttttattttcataaactccgatgcaatggtttattttgaataaatgggagggaaaaaaacaaattctagaactgatggagtgcgttcgacataagcagattgagtgaaaaaaaagtctctcatttctacatgcacgcttcctgaactattaaacggtgttttttttacaaactttttatttatgaaagttatttttaaaaaatcatactaatctcttttgaagtttaaaataaataataatcaattaatcatacactaataattcatctcgttttacatattcttttcaatcttcactaatcctcttatctcaaacactcatatgttttacccattcttttcataactcacatctctcgtttttcgcataaacttcctaaactactcaacggtgta

SEQ ID NO: 53753 - DNA, 1501 bp, Oryza sativa
gtcgtctcaaaaggaaataaagattgtggccatatactatcccgtccctgctgaattctcaccaattaaagacagtttttcactcaccaaatcactccaagctgcctggcacacaacactcgccaccacgatggtactacaaatcaaacacataaaaataattgaaggtacctgcattgcatttcatgacctatcagttgtcagttctactgctactgcaaatactctttggcaaccaaaacagcacgagtaatatttctttttccgattgcgggcagcatcgattgtagtacgacacacttgccctcgctgagggccactttgattcaaagtaaatttatagaaattttaaaggattttattcatatatgaatttttttctgtatacccctttgaatcaaaggaatggatcatatgaaatcctatgaaattcctatggaatatctcttctcatgtaaattttggaggaaatttaacatgagttagaacctcatggaaagaatactttgagtctttatctctccataaattcctatgtttttcctgtggcccaatcaaacaagcattcctatattttttctgtgttttacgatcctctgttttacacttgcattcatgttaaaatcctatgtttatcatattcctctgtttttttattcctgtgattcaagggggcactgaatagtgaatccgtcgtgtaaccgaagaaaatagagttgaccttatagtaggtactgacttgctctcatcataacacaaaagctagtactacgagtagtagtagcagctgtttcagactttcagcaccgagacgggatgttcaacaatgctcagcaggggtacgtcggtgaatccggtcaagaagggtttgtcctactcctaccgaaaaggtccctctggagctaatgatttcatttcgacaggaacaattcggcaacgtttttcttcttctcaagattgatcatgacgaatgcttgaatgcttgtttatagtactaccgatatttcattcttgattccactgtgtaattttaaccggtgtaccgatacaaagcaagcgaatgctgtacacagttaatccgaatggtgtacctgcaggttgaaacgcagggcccaaaaggtgtgcaggctgatcgaacagcacaacacagcagtacatggagtacatatcctgtttaggactagctgctcaccaatgaattccccacttttcaactgttcaacattctgttaggattccgcgtgcagtgcttacttcattcacgccatacttaattactctaattaattagtctactccttgcgataagctagcaccctttttatcctctccaggatcagattatccagattcttgcacacgcatgcttggtactactttctcattcttctgaatttttacctcacgttccagaccacacatctctctcgtcccatcaagctagccgccgtacgagtatggcgacttcaccctcaccttcgcctcctctctctgtagactt

SEQ ID NO: 53754 - DNA, 1501 bp, Oryza sativa
ctggccttcatcgagggcccgaccccctcgattccttccaatccttccatctcttcaactttcacccgctgcccctggccgaactaacaaaggaggggcctcatggtcccccgctcgaggagttcaccctccgacaataatcttccaaaaaactcgatatgaataagtacgtatataccatgcacgttggccccattatattgggggtctttccgacaacgtacaagctcgtggatccaaaaaaagtcgtgcataatttgcctatatattttaccccactgggacacaattagacgatccatgactagctaattaacagtacttatttagtgtttttttcttttcctgcttagactgaagagtaagtgtcggcgccgttagtgtgacgcagtttttttttttctgtttacgttcaagagtatattcggtgcgaccgtgagcgtgaccatgggttatatataatatttaagatcgagaggttgattcaaatatatataggcgaactgtttgtttgtaatgatgcagacaggaatagagcgaatcccgtccgtggatacagatttggactgagtagtgttacatagtgaaagcacacaatcatataagaaaactagggtctgccgcactacgccgctgctgctctgctaagaggaagtgaggaggagatgagacacaccgaaccctaaatccctcattaggctgtcttagattgacttgggtcttctgggctgcggtatattcatataggcctgttcgaccctgagttttgttcatccaacggtgtagatgcaatctaatctaccgatccaagggctgtaaattaataatgacgtgaatcatttaggtttaagctttaggatcatagttgcacttagtaggggataactttataggaacaagggattaaagagaaagaaggcatcgatctactaactaaaatctggcaagatacattagggaattaagaggtgttcgtttctaccgtgagaaaaatgagaaaaccattaacaacagtgagtaattaagtttttaattattataaaccattaaccggtgatatagttgtaatgaggaaccggccgggatgccgccatgcatgatacgtagccggcgctgcacccgcgccatgttgattgttgagaagggggatgatgaagaaatccaacaattaatggtgaagaaaacgacctagccattaattagaaataggggaaattaaaacgtcaaggatgatggggggctgcctacggctcgggcgcccgacgatttcaagaaaaatcgggcgctgacgttagcgtccgatttatgtgcaaaactactttaaactatttttctcttaaattacttatccaaatcatgattcgattgcaccattaaattcgttataattaaatcttcaaaacaagaccacacatggatatattccgacggaaaaaaaatttagctcattattaaattatttttaaatgttgcacgatgttccataaagtatatcggaatt

SEQ ID NO: 53755 - DNA, 1501 bp, Oryza sativa
tttttgttggatgaaaaatgggtctcacatgtttttataaattctactgctacataaacgtcatgtcaacgccacatgggacgaagacaggtcaacaccgccacgtcagcgaaaccgctctccaaaaccgttcgggtatcgaaatatccagaattgtagtttagggataagaatcagattcagccactagttaagggagtcaaagtggacttattccttttagatatggttttcagttgtacaattattttcactcatatttcccaaaaaaggaataagttcaccagccatccctcaactttatgtcgagtctgtatgacatccctaatccccaatacccactcctaaaatatacaaaaccgtgcaatttaggtcctatagcggtatggatctctggttacactgatgtggcatcctagtttagcaaaaaaaaattatggggcccacatataagtgagaagaaaaaaaagtagggaccgcatctcttttttcttcttttttctcttctattttctttctgctcttctcttctcttgtctacttcagggagcgaggctgccggcagtgcaggctagtgtggcagcgagcggcagatgaagcggcggcgggctagtgccgcagtgagcagagcacggaacagcggcgagcgaagcagtcaggggacggtaggcatagcgtgaccaccgagaaggtgaagggagctcgccgcactccctctctcatcggcgcctcctctctttctgcgacggcgtccgtcgtccctaatccttgcctccgagcctaatcggtgtcatccccaatccttgcctccgagcctagtcctttttgcgacgacatctcgttggcgtatttcccaatcattgtgcggtccaaaaccatcgccggtcatgctttgctccgcccacatgtccctactggctgctctgcctactgctgcccggacgtccctgcactgcgtctccgccccatgcctcgtgcccattgttgagcccccatcagcgccgaatccgtgggcagagacaatctagcatgattgggagttcgttcgccaccgtctatgccacgaccgcgacggtgcacccatgagctcacccatcgcgggagcctatggaggcgttcaccgcctccttcaccgcgacgcccaccacaatagctaacctagaggacactgacatgtggggctcaccgtatgccacgtcagcgaaaccggggaaaaattagatcaatactgcctcgggactttttttttttttttttgcatgattggggaccttagacagattcgacgtaaagttcagggacgtcggatgaacttattacccagataaaatagtggtcccagggatgcagtcgcgacatgcgggccgggcctgattgggccggaatgggccgcctccgccgccaccacacggcgagtacatttctcgccggcaacacaaacagaaacaggagagagagagagaggagaagaaacaggaggaggaggagatcgaggagggga

SEQ ID NO: 53756 - DNA, 863 bp, Oryza sativa
agttacattatagttacagtgtaattacatacaagttacagtgtaattacactacgattgtactgtaattacatctgacaaatatcagggggagaaatttgatgacaaatatctagcaaaatcgttaattaaatacacacatcttaatccgattagctacaattcctagcaataaagtctttaagggataaattaattttggagtgaattgcactttgggccaccttttattgctgtagtttcactttagatcaccctagtcaattttttcactttgtactagctaaatttatgcttattgcactttggatcatctcaactctcttcattagccatgtctacctatactccggcaaatgtacgacctgctcatagacggagaattttgctagctgttataaccgatgtcttcaaggttattgatgtgataaagaagtgattttaggtggtctaaaataaaacaaatgtaaacttagttagtctaaaataaaaagattagaccaaacgtaatccaaaataaaactacgacaataaaatgcggaaactctaatgggcaattgatcgccgtggcgatcgggtagcgatcgccccccctccctccctccacctggtttccgtttttggcaccgtattactttcctattttagtaaatttatgcacctaaagtttatacacctcaagtttacacatttaaagtttagagaccaaaagtttataagtcaaaagtttatatatccgattcaaatttgaatttaaattcaattttttttatatatagtatttctatacatctaaagtttatagacttaaaatttataagtcaaaagtttatataccgttttaaatttgaatttgaattata

SEQ ID NO: 53757 - DNA, 1501 bp, Oryza sativa
gagagcaccttactttatcattgcgggtgctctaagctcacattgtccaccttctcctctccagcatcacccttctctcaacccaatccctaaaccctaaccttaacatagcccttcttgataaggtactatgtgctactacctccgtctcaaaataagtgcagccatgagtttccgcgcccaactttgatcgttcgtcttattcgaaattcttttataattagcatttttgttgttataagatgataaaacatgaatagtactttactcgtgacttatgtttttaatttttttcaaaaaaatttcaaataagatgaatggtcaaagttgggcgtgaaaaactatggctgcacttattttgttacagagggagtagcttactaactagcgcgtgtgtgcgaattactagcattcatgcacattttgtatttgaatttcatgttaggatggctgcgagtttccaaacggggcccgtgtttactattgtacgatcatgtgaccacagctatatatacgtacagtttcctcttctgtcttctttttgtcttgtttcttttgttggatctggagcctaccgctagtagtacgaggaggctccctgcccttttctgcaaaccttggcgccaaattctccaaggataggatggtcatagtactactcctagcactaatgtgaacgattcataggcccactttagtttatgtgccaaaattttttgaagtatacatacatacatacatatgtatgtatgtatgtatgtatgtatgtatgtatatatatatacatttaaagtattcaatataaactaataataaaataaattacagattccgcgagatgaatttattaagcctaactaatttatcattagcaaatgtttactatagcatcaccttatcaaatcatggcgtacttaagcttaaaagattcttctcgtaatttacatgcaaactagacaattgattttttttatatttaatacttagtacaagtgtccaaacatttaatctgacgaaatttttggaagttcagaggaaccaaacactgccatagttccatcacgtggaggttaggcttcgttttcccgcgccgcgcggcccctattttggcgcgaaaacacctccattcatgccgccccgatggcgcgaaaaccgctcggctgcgtgcatggtgggggcgcctctctctccttccccgcgtcgccgtcagagattcaaagattcttgtctcttctttcttcttttctacagtgtctttttcttctcccctcccttttctgttttctctccccatgaatcgtgcgtgcatgatcctgaaatccatcgatcgatcgatcctagggtttctatccaatccgatcttcaaaaagatgatgaaaggagaaaaaagaggatcaaatttcgtacaattcggatgcaaacatcttggatatcatgcggatccaggagtcgtatgatgaaacatcattacagtagtaatagtaattaagctaagatgtac

SEQ ID NO: 53758 - DNA, 1501 bp, Oryza sativa
ctgctgcggaggaggatgaggaggcctcggcgggtacccgggaacagcgtccatcgggatcccgatcggcgtgggctcgcctctccccgccgccgcgtcgggctgcgggcggagcacgatgtaggaggttagcccgagcgccgtggcgatcagggccagcaccccggcgccggcgaagaagccttccctgacgatgaagcactccgacgccacgatcccggcgtccaggaacatcacgaacgcgatcaccgccgcaatcctggtgcaagaaacgaacgtacatgacgtacgtgatgtgagatcatggtgacgagacgcgatcacgtgtcgtgtgcgcagtgtgcgtggttaattacatatgtggattatttgattaatttggctagatcggcgacgacgagtactactcaccatgagatgacggcgcagacgacgccgacgatccgcttggtctcggacgggatggcgcgggacttgcagcagccgcagcagccgccgacggccgtcacggtgacctgcgccatcaccaggaagatggccgcgcatacgcccagcccgagcgccgatgggttcgtcgacgagtataggcaactctgcaagacacattcccatcatgacattgtctgatcacttagatagtactccctctatttcaaaatgtttgacaccgttgactttttagcacatgtttgatcgttcgtcttattcaaaaacttttgtgaaatatataaaattatatgcctacataaaaatatatttaataatgaatcaaatgataggaaaagaattaataattacttaaattttttgaataaggcgaacggtcaaacatgttttaaaatgtcaacggcgtcaaacattttgaaacggagggagtagtaagataagatccagaacaaattaaagaagagggagaattaattcaaagacgagcagagtgtgcatgcatgcgtgcattgctagcgcttacagtgagcttagagccctcggcggcgaaccccaggatggcgctcagcaaccccagggatccgaccacgacggacacgatgatcgtcgtcttgtccattttgatcgcaactacggtcgttcctgccccggcggctaccgtattttgccccatgtcgatcgatcgatcgcgagatatccgtcttctaggcagatattgagaaacggatcagtggcgttgtgcccgtacgatggtacgtctgtttatatagagggctggcgagctcgatcggtcatcggtcacacactcacatgctgatgcagttcgaatgatcggcatgacggcataggcaggtttacgctactgccaacgagaggagcttagaataaaacggccttgatgcaacaggccatgttcgccataattaatgccttcgtggatgttccattctgtaacatgcttgcaagttggtggggattcatgtagtacattagatcgagaacagtcaatttacaacttagatgtagatgcatttatctattactacatgctata

SEQ ID NO: 53759 - DNA, 1501 bp, Oryza sativa
attaataaagtcatcatgaacgctgcattatcgaatggtacatcacctacttataaaaaatagtcataaatatgagcatccatattaaatataggacataaacctgaatggactgatttcatcacaaacaacctaactaattgagctacgatcaatttgtatttggagataatatttgacgttgagcatatgatttgatgaaaaatgttcaaactttgatgttacttttatatcgaaataagtttataaaacctacatgtttttctaggactaagacctatatattatggtgtttttcatggtaaatctagacagatcattttgtatttttataatctacggggctaaaagtttatctcaaaatcgtcctaaacattaaatatatatgcttggagccttagaggtagtataattttcataaaattcctgattccaaactagtagtagtgctactactcaaattgtttctccaagtgtcatgtcaatgggtggtgttgatactagctagactcgccaaacctacgcatggtctctacttaggttgagagaaaaaaacatttttcccgacgtaagggtctttttttcgcagatgaacatgactagccaaatgaccgcctaaaaaatataaatcggcttgtatcttctcacggctttctttacggttactcttgatgcaccccaataactactgtatagctagattttgtcgaatttcatgtcagctggtttggcttgttttccaactatggctagcctaacatcacccctgtcacacacaagatgttacccccaccctacggccagttgtctattttgtcatatgcaatttttagccccgtctctcctctccatgacaaacggcattagcagagtgataataacttactctgtcggtttcatattataggtcgctttgagttttttcctatttttaagtttaagtaagtttatagaaaaaacattttaaacaccaaatcattttcattaaatctagcacggaatatattttggtaatatgtttgttttgtgttaaaaaatacttctatatttttctataaacttaatcaaatgtaaaaaaaattgactaagaaaaaaatcaaaacaacttataatatgaaacggggaagtagacaaaatcagatcttctgacgcattgtcaccatgatgtcgtagctgacatgtggactctagacgattggtctcatatgtcaatgaccatatcacctataggatgaatatcatgttcatcgaaggacttatgaatactgtattaggattatgggcaaggaaaatgctctggtactatgtagcatatatgactataagaattttatagctaattataaatctagttcataagaaaaaacaatatatgtaccgatagatattggtaatttggtacatagccatattataatacatatatgcattatgatttatccatttaatacccagataaataaaaagcacaataaatataggcatttactttttttatcat

SEQ ID NO: 53760 - DNA, 1501 bp, Oryza sativa
agggggtggacctggaaggcctcttcctaggtcttaagcttgtcccggaggaattgagaggcatgaaaggatcttggtgcttgaagaagaaggatgccgaaaaaaaaaaatcaggcagtggggaagttattctctccacgagcagggtatgtcgaaggaatggtgtaggcgttgggcaaaatttggtgtccacagagagggattagggctaaggagttgggagataaccttttcctattctctttcttgcaacgcggggggggggggggggaagagaagagccattacggaaggcccgtgggaattcggaggagatctcatcgtagtggattttgatgagacgaagaggctgaaagaccttgtattcacacatttcccagtgtgggtcagggtgtacaatctgccgttcggcttgatgaatgtggatactggccgggtaattgggaataaaattgggaaagcattggaggttgatacggatgaggatgggtcagccgtgggaggttatctgctggtgaaggtgctcatggatgcccgcaaagccctaatcggcggggtgatgatggagggtgtcgccggtgagaaggagaattggtgtggagtgaagtacgagttcctgccaaatttttgttattcctgcggcgttctgggtcatgtggaggagtgtgatgataaggtatggaaggaggaagagcagcaattcggggactggttgcgagtcctaccgatgaaacagcgggatgtgcgaggctggagctcggaagggggcagttctgggggttcgtttcagcacaggagtgtcgtatcctggaggaaaagtggagttgagaaaggaggtagcagcggtgtaggtggaaaatctgctagccgggatgaccctgaactaagggatgatgctgaaagcccgggtaaagggcatcccaagatccggatgggcggtgctccgaagaagctgacctttgtcggtgatggtagttcggggagtttgactgaggagagagggcataaaaagctgctggagattacggctccctcggagccgcaactagttccgaccacgggtgaagtagctagtgggttagatggagaggacgctcgggggaaggagcacagtaccatgcaggttcctgtggggggaggagtaaaggacaaagtgtgcatgaatgtggatatacagggatcaatctcgttggaaagcaacgtcgggtaacagcacactctcccgttggctgctgaaagtggtactttggatactgggcactcggggacgggagataagaggaaggccactttcaagcggcgtccgcgagtgatggataaggaagtcggcgccaaggagagcgcgattgctgatactcgaaagtgctctgtaacggaggagatggttgtgaccgaagaacggaagaaacagaatgctcaggtggctgtgagtgatgacgcttccaaggtcaattatgatctgcaggcaggattggccggccaatcccgccgagataaatga

SEQ ID NO: 53761 - DNA, 1501 bp, Oryza sativa
tattattaaatctgtagtatgataatttgaacaaagtgcctgtagctttgtggaatttactctacggatttaggttacctagttcttttacaacacatgtttcttcctccatgcaccctggtgttggccggcatgcatctttgatgttgatgggtggtggatacctttaatctcctttcattttaggtcctgtttggttcgcgggacaaaaagtttttggcgtgtcacatcggatatacgggcacacatttaaagtattaaacataaactaataataaaaaaaattacaggttccgcctgtaaagtgcgagatgaatttattaagcctaattaatttgtcattatcaaatgtttactgtatcaccacattgtcaaattatggagcaattaaacttaaaaattcctctcgcaatttacacgtaatcggtgtaattagtttttttttctatatgtaatactctatgtatgtgtccaaatattctatatgatagggtgaaaagtttttgtttactccctctgtcccataatgttgcaacctaggatgggtacgaatctggacatgcctcatgtccagattcgtagtcctaggatgaggcatgtccaaattcgtagttttaggatgggtctcatcctatcctaggttacaatattatgggacggatggagtagaaactaaacaaggccctagtggccagccactcaggtgccggtgcctagcaagcattgactacatacatagggttgggaaggaggtcgccatgtatgtcattaacacccaaaatcctaataataaagggtcactatttgctaattaatctgagaaaaggtgtggatgtcatcatgcgttgttttatgtatgtagttaatgaccgactttaaagtaccctttagaccgggttatgtttggttccgatatatttattagattgcaaaatgacaaaacaaagtcaaatcaaagagcggagctatagtgcaagaggggatgcctacaactcggtaaaattttttaactataatttacctgtttttcattatatacgtatccttctaatacaaacttagtcattcatatcagcttaaacttatccaaagcagagtaaagtttgcgggtgacaccccctcaatattttttttaaactacccctcaatttcatatacaacaaaaaagattacaaccctaccattacaagaaaaaaaccaaataaacatatgttaaaatagaataatgatgctgcacctcataaaacactgaagatatgtgagctgtagagtgcagccacagcgctggcagctctggtatgtaagaaaaaaaatacattaataaatatcggtcaccatttttatttcttcttacagaacagccgaccgatgtcgtcaaacatgtcaaacaagtcgacgacctgaatccgcactgccaattgaattatcaacaaactagaaattaaacaatcttaattgattgatgagtgatgacattgtgaacgggataaccttaaaaaga

SEQ ID NO: 53762 - DNA, 1082 bp, Oryza sativa
acgccccaatcccgccacaccgccgttaacgaacgagacgaagaccgatcgaacgacgagaagcgagaacgaacacgtcaacgtacgttgccgcgtcaacgtgaacgagaacgagaacgatcgaacgaacgtgaacgagctagggaacgtgaacgagcgaacgaacgaggacgaacgttatcgtgaaatgcaatatatatatatatatatatatacatgtatatatatatacatgtatatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattagtattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 53763 - DNA, 1501 bp, Oryza sativa
tagaaaattttttttttaaaaaaactacaccgtttaacagtttgggaagtgtgcgtgcagaaaacgaggcggagggagctggaaccagctagaacgaagctttaggctgcgttctttcaaaggagatttgggagagattgaggagattgtgacttgttttccgtgcgcacgcttcccaaactactagacggtgcgtttttttgtataaaatttctataggaaacttgctttaaaaaatcatattagtctatttttaaaatttaaaatagttaatactcaattaatcatgtgctaatggctcacctcgttttgcgtatcttaccaatcttctctatctcccctttctcaaactcagccttagtcatccaaaggagtggttttgctatccggatggagagtgtattgaagctatttctttttttttcgtgttagtcaaattttagcttagagagttaaatagacattttcgttggagatgctcttacctactcattgtgaaaataatacgaaaaagaaatgcacttatgcttgtaaaaataccttggtcaaatcatgcgcggttcacacttcacacgctcttgcaagtgatttgcaaatgctcgtgatcgtgcaggcatgtggtgcagcgaggtgactttggattccttcaaacgtacagccaacatctcttgcatatgtacaacaatcagctgccagcggggcaggaataggatctgtggtttatcccccatgagctatgatagctgcatgtccaacgagaagagagtcaaattaaatctcctagtctgccagacatattcacgacctatcttaattaatattccatctatttcaaaatcaaaatattgtaaactatttctgaattacacatagcttaatattatgaaatttaaacatatactggttcaaattcgtagtatttggttgtctaatccaaatagtaaattactactccagtgaaaatatagtactgcaacctagtaccggatcgagcacatcctagtattataaatatgaacaggatcaaacatatcctagtattacgaatatgaacaagagtaaccatgaacaaactcctatccaaattcaaagtagtaagatctatgtccagattcgtagcactagaatatgctcaattctattttgggatggagagaaagtagctacctatatcaattatattaattatttagcctcaacgaacatggcaccttgcacgtacgttcagctgtaaatgttctttgctgattgctaaccagaagagaagaaaccctggcagctcgatggcaataccttgattccttaaacaaagacgcatgcaactgccagtccctgctaacatgcccatggtaaaaacggacatttggaaacggaggcgcgccgaacatgcccagaacatgcatcatgtccctcatcctgttcgttgacttcaaccatgtgccgatcgaaccgtgtagttggtctatctctatataagctcacacaaatctgatctgtcacc

SEQ ID NO: 53764 - DNA, 1501 bp, Oryza sativa
catggtggactttcatcagctgatcattccggggtaatttcctactaccaagaggttgtgtttattgttgacctggtccttaggacaagttcaataattgagatcgatctgtgctatttcctagtttgtgtttattgttatgagatttttggatttagagattatctctgttggttttccgtatagaaattaaccttgtcaaattttgatgatgctaaattttaacataaccaaatctttacaagggaagatgctaaggtagtttttgtttgaagctttgccaaattttggatttaattttaaaagaagtttatggagttaccaaaatatgatagaggtaatgatagtggaggcatgctagtttattgcgtactcagtgtttaggctgaaattttcggccacacgtaaaatgagacaagtcattagcatgtaattaatagagtactaattatcataaatttgaaaatatatatttatttgtaggaaacatatcgtttagcggtttatgaacgttctaacagaaaacgtaaatagttgttccaaaaggctgaaatgaactcttgctaaggctaatttcttgctaaggctaatttcgactacaaactaaacatccttggatttattattgatttttgaaaaaaatatccattttactctcgcatactattccattggttcacttaattaactgtctaaactattttttactacttaatagcatttttttctttgtttctctttatatgagttgcattttaaactgaaatttagtagagccatagatggaaacattatcaaagttcaaaaataatttaaaaaaatttcatgagtatttgcttgaaatttaaaacctcgatatttaaatcagtctcaatacttaaacagtgataaaagaattcttaaaaatgctgataggtaagttataatgcatctatcaattctactaaatttcgttgcaaaattcaacttacatagagagaaaagaaaagagagaaacaccttttaggagtaacgtgttctattttcaatagttcagggtataaaatgaaaataagatgtttagggtaaaatgaacccatgaaatagttctagggaataaacaggacttttttcttgaatttttatgaagcaatacataacattattattattattattattattattattattattattattattattattattattattaaatgtataaccatttatatagcatgtagtaatagataaatgcatctacatctaagttgtaaattgactgttctcgatctaatgtactacatgaatccccaccaacttgcaagcatgttacagaatggaacatccacgaaggcattaattatggcgaacatggcctgttgcatcaaggccgttttattctaagctcctctcgttggcagtagcgtaaacctgcctatgccgtcatgccgatcattcgaactgcatcagcatgtgagtgtgtgaccgatgaccgatcgagctcgccagccct

SEQ ID NO: 53765 - DNA, 1501 bp, Oryza sativa
actgtttccttcaggacaagatgattttctttcttctattaatttcattacagagatctaaagtagatatatggctacaattaaacaactgtatctatcaacaccacatgaccgatcgaagacatcggcaatctaccattgagtcacatttgcagcatcgcatacataaaaaaggagtactccacgtcaagtggttatcactaattgaagacaaattaatagcagatcgctacgttacaacattagacagttttcatatgttctcttttgctgtgtgatagcatctataatttctcacagttcaatcaacattgatcgtctaaagcctttcttttttataatggatcgtctacaagttactatatgttatttaatatttttattgtgcttgctaatatgttttaggtcttacacaaattatagctacaaattcccgcagcaacgcgcggggtatcatctagtttcctttacacttacttccattctctcctttgctcgtgatgccaactgctttctcacactttgtaagaagaaagaaaattcaagtgcagtcattatcgttgatactaactctaatgtaaacttttatatatgttatttgagatttaaaagctaattgtaaaaataaattatgatgtaaaaatttcaaaatcaactccaaaattatgatttataattcaaaaaaaatgataacagcttataagctgaaagccaaacaatgaggatgtggatttttagtcctgcctctttgagtatttaagatctcactgccagggatgaatctaggcccagcccgaggcctagagcgaaatgcatagaaggatagttattttttcagtatgtaatcattatgtaatgtccaaatagtctttatgagttggcccgagccttgggccagtactgggtctattcctgttcaatgcaatttgagagggagcctaacgcgtgcacctctccccacttgacgcactcgccctgctttagtccactactgtttttttatacatatgtatatactttgtatacatatgtgtgtgtacaacatgatgagtgtggggtggtggtaacctgacccaaaacggtttgaggaaccttgctgcggatgcccttaggtggtactgcagtgataaaacgagagaaagtgtgaagccagtcattgctcattggcaaagggcgcgtgcattaggattatcaaacggatcatgtgtgcaaattttagcactattcatatactccctctgttcgtaaatataagggatacactattcccgtgtaacgtttgaccattcgttttattcaaaatatttgtacaaatataaaaaagaaaagttgtgcttaaagtactttggataataaagttaatcacaaataaaataaataataattttaaattttttttaataagacgaatagtcaaacggtgaaagtaaaatattaaaatctcttatattcacagatgggggggagtagtatacacaaatttagccgtgattggtgacct

SEQ ID NO: 53766 - DNA, 1501 bp, Oryza sativa
attggagcgaacaaaactcgggatcaaaacggttgaggaagcttactggccggccatcatcgacgacactggccggccatcatcgacgacagttaaatggagattaaatccgcccaagccgaattgtaggggaaaatcatgggaaaaatgatgagggatgagtggagaatcgatttttgtaatcaattagaggaggaaacgcatggggaggcagattgacatggcgacggagctagggttcggcctagcgaaggaaaaacacggattggtgacagccaacgtgattaatttatgtaggactaacaatgcacttcttcttgttgctgggtgtaacaattttgttcagttttaatatttctaattaatgtaatttaaattagctggacttataaattttttacccattagttgaaagggtaagttaacctgaggtaaccaaactctaatatatgcaaccaaccaaacaagattttccctcatgtgcattcatccaaccactataccattgcatccaagatcaactgatctaaccagccaaacaacatcaattgtacacacttatccatgacacggtaagccaggatgatccatacgggctatgctagactagtgcagataaacaaacacatcttagtggttcattccttgtgtatacataaaggtatatagtttaaggaaacatagtagccaagggaacctattaagctgctaactaacggaagaaaaatctgctaactaagggaagaaaatcttttatagttaaagaaaaaaaatactgctagcttaccacctaaccctctagactaactcacaaactatagtaaggattatactaacaaattattcttttgtggaaaataatatatatttttttatgtagctagctagctagaagttctccttgaatattttgtcaatgcaatctaaagacgcatatggtcatgatcttcaatcacttttaagacctacatttaatatcttgtattgaagatgtcacttctcgcgttgtagattagcatctaactgaagacatagattctcaatattgaataaggtataggatatttccaactagaatcaagtatctgagatcaccttcaggtatgtgccacttagcatggtaatctccaccacaaacacattagttatatcaatattaacatatatacctaaaagagtgaattaattttaagaccaaggacaatcatatgcagtgattctacatatactgagtggataatataaatggataaaatgttgttttttgattgtttcgaagaggtgcatcttcaatgtcatcagaaaactcgagcatccacagtgacaaaaggatgtaatgctgcctagcttattatcctcaactattgtcatcgacgaactcgatgttaatgatgcaagactcgtgagcatatctctattttatagcccacagatttttaaaatcaataaaaagcataaagtatgataggttgatatattagaaactaaattgcatgttagt

SEQ ID NO: 53767 - DNA, 1501 bp, Oryza sativa
cttgtgtatacataaaggtatatagtttaaggaaacatagtagccaagggaacctattaagctgctaactaacggaagaaaaatctgctaactaagggaagaaaatcttttatagttaaagaaaaaaaatactgctagcttaccacctaaccctctagactaactcacaaactatagtaaggattatactaacaaattattcttttgtggaaaataatatatatttttttatgtagctagctagctagaagttctccttgaatattttgtcaatgcaatctaaagacgcatatggtcatgatcttcaatcacttttaagacctacatttaatatcttgtattgaagatgtcacttctcgcgttgtagattagcatctaactgaagacatagattctcaatattgaataaggtataggatatttccaactagaatcaagtatctgagatcaccttcaggtatgtgccacttagcatggtaatctccaccacaaacacattagttatatcaatattaacatatatacctaaaagagtgaattaattttaagaccaaggacaatcatatgcagtgattctacatatactgagtggataatataaatggataaaatgttgttttttgattgtttcgaagaggtgcatcttcaatgtcatcagaaaactcgagcatccacagtgacaaaaggatgtaatgctgcctagcttattatcctcaactattgtcatcgacgaactcgatgttaatgatgcaagactcgtgagcatatctctattttatagcccacagatttttaaaatcaataaaaagcataaagtatgataggttgatatattagaaactaaattgcatgttagttctaacactctacgaatacacaaaataacataatcttacatacttacaaatccatcataataataacgttacatacttacaaaagaaaagaaaacagcagcggaattaacggtctagcgatggcttcagctccactcccacaggcagctcaactggggtataagccaaatggtcaaactttaaggacgaatttttccgacaaaaatgatttgtgaaaatttctcctttcttccttatctagaattctttgcaaatcgtttcattgtctactctcctctctctttcaacttgagtagttctaaaactagtggtggaaacttgaagatattgatgtggacaatttatggaggtcagtcaagtggatcgaggaagaaccgaagtgccaagtggtcaagatagagtgaagtttggaacctatcttagaacctatgccgccaaagtgtctttgaagaatagttagtagggtagaacgcttgttgtttgctttgtgtgtaggtatggttgcatttccatcattggagaagttcattgatgagtgtgtgactatactaggttgcttgcttaatcaacttgaacaatataatggtctacacacatcagatcagtgttaacctggttaaggtcttgtctttagtgtaacccct

SEQ ID NO: 53768 - DNA, 1501 bp, Oryza sativa
tgaaggatgaactgtcagttatgttgatctcccatgactatgttgattttcagcagctggttgacaaagcaattcgacttgaagacaagaataacaggatggataaccgtaaaaggaaaatgattgtattccaggaggcacaggatagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattatcggagttatggaataagatagactgcagtttacctatgcccttttctttctagccgttccgaatctcgggacgagattctttgtaaggggggtagatttgtcacatcctgattttcgtttcaggatttataaattatttaataaattattaatagaatttatattaaatgttcattaatttacaagtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtattcttaacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtatcttatccgaatcaaactcgttttcgagtttatctccaaaaccgagtttttgatttcccggatcgatttc

SEQ ID NO: 53769 - DNA, 1501 bp, Oryza sativa
cggtgaaatcgacgcgcaacgccgcaattcgtttctgactgaggtggcgcagtggctggagcgaaaggcgcctcgccggcatgacgtggactgcagcggatcttcggcaacatcacagcgccattgctccatcttccatcggcaattgtgctcctcgttggcaagtggcggcttgaacagtagcatggcgctccccggcgaccgatctgtgtggcagctctaacgatctttgtgctcccctgttgtgctgctaatctccattgagatcaggtcaaatttccccaattttgttgtttccaattagagagtttctgtagatatgtttccaattatagcgtcgtcttttgctcatatatcatttttgtttagcgaaaatatatgatgaaaatttgtatgtgtggtaacagaaaaaaaaattgcaatcataaaatcatatatatagtctggttctgaacaaattacatatcaggttaattcatgtggatcatttggttaattcagacaaaaaaattgctgtacataattgttcaaagaaacctttttttaagacaaatatgagctcatttttagaagaaaaaaatccattcctctacttcaaacagtgatcactccaagtgcacattctatcgaccatattatgatttaatgagatgcttatagcccttctggtgtaaatgcagtcaatagtagggaatctctcctatgtggtcaagggtgctggcttgctggggtctccgtcaccctgacatcaggttgccgtcgatccatcgccttcatattttgttgggtaagaaacaaatcaacgattcttcaacaatttgagtttgcagtagatggagtgttatatcgactgaaatattattttttattcttttgtttgtaacctcaagcttcccagattgccaattcctgtcctagattgttggtagtttgtctactgaggattctgtactggaaaacatgtcagggcagtgtggcgttgtgctgtctgtgaatacatgtttctttgagagggaggagcatgagagagaacgccagatttttttggcattctcaactagaatgagaaatatgaatacactgttcgaattttggaagatgtgaatctgccaagatgtttgccaagctctacatacaccatttgtttgctaaggtgttttcagtaaaattcctttgggcaactgtgacaatggtaaatcaagaaaatgatggtaatttaccaagtgcttttctaccaaattacatcaaacattgtatatattttcatgggccatattggaaatgttgttttatggctaatattagcattcttattttttagatccgataaatttcaggttgcaacttacaaggatcggttttggtaggaccaccaagttgcctaggattttcgggtaaggattatttgttgttctgatgcggatcatggaaatcgtgtgaaaaattatccagattctggtcttgaattatacttgccaaaactgacaagattatatgaata

SEQ ID NO: 53770 - DNA, 1501 bp, Oryza sativa
gtttttaaatctcgagttgaaaatatttaaatctcgagttgaaagttttcaatcccgagatgaaagttttcaaatccaagttgaaagttttcaaaatctcgagttgctctcaagttgaaagttttcaaatccaagttgaaagttttaaaatcccagttgaaacttttcaaaatcttgagttgaatgtttccaaatctcgagttgaaagttttcaaatcttgagttgaaagctttcaaacactagttgaaagtttttcaaatttgagatgagaagttgaaagtttttaaattttgacttcaaaaattcaaatttcgagtttgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcacgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatacacgttgctaagctgacacgtggtggacaaggatgactgatttgtgaccggtctgacactggtcgcgtcatcaacagacagccataatcccacgtcgcacctgtttccggcggaaaggggggtagatatgggccgtcccgtcagaagggcacccggagagcaaccgtaccgatctccgtccatttatgaagagaagaacagtccagtttggagagggagaggggcatgtggtatccccttgagatataaaaggaggaccttgcccacttagataaagagaggacttttagacacaaggccttctccagatccgatcccagggcgattgggggctggttgacactttgttacttgttcatacacaaatccactaaaacacaggagtagggtattacgcttcccagcggcccgaacctgtatacatcgcccgtgtctcgtgtttcttcctagctggcgatctttccacataccgagagagcttgagatttcaccctaagcccccggccgaaccagcaaaggggggcctgtgcggtctcctggtgaggagccacgagctccgtcatctggcgcgccaggtagggggctcagcgtgtgttttctgagctctcgtactcctccgtgtgcgccaagtttttcttgttcagcctaa

SEQ ID NO: 53771 - DNA, 1501 bp, Oryza sativa
ctgccaccaccgcagccggcttcgccgccgcgaggacaagcctgtcggccgctcccctccccaaccgaccgccaagctgtcacctccactgccaacccgaggccgccgccgctttcgccgccccggccaccgtttaccgccgctcctggccgtcccgagccgcacccgtggccatcctcagcgtcgccgcgcctcggtcgccgcccctcgccgccgaaattccacgggagcccgcttttccccgttcaaggtcccggaggcccccggccgtcactcgtcgcccgtcggccgccgttggggcgccgccgtcgtcctcgcccggggagcgccgccgctacctcgcctccgtccggtgccgtgccgcttggtgagcatcccccttcctcctctcctttccgccgcccttcgcgcgccttctcgcgccgccgctcgccgccggtggccgtgcgccgccgtgcgtcgtgtctcggccgggccggctctgagccgtgcccgtgctctgggcgccctgcctcgtggccgcccgatcagctcgagctgatctgggccgtcggttcctgcggaccggcggtggaccaccccgtggtcccggtccacggtggaccgattcccttgacccgctggcgtgtggggcccgcctgtcggcgccggcctctttgatgacgtcagcacttaagcttttcctttgtaaaaataaataataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttagtttttatgtactattttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgtcatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctggtcgcacccatggcagttaaggaccgattcgcgggatgccctggaagaacttatcgtacttaccacaagccagcgcgggcaacggctgggcttgtagtgtagctttcctctagtcgacgcatccaggcaagggtgggcgtga

SEQ ID NO: 53772 - DNA, 1501 bp, Oryza sativa
aagttactctgagaacaagtacattgttgatcactcactactatatctcctgtgataagtacatacacagatttttgttaagcaattgaatgacatgataaataatctatattattacatcgcagattgatgattgatacatgtccttatgtccctgctgcgcatgtaaataaacagatgaatacccatgatgattatcaggattgaattgctttctatgcacttaaaattgatgggataatttgaacaatgttagctgagcgtacattaccatttcagctagtaataattacattatagcttcctcttatctgcagtgcttgcatgaacaataaataaaggccaatataatcacctgatcactatccctcaaataaaacacaaattgtataaatatgaaaagagttgttaatccaaatgtgtgccgtgtattgcaggacagcggcaaaatactcgtacaccctctaaactggaacagcgggagtaaattttttttcatttggatgtgtatacaataaaactcgtcacaatttgcaactgaggtgaatcgagtttcagtttggatcatattaaatctaagctttgtaaaatgggactgacataattctgcaataaaggattcacattcagttttagagaaatatcacatataaaaaggcaacattcagatagtgctcatctagtttcagcagggggaacaatttggtgtaattatttagtatgcaacattctaacagttcacatatatatttatcaagtggtcaacttaaggatctcttactactgctgaatgttcatatatgtcaatccaacggacaaaaaacaactaaatgcattccacttatcataggcaagaatttgcatctttcaggttggatgcacaaacatacacattcaacagtgcaagctcattcgccaacatgtggttcttcacctgcaacctaccacactcccaagtcttcttgaagatttctttcctgaattaccaataatgcaattcactaatccatgatcagagaaaaagtcagggacatcaaagatgactgctgaataaatcgatcatacctccattttcagattgagcagcttctgaacacattctttctttgcttaactgcctcccacatcacctcctgcagccgcctgctagcttatcaagaaaccattagcaaatatgatagtacaagcatagcccaacatgagatctggtaaatgacattaacgctcaccttagcattgagctccgggatcatcttggaagaaatacaatagcgttgatgctaactgaagcggcagctaggatttggcttcagctcctgcatgtaagtacaagtcacctcacttctcaaatttgtgatgtaatagcatttcaaggcaatctttaacagtacatcaccaactgaattggggcaggcacaagtgtaaaaaagcaaaaaaaaaaaaatcgagggtagattacaagatataatggcaacaccagcagcagtgtccactacctcca

SEQ ID NO: 53773 - DNA, 1501 bp, Oryza sativa
cataaagtatgcggatacattatatcttcaagtaaacggaaaggatccatttgaattaaggaaattgatgagtccttacgaaaataatatctacgaacaggggatatcagagtcctacttataggggataattaatgacgttgtcatatcgtgcggggtctgttgtctccaagttctacttggagaccaaggtgatctgcggtataaatagataccccctgagaggtatagggcatcgaatcttagtgcaagacacccgccaccacataagcaatccggaggacttgaagccaattcatcgatagatctcgtcgaggctctctcgacaagaatctcgtcggtaatcttggagttatgttgttctctgttgtactctgtggattcttctataatcccatataaactggattaagaatattaccttgtgaggtgcctgaaccagtataattcctatctttttatgtgctcgatgtcgtatcgtgtagatcctcgtaccaacataccccgatacccatagaatacggtccgtgggaatcccgtcgacattataaatttatagagttcaagaaaacttagatccagtgttgtgctaaaacaatcttaatatgacttatatttacaatatcttattaaacattgcttgtgttaaaacttagccaaagtttaacagtagacaaccaaaccgacactaagtatatctttaagagcgagtaagtaataactttggtatatggcgttattccacatttcctaagttcgaaaactattttgtaataatacacgtaagttcaaaaactatgtctacaacattcaacgttacaatgtcatataacctcacaaattattgctgctgtagcggttccaatcgaaaaacatcaaatttcgtcttggagcaactcgatagattatggagaaaatctcaaacccctaagtagaatcataaaaaaaagaatgcgagagaccagatcagataaagagtctatttgagagagtttatggtcctgtagtttcctatctggccttaggttataagtcctcagctatttgtcatcttgcttaaaactgtaatctttctcagactgtaatcttttatgaattaataaagctccttgtattcgtcgaaaaaaaaagctttctcaaaaaatttagattttcgttcaaattaaaaaatatatagtcaaataaaaataattgtacgatagaaaccgagaaacccaatttgttagattttcagaaaatgattagcaacgagctttgcctttgattctcctgggtcctggccatcaccgactcaccgtgcggtgctcgcacccccacaaaaccggtcacatgctgcgcataaatccatccaccccatcacgcgaccccacacgaccattattcctcctcctctctggagtctagtctcctctcctcactcctcactcgccccactccgccgcttcactcgcgagctcgtcgttggcgccggcggcaatggcgtccccccgcgcgctctccc

SEQ ID NO: 53774 - DNA, 1501 bp, Oryza sativa
ctggtccacttcttttctccgactccgaccgccttccatgacgagcacatgatattttggctgcttgatacaatctctatatcacatgcttgcttcaacggaggaagtattattttcatttggatgtatagaaataaaactcattacaatttgcaacttaggtgaataaaaaataccatagcttggccttagaaagagagaaaatcagaatattctagaccaaaagctttctaaatcagcatacctgatattattactatatgaaaataataatccatgaccatcgacaattatatattatcacttcaatatacaatatatgtccacacaaaaagaaacagtagagttatttttatagatattcatataatcttgtcagttttggcaagtataattcaagaccagaatctggataatttttcacacgatttccatgatccgcatcagaacaacaaataatccttacccgaaaatcctaggcaacttggtggtcctaccaaaaccgatccttgtaagttgcaacctgaaatttatcggatctaaaaaataagaatgctaatattagccataaaacaacatttccaatatggcccatgaaaatatatacaatgtttgatgtaatttggtagaaaagcacttggtaaattaccatcattttcttgatttaccattgtcacagttgcccaaaggaattttactgaaaacaccttagcaaacaaatggtgtatgtagagcttggcaaacatcttggcagattcacatcttccaaaattcgaacagtgtattcatatttctcattctagttgagaatgccaaaaaaatctggcgttctctctcatgctcctccctctcaaagaaacatgtattcacagacagcacaacgccacactgccctgacatgttttccagtacagaatcctcagtagacaaactaccaacaatctaggacaggaattggcaatctgggaagcttgaggttacaaacaaaagaataaaaaataatatttcagtcgatataacactccatctactgcaaactcaaattgttgaagaatcgttgatttgtttcttacccaacaaaatatgaaggcgatggatcgacggcaacctgatgtcagggtgacggagaccccagcaagccagcacccttgaccacataggagagattccctactattgactgcatttacaccagaagggctataagcatctcattaaatcataatatggtcgatagaatgtgcacttggagtgatcactgtttgaagtagaggaatggatttttttcttctaaaaatgagctcatatttgtcttaaaaaaaggtttctttgaacaattatgtacagcaatttttttgtctgaattaaccaaatgatccacatgaattaacctgatatgtaatttgttcagaaccagactatatatatgattttatgattgcaatttttttttctgttaccacacatacaaattttcatcatatattttcgctaaacaaaa

SEQ ID NO: 53775 - DNA, 1501 bp, Oryza sativa
gcttaattttgacctgatcgagattaacaaggttatcaccacacatataatgcttgcaatgcttggttagattgatgagccgttgtgtggagatggaccaacctaaacggttttttgtagcgacaagtgcaacgcattctcattattttttttcatttttttggcttctgtcattttcttgtggattagttcattattacaagaatgtgaatggatttggttatggctgcattgtgcgcattatttatgaaggcatagacagatttgttaaatataagtgctctacagattatatgtattattattaatgcgcaaacttgtagttaattaacacatagcgttacttatcttttacatttaagtagtgtatgaatttctacgtttttaggtatgcaatcagcgggaatgttatatatgcaattttatgattagttttgttgtccattcagtaagaattaagtgatatttcaagatatatttattactcaatttacttattagtctgatagatcttgtccatatcttaacgaattttaagatactatatatctgattcaggagtggaaattagattgctttggaacttttggttatcgagaatcttggtccactcatgtttatcattagattacaaaatcgatcgtttcttatgatataagataacaggtattctaattaatctattcacactaggtataggtaacagaacaaaaaagtagttatttggctatctttattggtcaaagtattggaggttcctgttcctttctatttcatgaaaagttcatttaccactttattcttttttcctgctctacataaactgaaacgtttatatatcctggatatacattttttcctttattgtgtggctccttgtgcagattcttcgctctatgcgtatccattgtactctataaaatttcatagttacagccacctagtatctcttttgactaataattgaaccgcacacgtgtaaatttataccatacatcttttatatcaagaatacgtttcaaccgatgagttatcatgttgctccacacatttttttatagaaaaaaaaaccctatgggttggtatgctcaaaagaaaaaaaaatccaaaacttgcaactcttgcaaaattgcgacatttggttcgaagatgaccctagaattacaacatatagcatatttttccctttctacttgctaaaaggatcaaaaatcatcatggagatgcattattaaaataacacggagagaatataacaagtgaacaaaaagaggggggatttttaatttgcattgccttttggctttctgtacgcctggctgaggatgaaacgatgaactgttggcctacattccttatgctgacacattgatggatcacgccatgtccaatcaaattgcaaaccgtcgaccagaaaaggtctccctgcatcaaatcaaattgtaccggcggcttctacatcaccatcgcatcactatttgctcacacttatttttttctt

SEQ ID NO: 53776 - DNA, 1501 bp, Oryza sativa
agattcctacgaactcactatttccagcagggtttacgattccgacgaaatccaaccggatttcacgaaatttcgacgtttcgacgaggctcaaaagtagaaaccgtctgagatttcgagaagtttcatccaaattgaaatttgaattgataaaaaaataaaataaaatcttataaatactatgatattcatagaacttattaggatataaattttcgaaaaacattatgtattgtgtgtatttactgaaacttacatcaggaaataaaagaataaagaattaaaaaaaggaaaacaaattactgtttcgatcggaatttcgccaaaaccgaccggttttcgagaacttgttgacaaacttagggaatttgtattcaaattttggtttatgaaatttgttcggaatttaccagtttttcaccggatttcgcgaaattccgaattccgccagtgcactaaattcgtatgataatttttaaagaaatttatcacggagcaaatgcacaataaaaatcatagtgcttattactgtctaaccaatggaggaaggaataaaataattcctcgatgcattcgtcgcctcttgtggtgcttatcacagtgcttaatactgtcgatggagaaagaaatgaaaaaaaaaaaagaaaatcctcgatgcattcaatcggttcctcggggaagaaagctcgccgctggtctggtcctccacccccgccgctcgctgcccctatctgctcctcgtggccggcggatctggggccagcgagctcactgccgcctcttgcagccgtggaagaaagagaggcaatcactcatcgcctctcgtcttcctgttgccctgttgtttgctgcacctcatggccgccatgcatatgcagttcgtcggagttgaagaaggagggcggtagtggcatgcgaggaagatggcggcggcggcgcaggccagggctgagcctcaccaaaccctcgtttttgctcgcacgctcctggccaggccgagttgtgaagctcgatttgagcgtttctgctcagcctggctgaggagctctttttgcatgggaaggccatccagacaaccgaaaattgcatccacagatacgggccaagcctcatgcagatgcaggcaaccaaacacacctatatttcacggggtgcatacgccgggtgtacggagaaacccccgcgacgccccgcaactgacgggcccgcggcgtggtgtagaccgcccaagaattggtctatggatagagagcggtgatccctctcgctgcggcactgccattttccatatccacccttagaatctccgcaaattcgtcatctactccctcgcatcgcatggcaccagcttccaccaccggcgacgcgccacgtggacgtccggggacgctatataaagccggcgccctcggcctcctccgcgacccatccaaacacccatccgccgccgctggctgaactcgcgggtgatctgatcggagccggaggaggaggaggagga

SEQ ID NO: 53777 - DNA, 1501 bp, Oryza sativa
agtacgggagtactcagcaagccaagggaaataagtgtttaatgcaggcttcaaggaaaggctgttgtttttgcagttgattttatttgaactcttttctaaaaacaactaagtgagtgcttctcaaacgacacggttgagacagtgcgtctcgtccggtcggagtacgtgcaatgtatcagtctttaaaatttgaaaacaaggttggcacccggccaacagcttttcaaacggccacccgggccaacaactttcaaacggccacccgggcctagctgatcccatcagctgcagattttacaaacatcgaacccctttccacaacagcaatttcacaagcagtagtcaaacaaaactacgctaggaatcatctcacatccgcccatgaccgtgggcacggctgttcgaacagtttgttaacctctgcagagggggtacactttacccacacgacattactaacccggatcacccagcccatggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttttgatgaaattccaaggaaacggtccttaagtgcaagagcggaaaaccgtacacccggtacgttccccggtccgcggtttcggaaattcatttagttcgcaagcaccgacccaggtgtcgggttttccaagtcttttgtaaaacccaagttttacccaagttgttactcagattttaagtttgaaggcgaccgtcgatactcgcacagagtgcacgaatatcgaggtgcaactagatggttacaaggggacatggtatcacaattaataaaggaaggatcaaatgcaacaaattaggtaggtccgccaatctgccttgcagacgggacaacaggttaagtgcgatcctatcaatgcataatattttcaaacaacataattaaatttcaaatataggctcaagatgttcaaaggtggcttgccttgctcgagatctggagcttgatcctcgaaatcctcgcgctgcgggtcttcgggctccgaaactacacgcgaaacaaacggcgaaaataaagccctattaatgacctctaagcatgccattagatagatctcgagatttgaggaattttggaagttgaacggagtcaaacggatttacagttgggaagatattgaatttataagattattggatttttggtctaaaggaaaaggatttaattaagtcctttttgaaaaagaaaagaaaagaaaggaaaagagggagggaaaatagacttttcctcgggcggctagggcgcggcccgagagaga

SEQ ID NO: 53778 - DNA, 1501 bp, Oryza sativa
ggattgaattctatctaatcctttgaaattcctatgaaatggacattcctatagagattttagaggaaatttagcaagagcttcaacctcttggtaactttcctttgagtctatctctctcatccaattcctgcgtttttcctgcggttgaatcaaacggtcattcctgtgttttgttttgtaatcctctgttttacacttatattcatatcgaaatcctacgtttttcctattcctatgttttctcaatcctgcgatttaaaggggccctaaaacttttctggatccacccctacgtacttggtcaccgtcttacgtgtgataacaagcatgagtaaaatatagcctcggcattccctgaaaataatataacctatgctcatcatttaccatcatcatcaattaaatcattctctcctgcttttccataaacctagtattgtaatgtgcagccaagttgacatgaagagctgatcgctaagaagttgggcttcaatttaaaccaaaccccgcgcgttgctgcgggagtttagtataataacgataagtaaaaataatatgtaagatagccagagtgcttgacaatataagattacgtaagttaacatggtttatgataatttaaatttaaatagtatatagaatgatgattcaaatgtaaaaggaagatcatatgactttataaaagaagaaaagtattgagatagtttggaccgtagattaatcatctaaatgctaaatataattgaggtgatatagattaatgagagaagaaaatgagagagataatttggaccatagattattcatttaagcactaaaaaccaattgatgtgatatagtgatatagcataacgagagaaaagagaaatgatattgagaatgaactatataggtacataacatattataaaaataataaagatatatattgaaatattacgtgaattacgtgggatgatgatttaacatgcttacattttaaaagctataaaatttaataaattataaaattatagattatatagcatgtttgtatgatgtttaaatttaatgattattagtggatgatgatatggcatctttgcatgttaattttttgaagttagtgtattataattttatagtaagtgaggatcagagtaaccattcgagaaaaaactctcaggtagcctctgtatccgcctccatgccttatcccgactgatattccttcacacacgctcgccaaaagtagcgaaaggtattatctcttgctacagcatccgtctctgctgcacatccagaagcaattacgattatttttcttgaaattctctcgttactaaaaacaaatttttcctgacggtcattttaagttttctctggcagccgacgctaccgtccacgactaatgaccaatgaaaatacaccattttcacttacggttaccagctaccaacgtagatggattttcattggcagacgacctagtccagccaccagcgaaaatggttttggc

SEQ ID NO: 53779 - DNA, 1501 bp, Oryza sativa
aatgcaaagattataatacttctccaccggagctaggttagattgttgggcccatgtggtaaccccttgaggtataaaaggaggtccaggcctagtggtggaggggggggatttccgagcgaactggcgcttgggtctcgcaaccccaagcacttgtgttctacattcaatcaatcatgcacaggagtaaggtattacgcatctcagcggcccgaacctatataaacatattttgtctcatcgtcttggaggggcctaaccccctcaagatcacacagctccgctcaccaagccctcgaatctcacccgctgcccctggccgaactcacaaaggggggcctcacggttccctggtggaggagttcattctctgacatctggcgcgccaggtaggcggtgcgttcgtgatttttgaggttcttttgagtgctggcgtggtgagtgtcgcgccaccgctacggggaaggcgcagcatccttaggagtgtcgtgccaccccaggcagggggcaaggccccccacatccccaccaggtaagcttggctaccaggtctttgtggcgagtcttcggaatgtccgatggcccccaaagttccggcctagcctcaccgagaagtacgacgacagcgtcaatcccttgagtccttccagatccacatgacgatcatagaggcgatggggggtgacgaccgggtcatggcgaacttcttccccatggccctcaggggccaagcgcggggttggctcatgaacctgctgcccgcctcggtccactcctgggaggacccctgcagttgagctccggctgccatcaaagcccaggatcccctgtgctggctcttccgtagcggctaactttggtcccaccggctggctatggtgcctggcccggctcaactaatcatcctctcatgttttcagtactttcaaattttcaactcatcaacctagtacagcttgaaatcttatatttatttccccccattctattctcatggccctgcgacgcccgcgtgttgctcatttgtttgctccctcggtggtaagagcccaacctctctccaatctacatgaacgattcttcgctaagtgtgggggctaagtcttctagccttatcctagccttaagttgagctctgggtgccatcgacgcccgggaccccctgtgctggctcttccgtagcggctggctttggtcccgccggctggccatggtacccggcctggctcaactgtggacaggaattgctggctctagagttttcggctctcacactcgtgcgaaagtaatcgtccatgtaaaaggaaaagagattggaaggaggccaccgaaagaaaagagcaaacaaaatgtgtagcgtgaggacacaggctcgtgggaacctgacctcgtttgctaagtggtcacagtcttcccaagatggttcggaacccatagtggggggccctcttcgagctaaaggtttgaaaggtcgcgatatgcaagcaaggtttgtgtttgc

SEQ ID NO: 53780 - DNA, 1501 bp, Oryza sativa
ttcagagtccgtggaagcttcggagagttcggtaaagttcttagcttttccttttctcttttctaagacttccttttcggtaatataatattcttctttttatacaagtttagtactttattccaattatagaatatgagtgctatgcttagtctatttatatttagtataatctcattggttaaaccttctgggatctgtattgatgctggtataatgtttgtttaccgggccatacgtcagcccaggctaagccgagggctatggttccggaacacaaatgctctgcaccgattgcaaggctgcagagtaataagtagtagcttaagcatggggtttaggctaagacttatcgttattttggagtatattcgccgggagagcagcgggccgctgatggtgacagctcagtatgggaatcttccccgcagtttatattcctacatacaatttcctggggttggatactcctccgtatacttcttcagttggatggttatgacaggttgtcgtaagaaactcggcaacccggggtaactttgcgatgcatcgggagggcacagttgagtctcggctcagctgtgctgcattgttaaaggggttataccgcaggagagtatactaattatgatagactaggtacttgtatactagaagtacaggaatagaatatttctatacttttccacttagccataattagaagatgtaggagttagctaaatccttagctgtgtgtcaacctaccatttgaactgaattaacccatgcatagactttgatgtgtataagtaatatatgaattgttagcatagttctctcttatcatatcttcccttggaataaaataaatacgataccttagaatactctcgggtgaaatgctacaatggtatatccgcgcgcttgcggattacatctgtgaccataatataccagggttatttctagtgctattgctgggaattaaatttccagtagtgtcgctaagaaataccaacagcggccgcgcccaccacccgcgccaccactggtccatcatcctcgccaccgctggtccgccgtcccaccgctcacgccatctcgcgccgccacccttcctctctcgtagagtcgcaatcgcaccatcctcgcccccaccatctcgcgccgccctcgctcttcgccgtctcacaccgccggctcggtcccgccatctcgcggcgccgtcccaccgtttcgccgccaccaccaccactgacgacgacgccacaggcccacagccacaccgacgaggcgactcttactcactgtcacgcccagaaattcccgaatagaattccaagcagaatgtgcattaaaacccctgtccaggactggccagggtacacaaacgacaaagttgacatacaggtccacgtcttacaaacacactaaaaatcgtacataaatgcagtggaaattaaaggataatctaaagctaggtcttgacttggatagcagcgggtgacaccattccaca

SEQ ID NO: 53781 - DNA, 1501 bp, Oryza sativa
tatcaacataatcgtatccgactctatccgatatggcgcggcgcggcgcggatctttatttctaatgctggctgcttctgccagcagtgattggtccacgtgtcctctctcacatggcacataaatccgaagagcacaaagaaaaaaaaaggaattgagcagttgtgcgtctaggagtacgaaggaagtacagggttgtggcaggccagtcctcctatgccgatgaaaggctattctggaaggatcgattaggcaaaagcagcgaatgcctatgtcaatagagctcacatgctctacatatgtataagtactgaggtagtacattagtattacaaaaaaaatgttgaatgcatatacaactactcagttttcatacatatcagcatctttgaaaaattgagttagcatatctcaaaataaaaaaaaatattttacttctccgaactaattcgatgaatactattaaaaaatctaatttttttggctcatcttacctcctaaactgtaaaaaatggttcactttactccttaataatattttgtagttttcttactttaagctgaaatttgttggagtcatacattagaatattattaaagttcaaaaatatttttcaaaatgtggttgtttgcttgaacttaaaattttgatgtttaaatcagtcctatgtactttcaacctgcataaacggtgggaaaaaaattaaaaagaaatgttgaataagaaaaaaacaatttagtatgttaactactccggtgaaatagttcaggaattaaaattaacttctttttcttctaaaatcagcgaaatcaccacatgcaactcatcatcaacgtatatatgtcacccatcactaattagccatcaatacaaacacctatacaatgtttatgatttaaacccaatttagtattgttatgtcatcaaaacaaatgatgaacattgtggctcctaacaaaacaaaaatctgaaacacttttttttaaaaaaaaacaacaccaattttatcattagtaaacaatttaattataattttagaaaaacaatggaagaattaatagtatggattgaaaaaaagagaaaatttgatgattttctcaacaatatgacccgttatgttaaacttaaactcaaaaaattccattcctacgattttttatgagtttcaaggaaattaaattgatttctatattttttatgaacaatgtgctaattaataacacaaaaataatataaatgggatataaatcgagcgcgccagttggcgcttattttctgttgagatccattcccggccgattctcatgctgctttgcttattttagccgccgccaagccaaggtgtgagtgagtaggcattgactgcgaaagtttcggccgagctgcggctagttgtgtgcgtgagagagagagagcgagctgcccatatatatagtgtcaaagccggccggcgacgatgccttccggctccgactccggctcctacgacccgctgctcgc

SEQ ID NO: 53782 - DNA, 1501 bp, Oryza sativa
gcgacaagctgaaacaacagcaaaagattatcttcacctatttcctttcgcttgtatccccccatggcaaagaaaagttgatggcccagaagaacataaaagagtctggcaggcaacaataagctaatcagcaactgaatagctaaagccagtgctgtgatatatctttgatgttactaggaacggagcattttaactttgggcatggacttcttcatctgacgagccctttctttttcctctttcttgcggagtgcctcggcgctcaatttggcctctgcctcttccataagttttttcttctcagccttcttcctttgaagggcttcctgccttagaccctgttgctccctgaaagcctcctgggaagcttttgttcttgcagcttcagttttggaacgagcctgcaattaccatgaataagaagaattagacactgtaaccgaaaaatggttgtggcctaaaacaaagatagaggagatactcacatggttgctgagcttgtaacgccccaccaaatcaatgtagtatggcacgagagcaactaatcttgtcatctcagccatgttgcttgcatctggcagtacaaacttgaaagaaaggactttcttgtaagagcctgccagttgatctgaaaaatgaagtgagatgaaccatttcccaaatttctcaaaagctttgtcaccaaggacctgcagagaaacaggttgtaaaacattatatatgtatgccactgtatagcattgctcagtcttactaaagacatgcggatcatattgagccagcccatgacaaaattctgagcaaagctatgtcaatccttaattactaaaccttccatctaattttctttatcatagcattaagacaggctacttcagtcgttaaaaaagatatagatggcgactttggtagaactctagcagtcaaaaattcaaggtactccctaagttcttcgctatccaaatgtgcaaaacatcaacagctaggaacagtaccccgactttcccaagacaaatatggcatgttcaatatcaacactgccttatgcaaaagcctgatgatattattaaattacaaacataatgaaatgataatacaagccatcatcacattacttgatccacagttactattctgggaaaatcttggtacaagaatagttatgaacataatagaatccaattggtgccaattcacccaaaaagtaagaaactcagatcaattcacaatttaattcctttacacttcatccatattgaagttagtgattaatgatataattgaagggagtgagatgtttctcgaatgtcgaatattgcacctttctcacttccaaattatttgatgataatttgtaatatataccgtttcgttttagaaggcacttacctatattactttcataaaagaatcaacatcaacaggacacctcactatatcatctgtacaatcttaccagaagaaccatttacccagtaccaccgaagctaaaaacagc

SEQ ID NO: 53783 - DNA, 1501 bp, Oryza sativa
gagtgattgtgttgctttcgttgggagatgcagagcagcagaggagcacactgttctactcttctcgtatatgaacctggttatacgaggctcttcaaattattattggaataaaatgatttacaagtttaatgttcttgtttcgtcattcggtagtttggttctctacgtacccatttgttagtacttagtagcgttaaaatcttggtaaaatttgaaactatcaatttgttgataggagagagatatattgctcatatttagtttattataaatatgatatcagagttcataaaatatcatttaaatcttatttgcatgtacttttcagtgtaacatattggcttcgatcataggttattctacaaaagtgtgatgatgacactaaattaataaaagttgcatgtcgcaaactggagtcaaccggcctcatcttttcgcttatgcttatgcttatcaacgaaaatttaaattttcaatcttaaatttgaagttgatttttggattgttttttcattgaagtttatctttcagccttagcttttaggttgctaagaacatactacctccgttccataatataatgtattttggagggatgtgacacttcctaggactatgaatctggacaggctcagtgtcacatccctctaaaatctgttatattataggacggagggagtatataaaagttttgtttacaaatacttctcgtttgcaaatatgccgtttggcttattaaacaatgagactgaacggttgtgcaactttttgccaattttggctggaggttcacagatagaattcaataaatgtgcgttttattttttttctattggtgttagtaccggtgtgcgtctctatcagtttggatgtgtccctattatgtcttcttttgaggtgtgattatgtttgaaacttttttttaataattagctgtaattctgtgagcaaaggtcaggattatattttattatcttaaaaaaaataatgtcaaatttcgttccattgtgaagaaattttgccacatttgcattaccattggcttcaaacaaaaccattatattttcaatacttgtgaattgccatcacactacttatcacggattggaaaaaatatgagaaatcatgccatgtgtttatcccattgaaaaaagttcttcctcttgtggtgactctgcctacctaataagcaaacagataatatgaaagagaatgaggtgtaatccgagaaaagcttcataatcatacaagcttcttttattttccccttttcttatcccagaagaaaacctttttttcctcaattaaatctaacacagaaaacctttttatagaataaaccaaaccttgtgaagccaaactgcaaaaacttgtgggggagaagaagaaaaataaaaacttcgtcgagaaggcaaagcaaatcaagccaagataacgcggaagagaacgagaatatcacggctattaagacctcggaatccacgggtgatgaagacca

SEQ ID NO: 53784 - DNA, 1501 bp, Oryza sativa
cttcatatatagcttctgttattataatacaattaatgttttattttttgaaacgccattgtgtattgttatgatatatgaaagttattttcatgcacaatctggatatcgtcacaattaggcagtgtagcacttctctgcttcacctcaagcatgtttccaaaatgagtttggattaatgatacctaattattgtatgttatccaattgtttataacaaaacaaagctcacatcttatataataattggagttgtatttagaaaaaaagattagtattatctttgaggatttgtatgtatgcgtagaatggataacaatgtcacgcatgattatgagctaaagggaggtgaatggataagtaatcaatgattaaattagatggatgagtagctagcttcttgatccaacggctgataactctatactaatgcgatccgatggcttaaaattgttgatgatgtggcttcttgcatgtcttgctttataggagtaaatgcttcttagtgggtaccaattatataggaagataggattcccctttgtttactagttgaactaagcatggtaagcaattcctagtccaacatctagtcatgttacatcccaagctaacaaagaaataaggtacacaaataatatggctgagaacagtaggtaaaacatcccatatcgtaacattataaaccatgcataaatttaaaggaaacatagagcatttgcaatatgggatcaatattttcaagtgacaagtataactttccttgttctgctgctggagggacattggcgactacttcgaagtacaccgaagcgtcgggagagccggattctaaccgacattcaaagtaaacaatgcaaacaggctataagactactgaaacaaagaacaaaaccattttaatggattctttacatttttcttgatttactgagacttgaatgggcttaaacagagtacggatgaattctctatgaattttagaagattcattgtgtttattactataacagaaaagtccttaattgattcattgtgcattaaataccccggatgacgtcggcggacagcggtggcggctcacggccgggcacgcatgggctcagctcaagccagcccggtgggccatggtgacacggcggcgcggcatggagcggcggcggcgcaggtcggccaccagtggcggagagcggtggcaatgcagcggcatggagcggcgctagcggcggtgctaagtggcgggcggcgcggcaccgagagggagagaaagggagaggagggcctcaccgatgatgatcaacgacagcgagcggcgagtcggcgacggcgacgggcggacgagctccggggtttcctaagggacacaacgagagaaattagagagggagagagagatcacagaggacggggacgccggccgaaggcggtagccatggaagtgctcaccggcgcacgaggggaagggggctccggcggcggaatcggtcggggaagcggcgga

SEQ ID NO: 53785 - DNA, 1501 bp, Oryza sativa
aattttgggtcatgaggggtgtgtggtgtattttgctgctgattgttggtttgttatgtaaatcgtttcttctaatcaatttgccatggattcttggctctgtgtgtatcttgactccaaaccctatggtgaaagtgagacccttgagttgggagattaaagaacgaggtaggtttagttgctttggccctagtcttagggtggtttatcatattagtatattttttatgttttaatgtagtaaaatatttatgtttggtttgctgttagatacacaggagttaagcaccaatgatttcattcctaggttctcctttttcatataggggttctgcttctgaccagaagtagtagtgacctgtgtgcctttttttctgatctccacatgtttgggagttttgatctctcaattgctagcgaaaagttgtcataatgccagcctaatgggatcaatgccctaccaatttcttcgcatcctgccggatccattggaacagaaattaattagttgacccagtagaactgaacttttgggacatttattgctgtgtttctagttaatcaacttcttggatagctttccattaattctgaacaaaactggttcttttggatagctttcttgtgtcacatggttccctttttcccctaatttggtaatagcatattgtggttcttttgtatagttacacgattttgtaattatgaaatataaaagataaacacgatagcgcaggtttcttatgatttgagcttactttgcttgaaccaaacgggcctgttaggtaacaaagattaagtttcttatatgggttatttattttgtttttgaagcaagaggtcacatgccattaataacttgtaatgtgaaaaaatgcttcttgtttgtaatggttcccaattgcatttataatgttggggacctatgtctggtctttggctgctttttatagctaatatgttgatggccatgcctgcgtatctattacaaagcgggtcccaagtcccaactatttcattgattagcaagatttcttgatttcagatgtaacttatgctgaaagctaatccattgaacaaatacccttgattctgtttgctttaatcgtactttccaaaatataattttagttgaacaccatatgctatggcatagtggaagtcgatatgaagcttaggtgttaaatgaaaaaacctttttaacaatgtgcttatgtatccgtctcttacatggatcaatcttgtttgtattgcagttgatggtatcaacatactgaacatgtttgtgaaaaggacggcaggatcaactccctgttgagtaccattccacaagatttcaccagtatgtcagctagggcttcaaaccatgcatatatatgttcagatgattctcaaatgccgtactataataactcagtgccttcagggggaaatggtaggttctatataacacaaaatcatcaggatgctcactacgcttcttctgatgatgggtcacaga

SEQ ID NO: 53786 - DNA, 1501 bp, Oryza sativa
tctccggatgcatgcatgggatcgtgcacgtctcacgggtcatggcggagacgtgcacgtcttatggcctcacgggccgggggagcatccatcattccatataggctcatagcataccgctggcgcggaatggagggccgagattttctgacacacaaaatcgaacggcacggatggcgcctgatcgatcgacatatcgtcgcgatcgcacatatatatgttcaagcctgtcagtatctgagattccttgcattttttgatagaagctttgcatgcatgtttcttccgccagggtgtagtacgctgcacatgcgaatagtttttctcttagagattgatttttaaaaaaaatctccctcgttgcaaaatatagtaatttaaaagattttaaaatttatctaaaacataacaacttttccaccaacaaacgcttcttaaccaatcataacctttttcatgtttaatttcttcgtcttctcttttttttccttggtcaatcacaaactcgcttcatttaattacacatactctcttaatatttaatatcgtgtatccagactcaaagtttattatattttaaacaaagcgatacctttcatatctacgtaacacactaaaaacctaaagcttaagatgcaagcataacaattattaattactccctctgtttcgggttataagacgttttgactttggtcaaagtcaaattgctttaagttcgatcaagtttataaaaaaattagtaactttttgaacccaatacaaatttattatgaaaatatattcaattattagtatgatgaaactaacttagtattataaaaattgttatatttatctataaacttagtcaaacttagaacagtttggctttaaccaaagtcaaaacatgttataacctaaaacggagtaagaagcatgcaaggaagtcaaacgcaccaaacactaaaacataaatataactacatacatcatctacatattattacattttaaagctcagtatatgaacatgttaaatcgttatttctcatgtcattctcacaatatttttatccaaattcattcatcatttctacgtatcagcgccggactgactatatatatgtctacctgacaaaattaagaagctcacgcagccaatagaatttgcccgcgccgctgaatccacacccctggatcggaactaatccgtatacgttatccaatctgacgattatctgaagatcgatgcgatatccgttcgatgagcatccgacggccaccggcggagtttgacgggtcaaaccaaatggcatccggccagccgcaccatcgatcggacggctgcggtcaaacgtcaaagcagcttcattattaagcgtgcaggacgccaacaacgtcgcacgtaggcatcaagctattcaactctggatgtccacatttttattctaagcacgcacgtctatccattaattacgcagttcgtacacgcacatgcatcgatcgctgcactacgttg

SEQ ID NO: 53787 - DNA, 1501 bp, Oryza sativa
gtgcgaaaccggtgctgtaggtcgcactgatccgaagctaggggcgctcgaaggcaaacgaggtcctgcgaggatggatcatcaagttatgacggggtgatgttttcgtacaaaaatagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcaatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgtgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttaagtgaatataatgaaatttcacagaggagggactgggctttatagggggagaggca

SEQ ID NO: 53788 - DNA, 297 bp, Oryza sativa
cgttgcatctgctttcggcggagtggaggtaggtatgacccatcccatcagagagtcattcggacagcggccattgcaaatctccacccattaatgaggaaatgacagggttatcccctgtgtcaggcgagtgacggcgctgagcctcactcaaggacaagctgtgatttagcttccaggcgaaggcgcaagccaagttttggtgaagatagggtgggtccccacccaaaagaagagtaggtagaagtggtgcatgtggtatccccttgagatataaaaggaggaccttgcccaccg

SEQ ID NO: 53789 - DNA, 1501 bp, Oryza sativa
ggatcaggatcgttctagggttagggttagaaattttcactgtttcatctctctttttcttttaccataaaaactgggtatattctgcactgaggggaaaatggtcattgttaaaaaaaaataacggttgtaatggtgttgaattgacggtgatggtatttttgggagaaagaggcttgtgcaatggcatttctagaaactaggaagttgcttttatcgatggcattaatatctcgatgggcaactgaacaccagatggaaatggaaaatgcttcgtgtcgcgcgtccgacgggaagacaaacatcggacgccagcttcctcctctatactagtctaaaattgatttacctttcctggtgtttttcctggtttctctttccaagttacttttactcagccgtatgcatgcacaacttgcatgcaagtatataggaacatgcaaattgagacatgatctttaaaactatttttcttccaaactaattatgcgattcatgatccgattattgtggtatatttgttgttattaaatcttgcatgattatattctgacgaaaaaaatatatatgtttctactgttaaaattcagtgtttcactcaatgagaaacaaatgtttcaattagatatggactatgttgcactttaaagtttttttttgttgcaatgggtttttgaaatgtcacatatagctgttgttgcaataagcatttcatgatgtttcagtagttttttatatcaaaatatagccatatgagatcttgttataaagattttattataacaaatctaatgatgcaatcaaattacatatcaaatatatattttaagagaaaagagttcaaagaataaaaatatatgtgtacattataatatagtgctagtagccgtacatgctgcatacacaggctagcacatgtagctgcatgctcttgcgctttaaatgtagtgctaggtgcgctgctactaagggctgtgagaggcggccgatatttcgttttttattagacgtccgatgggtaacctcctccgatggaaattggagacacttgaaccagctaaggagtctctctgttgtggtctttaaccaaagcaggattatacctcctcggtgcccatggcccatggcccatgggaaaccacgcagccacgcaggtggttgcgaaggttggtgggggttcggaattttcttctccgacccccgtcagtcgtaatccgttcggctacgaatcgagatttcgatggcgagtaaggaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggctgcc

SEQ ID NO: 53790 - DNA, 1501 bp, Oryza sativa
agtagattaattcgccctatagctagctttattatcacttaatattactaactatgtttctcattttatcacttaggacatgtagaacagttattataataacactcttagctatactaattagtgctgaaaaaaaagaaagaaataggagataaaacatcgttgctacgattaacaacgactcttaatttttttaaagttaaaacttagctgcataaggatggaaagaaggaaataaagataaataaaattaatggttagaggttttgttgtctcaactgtcacatgggatgacagtcttgcatagtttaagggctcataacaggctttaactttaaacatgccatccctaactttatcacttattattactaagtactaattaactatcttttagcactacattatttgatcctccagctagcttgatctttattgatctgcatgaaatgcgctggccacatttgtcgttgtcaccaatattgttcaaagaacaatacaagccaacatgcatatggaccatgctcgcaagttggcagctatcatcagcacatgtatatatctatcccagcctaatccactactaacttagctatagctacttgttgccattggagtactattatgcaatgcaagaggtgactcttgtacagtgacatcaatcaatttttcggcgtcctaattacctgcaggaacatgccattgggtgccctgatgcgcgcgcgagtcttgtcgccgttgcgcacgatctggaacgcctccccgggccccggcgacgccaccgtcgccacgacggtgaccccgtcgccggcgacggtgacgaacaggttgtcgaacaccctgaggtcgaacgtgtcctcgtcgatcctccacagcttgaaggtctcccaccccgaggcgctcgtccggttcgccaccaggatggtgccgccgccctgctcggcgcacaggtacatgttctgcgtcaccgacttgaattgcagctgggttccatcctaaaatgcatagaaaagcgtgttctctgatcataaatgtttgatgtttagaataagatttgataagatttttgaagtttttaatcatccaaatgtacttaccaggaggtctttgtttggaatgtcgtcgaagagggagggaaggatccagccctccgtgacgagccaacctccaaggttcaccgcccgaatggggggcgacggggcgccccgtttcgcgggccgcaccgtcctcccatcggagactgagaagaggcacggcgagcagaggaggaggaagaggaggagctcaaaatggcgcatgatgaagacgaagatttttcagctcttgatgactatcttagctcagcttgccaatgtatatatatacacaacgtagtgcagcgatcgatgcatgtgcgtgtacgaactgcgtaattaatggatagacgtgcgtgcttagaataaaaatgtggacatccagagttgaatagcttgatgcctacgtgcgacgttgttggcgtcct

SEQ ID NO: 53791 - DNA, 1501 bp, Oryza sativa
agctcccgacaggggacggctgcacggcgcgacggatcggcggtggtgaaggccgtcggcggtggtgacggtgaggcgatggctgcggtgaggaagatggaggcgacggcgatgcgaccaagcacccgttgacacgggcggtctggtcgaggcggcaacgacggtcatgctgtgagggtgggtgttcaagcctgtggcaagcttccttccaggcgtctgccctcttacggtggcggcttgccgccgaaagatggccacagtggacgagcgagtgcgggggagaggggatccattcttctctctcaccctctccctctccaacccaaccacgtggatggatgtgaagcgcggtgaaggttaggactcttcttcgatggctagccggcggcgaggcgtcggcgcggtggctgcgcgtcgaaggggattagatggtggttctgctgaactggcatgcactttttaacgcgggagagtagaacaacgggcgaaagcctagccttcgggccggcaacggcgacgcctgcgggcgccgttttccccttggggtgttgccgtgttttctattttcccagtgggttcttcaggtgaaaaccttgtcctggttacctaggacgaacggcggcggcgcttttggcgtcgttttccttcttggagacgtcgtttagaagtcatattcctttgagagtgttgtgtgcttgttttgttttaaacaataggatcagacgtataagcgtggtgtggttgtttattttctttttcctgactatagtctcccaggactataggcttgtattttattccttctttatcaatagaaacatcatactatcttatgcgggttgtttcaaaaaaaatggccgggaaaacaaaataaggctttgcagacaattttttttctaaaccacaagatagtgttcattgaagaaaacaaatgtgggctaagaaaatgcctgagaaataaaaataggctaatatatgggttgttaaataggaatgtccaaactgaagtccaacaaacacgcatccgcacatggggttgtaggatcgtgtgatcgcgcgggacgttggactagcgatcgatcgtgcagtagacttattacccctctattgcccctatttatgtactgtacatacttgcatacagtagcagtttcggaagcatctgctgtgtactcgtcgtgccacagaaccggtcgtcggcgtctttcttcctatacacgccaatggcagtgacagtggcccccacacgcagtgcgccagtgcctatatataaggcacacaggctcctggcacgccgcgccatgcaccgcaaagcgacacacgcgacacgccgcctccacctgtatccctcaatcaccgattcgtcgatctcccctcctcctcctcctcctcctctccccggcggcggtggcggtggcctcccccagcgtgagagacagatcagagtgctcagctccccactaggtaggtgcgggtgtgttgccgcgtgcgccggccggca

SEQ ID NO: 53792 - DNA, 1501 bp, Oryza sativa
tcatcgtcacagctgacaatctcctgctgatgcgtgatccccacctcgtgtttcctcctccacatgtcttcttgatccaatactgaaaccttctgctctgatactacttgttataaaagttagtcaatatagcggaacgacgactaaccttcccgatcgcttcagtcattgatcgcccaagacatgccagatgacgacacaggaacacatggtatttgttaacgaggttcagccgaagcctacatccccgggctctgattataggcgctcctccctaaccaatatagctcctaaccgctacgagtccatggccacgccgtgatcatctccctgcgtgtctacgctacattgtagtcgccatgattacattgtggtgcctccccctatttaagagagttgctgggttacagagtccgactctaactctaccccctaccacctatttcaactccaataggactggtatatttgatacctattctaacatttcttttccatgctccaacttgagttgaacatgtatgccatatatctttttttgatattgtcgttggggaagtactcgtgtaaagtagaacctttttagcctcaaggtgctaccgagaggtaccacattgacacattctgtagtataaaatttagtactacctccgtcccataaaaattgaaattttacctttgaacctttgtcccataaaagttatatttctactgatgtgggacccattaaactgattacatttccttgtaatcttctttccttccatcccatctctaacccattgtctcaacattccttttaatcaagtttatatatggaatgtgtgcatgtattgtgtttattaaatagggttactgtagtcatttgtctatcctgctaatatatccttaattccctagaaattcaatttttatgggatggaggtagtacctcttttggtgaaaaaaaaaaagaaggtacctcttggtatgtccatagtgttgaggtaccaggaggtaccacagattaatactaaaaaaacgcccagtaagaattgcaaagtcactcactagtgcatgtgttatgcctctgttgtctgatttggtgatttggtctgccttggaacatttgtgggtctttgatctagctacatttacgaccaccatgattgacaattaacatcaatcacgagcactctggctggttgggggtcaagccaagatgtcaatgatgccactggaaaagattgacctagctcgtgtggttgttactttagcagtgcttctggttatttaaacaatgtgttggctgtttcgcgagcaaatgtggtgatatgtgtcatgttgcaattactgtcatcttaaaatgaacacatgcatgttttcctaacaaattcaactcttctgaacaattcttgactgaaatttcatgtactatgaatttggaacattttaatccactttattgagaaatttttatgaccttcctatgcaaaataggtgccttatcaatccatggagg

SEQ ID NO: 53793 - DNA, 1304 bp, Oryza sativa
agatgggccgagagagattcggcccatcgaccccgggggaggcaaaatagacttttgcggagggattgatttggaaggatttggattcggaattggactcgacgatagatcggggattgagatccgagatggcacggacactagacaacaagcaaagaaacaaatttcgcaattagggtttttaagagataattttcccgctaggcgccacgacggaaagggcgctacagactagtctttggggaaggagtggccgccaccccacctcgggcctgactcccctcgggggagggccacgtggcatcgtggggtagcctcctccctctaaacctaatattcctgggcccatatcaccgacagtagcccccggcgttagccctgaccaaaacttttcctaggtggtcagggttgacgccactctgttagtcaaatgacatgtggaccagatctcttattctttctttgctggcactaagacccatgcgcctttttcgccccagcctgagggtgactcgctagcccgtgccttaggctgtgaacttattttctgtatatattcagcaaacgttgttagattatctcgggcccgtgaccttacgcttgcccctgccatttgttaacctctgttcatgttctacttcatctattcaaacgattattttcgcgagtgtgaggaatgaactttccatagccagcaatcttcacccgtgatcaagctaagctgggcgccgtagccagccggcggggccgaagccagccgctacggaagagctagcacagggggccccgggcgtcgacggtacccagagctcgacgcagggctaggatagagctaggaatcgtagcccccacactttaagcaaagaatcgtttgaatggatgaagcgaatacaaactttttgttaccaagggaggcaagcctgcgcgcgacacataggtaccgtgggaccgcgaggaagagataggcgagagataaatataagcaagaataattctatgcaaacgattaacttcgcgcaagtgtgaggactgaactttctatagccagcaatcttcgcctgcgatcaagcgaagctgagcgtcgtaaccagccgacggggccaaagccagacgctacggaagagctagcacagggggccccgggcgtcgacggcgtccagagctcgacgcagggctaggatagagctaggaatcgtagcccccacacttttagcaaagaattgcttgtatgaatgaagcaaacacaaaccttgcttgcatatcgcgacctttcaaacctttagctcgaagagggccccccacta

SEQ ID NO: 53794 - DNA, 1501 bp, Oryza sativa
atttaaacccatggagcccacatatcaattacaacaaaaaaaaattacagtggcgaccatgtgggacccacatatcaaccggttgagttagcgtgagacccatgcgggcccccgcatgtcagccgcgggtgaatcctcaaccagtcgacgctctcctcgtgcattagtggcggtggcggctggagcagtggccggccctagggagagtggattcgttgggcctcaagtggatctcgtcgctgggatgccgacaatgatttccctcattgcgatggtcatcggcagcggtagccggttgatgatatcttttgtctgactgacatgtgggccccatatttttattttattttttatttttttgcttctagtgccatgtcactgtcacgtaggacaaggatcaagtcgaattagccacatagatgccacgtcaatcaaaaccgtcattcaaaccgtattgggatcttatttgactggttttaacaattgaggggagaagaccgaacttgctgtcaagttaagggagctaaatgaacttattccaacgtactatatgcgcatgaggcccatattccgatagcaagtccggctaggaattatttgggcctcactcctcaggctctaagtagactctcctcctactggctagtggctacgtactgcccttccctttgcgagcttgtacttacttcctgaattgatttggccgagattattaaatcttttgacggcagctagtgatgttaacagtacaagtgtataacacccagaaaagatgggcagaacaacacctgtaacaaaagttcaggtgtttggcatgcttaaaaccaaaggtaaacttgctgaaatggtgaaaccacatgacacatattttcaggtttagtggagtccatcgcgttgatggggtatatctttggccaaaaagtgaactcactcttctccgttcagcagcggggagcgtgtagattacagcacgcatgcaagcttagtgctcgtcagagaactaatcactaatatatccagccgctgatttctcatcgaagacataattaaaattgtttgcacgctgatctgatcacagaagcgattgatgcatgcaaggtgtggcgacgtggagagcccaacacggaaccaccaaggatggggggcgcacgcagagcttgctgtgctgcgtgctgctgctgcgtatgcgtgcctcctgggatacaccgtgtgatagatctggcagccccatccgacctctcgccctataaattgggctaccggccggcgtcttttgttcatcacctccacctcgcaaacagaaccagtactttaatttcaccttgcaaattcagttgaattcggctcgttcaggttcagtcgtttgatcatcatggccagtatggccaagtcgctcttgtgcatctcgctcgtcgccatcctgctcctcgtcgaggtaattaatcagatatttcaaactgatcttttaacctaaacgaaacggtttcctgaattgtatata

SEQ ID NO: 53795 - DNA, 380 bp, Oryza sativa
tatgtttgactattcgtcttattaaaaaattttatgccaatgtgtaagaaataaatcacacttaaagtactatgaatgataaaacaactcataacaaaataaattataattacgtaaattttttgaataagacgaagggtcaaacatgtgagaaaaagtcaacggcgtcatctattaaaaaacggaggtagtactagtcaacaaatgacagccaggatatatatatagataagcacacagaaatccttgcattttgatgagaattacctacatatctcgtgatattgatgcaaattttttttataacaggcagattgccacctctttttaattattgcacatgtacaaattataagtatatatcctatttttttgtgttt

SEQ ID NO: 53796 - DNA, 1501 bp, Oryza sativa
tttgagatccaattgacacgttgttgatgcgaaaaacatacactttgcttttgaaaagcaaactctctccaaatcctcttcgattttaacttcgaatccgatctatgatttgccaaatttggtcgttaacacacgtaagcgccatgtcaatgccacatgggatgatgacctagtcaaagggagccacataggtgccatgtcatccaaaaccgagcataatactgctgagggacctattctgcacggttttgtgagttgatggatgcgttgtatctggttttctggactaaggatgaaaattagactaggcgacaaactgagggatctagagtgaacttattactaaacttgttgaagcagagaggggggggggtgttaaatgtcgtcccccctattcggcctaaacagtttagaggacaagggtgaaacatgcgactatagtgaggtgcagggcgagagaggaaatgagagattgagtgagagagggatgcctgcgaaaatactttaagtgattggaatgtaacttttaaacttgtaaatgttgagaatacaaaaaataattgataacagtgtgattatgtgagctgtagtacctactttcgtataaaaaaataacttataggaatgaatctgcgcaagcattatgttcatccatataaattggttttttgaacggagggtgtagattctagattaatgtgttagatgtcgaactttatattttctttaactttaactatagtaaacagtaattttatggaattcactcattttttctcattgagaatttgatctgcaccataaaactgcaattgccaattgcatgctggaattcacacaatttatttagggcccatttgattcaaagaattttatgtagaaatttcataggattcaaatcctataggaatttttcctgtgtgaccatttgattcaagaaagctttcaaattctataaaattcctatggaatggctcattgcacatggattttggaggaatcttagcaagagctacaacctcttagaaaattttcttcgagtctatctttctcatccaatttctatgttttttatgtagttcactcaaacggcaattcctgtgtttttcctgtgttttataaaactctgatttacatttatttttttatcagaattatgtgttttttatacctttatttttttcgatcctaccattcgaagtgcacttagttgcgaagtgtcattaaatttcgagaaaccacagatcgatcagatccaagtccaacgatcaactactccacctcccgctacaagccttcagcgcccaaatcgagtgcctacctttatctctcacctttcgcaaatcgcagccggccgccgctgtagtagcaaacatctccttcgtcttccctacgcgtccacccgaaaaagaaaaaaaaaagaacaggagaattatccccacttccagagtccaaacctccccgtccatggcgacggcgagctcgatccggccgccacgcg

SEQ ID NO: 53797 - DNA, 343 bp, Oryza sativa
cgcacccccggacgtccccaggtgcacggcagaagctggcctttattaaatacaaatgaatttggatcacaactcaacagcatgcagggtgtgcatctggttgtatgcatctaagttatgtccttagtatttctcaacattgttttataattttgatgtaaatgattgacaaaaaacttccatgtttttttttaaaaaaaaatctgtaaatcgcctcgtatctgaatggaaggtatgcaaccaagagttcggtgctgaaacaaagctgaagggatgcaaatttcacaatttcacgcgaattaagatttatcaattaatctcattcttgtctggtacgaaaagt

SEQ ID NO: 53798 - DNA, 1501 bp, Oryza sativa
atcttcaacctgtgtaattattactatcctgctgctcagaattacctctggaaaagcttgattgataagatcccatacggaggcagcccataagtcatcaataataattaaatacctggcaatattttatgcatattagatacattttttcagctaatatagtaacattcatgagaaatatataaatcgaataagtaaataaatgaggaagcaagttttacaggaagagatgtaatggaaaagatgttcaaattttgacccttcctataaatgttgggttcactatagagtccaaactgttatgcaatagtgtctgtctacgtattgcttgacggtatatgcaatagaattcaaatgggccagctaaagtggccaaattggcttattatcaaaaaccacatccccattaacatagctgtaggtatggcccttgagaatatgtatccccaataatcaatggtcaacggtcattctattgagcagttttgcaagaatcattaaaaatagtaccatcattaaacagaataaataagagtggataactagtgtatgcacccctgtgagtaattgaatgaaaataaagaactcgatttcggaatgtacattagtttcagtttggataatctatatataagcataggattatatacttcaaacaaattagaatctcaagatggggaaatcattgcaattatcatagggaagtctagagacttagaccatatcctatttattctctagattattttgcttagtactccttccgtttcatattataagtcgtttgattttttttctagtcaaactttgttgagtttgaccaagtttataaaaaaattagcaatatctaaaatatcaaattagtttcattaaatctaacatgtaatatattttgataatatgcttgttttgtgttgataatcctaatatatttttctataaaattggtcaaacttaaagaagtttgactaggaaaaaagtcaaacgacttataatatgaaacggagggagtactatctatgtacagaattgatgcatggactattggcaaccaaaggatctgatgcattttgtgatggattggtttctttggcatgttccaagttctagcactgatataaaaatggacacaagaggcactacttagtaaagtataccttctatcttgaagatactccctgatgctgtcaataagcgcaagctccttataatcgtcaggtggctgcttccgctggagttgaaagaacatctcgcggaaaaccctcttcatatcaggcttccgggagatccggacgaaagctcgacagtcaaattgtcccccaattctgttgtacaacagtttggcaagtgtggtcttaccaatacctgaagatccaacaacagacaccaccttgagcttctgatcctcatcattggcgagccgctcgatgaactcgctcacccggccatcaatcactagctgggcatcttcttccccatacggcctagatggcaacatagg

SEQ ID NO: 53799 - DNA, 1501 bp, Oryza sativa
ccagtgccagccccgggtccatggagctggtatgtctggcttggtacaacctgaagaacacctggttgctctgcaacaaaagaggcaggagccaaatcagacgtaaggatacaaacagaagtgcaaatggcccaagtacgattcgcactattggcgactttagcatacatacttcagaaacttaaccaaaatccaaagaaatcatgtgccgtattgtaatctataaccacacgacactggcatgtacattagataagttttacttgattaatgataaaaagaacagtacactaagaaatccggtagctgcttggtcatagatagcgtatatgtaagatcgaatcatgttagaaatataagttaaaatggtattaataaaatccacggtgaaaagaaaaaccttgcatatataatcctagaaaatgaacagatgcaagtccagttcataaggaataggttttatttgcaaatatcttatcagtttggcaaatacttacaataacagctaagagcatcagaattcacaaatatccttcaataggattgttcatactatatgggataagtaggatgtaaattgatacatcctggtctacaaaggaaatattgtacttcctggttccaaagtaccaaatattacatgacaaatatgactgaagcacattattatggggcaatgaagaattagttatagttataatgtacaatccccgaacaggttcttagtagcttacaatcctatgatttgtgagtgtgcacttaagcctgaacctgggcttgtgagagaaaagaatgattgctttcgcaattattgcaacggaagactacagtgtgaaagaaactttgataaccatcaacattaccacagaacatcaccaatcaatcacacctaagtccaaagatctaaaagcttaaggatcatacttaattttactcaacaagatggaagttattcagtacggccgctgtattacagattgacaaatgatacatttatgttccaataagaatttgagactccgatgttcatccattggtttggtgccagccaaaaaccagatttattcctctcgtttcattttccagatatagaagaacggtaaacgggcataattctgaaagaaaaataggatagagtactcactcttgagctcctcgacctgctggggagtaagttttgcagagaaaccgcttgcggcgtgcttgtagtggtagagcaccgcctcctttgccttctcctcgctgcaatcaaccaaccccaaaatcagcaaatcgccatacaatccacacctctcagaaaaccctattcctacccagtatcaccacggtcatattggagctaatcgagcccccagaaggacacaagtttctatctcaatcgaaccaccggaatccaaactcctacaaccggagcaacatagatcgcacaaatagtagaaacaaccaggcgggggatccaaattccgcgagtatacctgccgaggacgggggcgagggtgcg

SEQ ID NO: 53800 - DNA, 1501 bp, Oryza sativa
caaactttagaagcataaaactttaaaaaatattattgaaatcaaaaccagagattatatattgtgacctcatcctcactaaatcgctcaagatcgacaatccgatcaaagagttctccaccagatgcatactccatcacgattgcaagatgtgtatgagttaggatcgcctgtgcaaattgaaaacaaagcattgtttattttgttccacacggcatgggattatgagagaaaggagtaagatcaaaaggagatcaaacttaaatgcacccataaaaccgagattaaaccataaagtgattagaatgaagaagaaacatggtacattccacaattgtcaccttcaaatagaaaacacatcaccaaaacccatcaaactagggaggaaaaaaaatacaaaatcgaatccttacccattcaatattcatgctcaagaaactagtaaatcatggcatagcagacaattaacccagacggacaaaacaatgagtgaacaatccctgactatctgctcctattttttctaaaccaaaaatgtttgctcctcatcaacaagacaacaatagatacacacctctatgaactggatgatgtttgggtgccgcagcgaacggtggttgatgatctcccggtacgcgctcttgttaatctgcgcaaaaaccaatccaaagccccatcagaacaaccaaatgttggccaccggatccacacgagcaagacccaccaaaccccagcctacaaccccaaaaccctattacgctagtgaagagggtagaaggactcggacccggtgattgccgcgtgggatggtcttgacggcgacgagctccccggtgtcgcggttgcacatcagccgtgtcaccccgaagttgcctgacccgatgctccgcacctcctcgtacgtgtccatgccggccggcgcacgcggcaacacacccgcacctacctagtggggagctgagcactctgatctgtctctcacgctgggggaggccaccgccaccgccgccggggagaggaggaggaggaggaggaggggagatcgacgaatcggtgattgagggatacaggtggaggcggcgtgtcgcgtgtgtcgctttgcggtgcatggcgcggcgtgccaggagcctgtgtgccttatatataggcactggcgcactgcgtgtgggggccactgtcactgccattggcgtgtataggaagaaagacgccgacgaccggttctgtggcacgacgagtacacagcagatgcttccgaaactgctactgtatgcaagtatgtacagtacataaataggggcaatagaggggtaataagtctactgcacgatcgatcgctagtccaacgtcccgcgcgatcacacgatcctacaaccccatgtgcggatgcgtgtttgttggacttcagtttggacattcctatttaacaacccatatattagcctatttttatttctcaggcattttcttagcccacatttgttttcttcaatgaacacta

SEQ ID NO: 53801 - DNA, 891 bp, Oryza sativa
attaacctagacaaccctaatatagcgcctacaaaggtcgataagaggaatcaagcgttatttctgatcacaccgagaacggtcaagtgagcacaacaatagttgttctaaagtcttcgatcgagaaacttaactcgttcatttgcattgaagtcggggactactgtcaaggttatggataccacatacccaccatataccaagtcttatacggaatcatatctcgtatatagaaggagttctggataaggaagaacaagtagagttctgtatggaaacgacaaggactactcggattgtatccatattggtctccctagttttacttggacaagggggcatctatgggtataaatacaaacccccctaggaggagaggggggaagccacaagatcaacatagatcaatacaagccaagacatgccgccggatatcaacatcagagattagcatagacataccccatccggttcctacggaggccggcaagagggatctagcactatctctgatcacgccgagtgcggattcgaggaggaagactatcatgtcatcgactacaagttggttatctagccgccaagtcgacgacaactaaatatgttatcccaaatattgtacttgtgtgatcctgatgaataaagagcaacaccggcttcggccaacaggacgtagggctattacctatcagataaggggcccgaacctatataaaaatccttgtctccgtctcttttacttcaatatcgcatataccctggtaccaacgattcccatactatgcaaataccgtagtcgcgatatgaaacgtcgacagtagcgcgccaggtaggggtcgacagtggcgcgccaggtagggggatttttggtgcttcaaggttttgacgaga

SEQ ID NO: 53802 - DNA, 1501 bp, Oryza sativa; identical to SEQ ID NO: 24836

SEQ ID NO: 53803 - DNA, 1501 bp, Oryza sativa
caaattaattgcagaatccgtcactaaaccgtgagatgaatttattaagcataattaatccatcattaataaatgtttactgtagtaccacgttagcaccactttgtcaaatcatgaagtaattaggtttaaaagatccgtctcataaattagtcgtaatatgtacaattagttatttttttaagcatatatttaatatgtttaaacgttcgatgcgatgagaaatttcggttgggatctaccctcaggcaagcaacggcataaataaggcgacacatcccaagaagaccaccaggggaagcaaaggagggttcatggttgcgggtcagaaactcagaatagaagaagattgttccgtggaaaaaagaaaatagaagaagaaaggtatggaggatctagtactagtagtgaaatcaagaacgtcactccctatcgctttctcttctccccgaaggaaggaaagaaacaatccaatcatattatagctagtatccaatattcttgttgtctttcaccttttggtctaggttgtctagtgcttgctattcttctactagtagtattataactgggttgttcattatttgaagattttcttttcattggggggaccgggctagaacgatttttcaccatctttatctggtcggtttcatgataaaactgtgaaaagttgtgtcttcttccaaagctgtgtgggtatggaagggtttgtacgaggagagcgcatggagggtttgggggaaagaagaaaagattcacgccttcttttgccgcggcgatggggttttgggccgtgggcggatgcggccgagagagagagacctcccgcgcggcggccgagagcagccgaggcaggggggacggccggcggcggcgaccacgaagccgtcggtttgttttgttactactccatttctgttccccctccctgatcaagtaaactagtttgtaggatcgcatcaactcggatgaggaatttttgccgattagatttagttttcaagctggaaatatggtgattcacgggcctttttcttgtggtggttgtcgttgttgttcatgccatttttctgaagtgaaagatgaacaaaaatttccactgaaaagtaatattttgacactgcaggtttgttgaaaaacgatgggcacatcgtgcgaaagatgcagacggcgcgatgagcaggactacaggaatttggatgatcccaaaaacacttcttgctaactatgatgggtgattttcaacatgagatggtaagccaaatatttttttttatgaaatgcaatgctgcttcttttcttttcccttgccgtttgtattttttttttgtttctttgcttcttacaagttctgtttggtacaagcatgatcttccttgcaaatttcaataattcggtgactagattgtaccctcttaaaagaaacaagtattgatgcccggatttaagccaataatatgataccacattaggtttgttggttagcaccagatgtaat

SEQ ID NO: 53804 - DNA, 1361 bp, Oryza sativa
caactccactccagacttaactcctgaagcaatatttaggagttggaactgtaccaaacaggccctaaaaaaattatataagaacataatcctggaaggttaattataattagaaaaaggaaaaaaaaagcaccatgccctcacccacaacattgggaacttatcctctaccattgaaactagaatggcagacagctatagtactctctaccatgagccattttcagccgttagattagatgtggatggatgagatcgatcgctacagtacctaacagtaaattaatgccgtactaacggtaggtattttacattgtttgtacagaggtttttaactgtagctgtggtaaaacactgtaccatccctcacgttttactgtttacctctgccatttacctctaatggcagtggatgtgaaccccacaacacaaacacgtattgaagaaaaaacaggagcttagaacaacccgacaagctcaactttgtccacgctttgtgttggagaaggcgagggcgagaaagaatatatctgtcgcccacatagtcccgccaacgtggccatcgtgctggctaaaagcgccaccagaagaggacaactgtctggagatggaattggtaggaaatggatcatcaaacaacgcctccaagaaggttatgatgcgacaacactaccaccatcacccgtcttgaggatcagggcgtgattttctcccaacaaaaccatcaggaggaatgagatatgccacaacagcgccctaacaggggttgggctaccgcaaaagcatcatcgctgccgccccagaacgggctaggctttcgcctagcaatctttctacctcaacctgttgtgaagtcctatcgaaaacagaaaagaacagtcattactatctaaagcacatttgttgacgatcgttaagtacaaattttgaacaccaaccagtacaatgaataaaggaaaaattagcatatgttacatgtatatcaacaacaaataatgtagttgtattaggattgggaaacaaatgtggatgtagagaatatacatcaaagtgaaggagaaatgaagacaacatgtgaagaaacacacttccgatgaatcacgtgcgagcacacagattaaaggactcacaagtcagttcaaatcgactcaaagtggggccaaccacctggaaaccgactaaggggcccacatggcagcctctcgccaaaggcggttttcctggtttgaccgaactaggtgttcaaccgaacattggctagcaccgctcagcctgatcctccacgtgtcacctcctcctgcgcacctgatggcagttatgcacggctggcggaccaataaccgtcatataaccatcataag

SEQ ID NO: 53805 - DNA, 1501 bp, Oryza sativa
gatgacaagaatgaaaaggatgatgatgatgacgatgggtcactcggctccggtgtccgattccgaggacgacgttcgggttctcaagagttctgtcgtcgtccaccattgttgtcctggcgctgatccccattatcatcgtcgtcatgtcggcgtcctcgaccagtatcgtccggcgtccgctgttcgcgatcatcgcggtcgtgggggttgtgacgattatcatggtgtcggtcttcgttcgagcggcctcctcgttcttcgttctcgcgacgtcgtgaagagacacgatgtcgggagcgattctcgttgtctcgcgcgcgtcctgcttctcggcggccattcagatggtcgcggagatcgccggtgccgcgaggtggaggggtagctcgtctaggcgacgtccgttgctccggtggttcgccgtcggcaccgccagctatcggatgttctggttgtgctctggtagcggcctcctcgaacgcgttactgagattggctaccgattcctgtagtcgttatgtccatcatgcgagatcatcgttaagtacaggatcatagggggtttctgtcagtattgcgttgatggtgccgaggtgttgggccggtgtgaccgcttgattctccgcctctgcgttagcgtgtgcagacgtgctggtcccaccgatggcaaatacgtcgcgtggtgtactggaggatgatgagccatagtcttcgagcaagtgtaggactgacgactcgtggggatcgatgtcgattactccaatgaatcgatccgagatcaacgtcgctccttgttccttgtctgcatccttaagagagatttttgattgctggaccttaggaagcggcgtcttaatggcgcagagaaggaccttgtagcttgagaagtcgtgattcttcatcttgtgaataggacaatagacatcacgagttagagaagtacgctggattccatgctctttgcaggcatgaatttcagcttgtacgttgagaaaaacccagcaagcttgcaagttgtgtttcctggacttgtggataggacactagggctttgttatctcggaagttgtccttgtcggctcgtggttcttgtcggaaggacaaggtttggccgcactaggaaccttctcaggctcgtatgacgtcgacgtttcgttctccgctacggcgggaggatccttcgacatggagttgcccggggttatagccacggcgttctcatttccggtcattgatggaccagccgagataggtaccgtggtgtaaaccgggaagacgatttcgtcgacttgagtccacactagcattgttgaagtagggactccttggatggggccggtgttgacgctgttgtcgatgaagcttgatgtcatagtagtagaaccttgagcaccaaggccccctacctggcgcgccactgtcgacgggggttacccgtagaccggatatagagggtattgggatacgctggtatgaggatctacgtagtacgacatca

SEQ ID NO: 53806 - DNA, 1501 bp, Oryza sativa
tgtatgttccgcccactgcaattacgtactgaatcgtataattttgctgaaccatttattttaggttgatataaaagacagcgactcttggaatggtcattttaagaaaatttcgttggaagaaaggggcaaatttgatgaagaaacgctttctaatttggaaggcgttaagagaaataaagaatactctacaaagatggatgggagcaaaaacgagtatatagtggtatgttagacttgttactttgtgaaatgcttcttgaaatatttgccatcgatctgctgattatgatgataaaaggacactttcttgacaaaaaaaatggcgttcttatttgtttgatgtctaatgactgatttgttctgatctccaaatcatccagttaaccattcttgttgctacggatggaacaatggatttccccaaattgatcacaaacgctgcagatctgaaagttgctttgacaaagctctactctacacccgaaacaggtcttgaggtatggggaatatttccatttgtatttcgtaaatcgtaagctagcacaactgcttcttggtatattattgaacaagctagggaaaacgcagcttgaatttactagttactcatatcacttttaccacttttctgataagtattattatctgtttgttgagtgcctaatgaattggacaaactaattttgttcagggtattcacgttttatgggcacctcaagacaaggatgatattctttcgaaggagaggatgcaaaaggattatccatatctgaagcccttgagtgtctgattagggcggccttctcttcgtgtccttggaggaaacccatacaagaagtgaagaagagcattatcatagtcccagttattttgtagttagaacttagaagaacacatacagatcattaggcaattacactattataggtctatagtctatatactcctatatactggtaattgagatcagctcattgttttggttgccagtcaggaatcagggcacctttctaagcctcaggaaatgctctgtaaatggtgatgaacttgtaatagagcacagtggtacacaagaattttcagctgattaacatgatcaaggttgattttataattccatggaactattattgtatttattaccatattttcatataaaataatctcaaaatggaggaaaataatcttagactccatactccctccgtcctaaaaaaaaccaactagctatgtatttggacatgcgtcatgtctagatgcatagttaggagttttaaggacagagtgagtatgttactccagcagctatagtgatgttgatttgagaaatttaatatgctattttttaaatatttacatatactccttccggtctgaatatttggcgttccccgacccatcgccggaggagaactcccgtgctcgccgccgacgttgctacagctgtggttggccagctccccgtgttcgcctagaccgttaccattataattgtcat

SEQ ID NO: 53807 - DNA, 713 bp, Oryza sativa
ctattacctgacaaggggtctgaaccattataatccttgccttttgtggggtctgaaccattataatccttgccttttgtctgcttgatgtcgtactacatagatactcgtttcaacgtacccaaatactcaactcatccggtccatgagtaccactcgtcgataattatgcgacttaatttcccgcagcatcatgacggggtatttatctagttaaactaaatttcttgtgaattaaaaactgctacagagtagggggaaaagaaaaataaattacagtacctagacggtcaaggtcaaagcatcgcatgcccttgcggctttgactcttggcttggaggaagacgcctgaaagccagtgaggctgagcagcaaggctgcctggctgcgtcgtcacacgccacgatgcgtcctcgtattccccatctccctcgtcccgcgagactacggccactactcctacgagagtacgagtacggaggccgcccttgagttttcctctcactgagaggggttgaactgtaaaacatgtgttgtacagtgaaacattttgacttttacctccttgttttgtttgggtgtatttatgtcctgtttagttcagactaaacttccctcaaacctttaacttttcatcacatcacatcacatctaaaacttttctactcacataaactcctaactttttttccaaactaacaactttccctaaa

SEQ ID NO: 53808 - DNA, 1501 bp, Oryza sativa
cgcggtgagggagtagggaacagcccgtggttagggtttggggtataagtggttgtttttcgaaaaaaccccttagtttttaatatttacagctctacccctaaaacggaattttctcttcttcacattgtatatttgtgaaataggagggctttttcgcaacaaacacaacgggtgtgaaccagtccaaggacgtatacgatatttcgtggaaatacaaggacttttttgcaaaatatccttttagtcaaaccggctccaacccgcgcccaaaaaaatcgttggaccggtgaccgcttacgagcggtcacgcaggcgtacgcgaggagccggaatgaggagcgacgtgtaaaccatccagataaccaaaaaaaaattcataaaaatgagaaaaacagtggggttaggggagttattgattgatgattcacaccagaatgacgcatacgctagcacatgatggcttcagcattcaggacaaacaacatataggagcgttttggtttaataccaaaatattgccataccaatttttttggtagtttaaatagtaaatgtgaagatttggtttgaagccaaatgtttggtaatacctatacttaatttgacacaattctaaaatattcttcgccacaatttaaaatttggctctcaattggcataaactaaacacactcatttacagatctatcctactaaaatattggtagtgccaaaacttgtctagagtttggcactaccaatatattggtagggtactaaaccaaactagcacatacttcttctgttttaaaataaactagttgcctagtatttaattgaacacatcctaataatataaatctgaacagtcgatatctctataaagattcaattggatagtagatagctagtacattctttttggtaaattggaaccatgccattataattttttaaagtttgagatatgccattgatatctcaatgacatataggacccacataagtcaatgacatgtgggtaaggatggtatatctcaaattttacaaaattataatagcatggttccaattttccctttgaacggaggtagtaccaatgctgaggaagaaatagggtctttctgctcgttcatcgctacaaccttgatgcctttgtcgtcacctagctgctcgcagaagcctaggatgcttggaaaatccttggaaatgaagatgtgatataccattggcatgttgattgcgccaagatgcaaaacagtacagctggcatgttgattgcgtctttctgatgattgatataccactgacccaacagcccaacagatatgattcactgacacaatgttggtgccaatccaatccccattgtaaaaccagctaaacaaagcgcaactgtgctctgtcgccttgatcatcacagaaagacaattaacatctactcctagtattttttttttaaaaaagaacacatcaagctacttatcgctgcaggcgagaacgtacagtaaatgaggta

SEQ ID NO: 53809 - DNA, 1501 bp, Oryza sativa
aaattaattgcagaatccgtcactaaaccgtgagatgaatttattaagcataattaatccatcattaataaatgtttactgtagtaccacgttagcaccactttgtcaaatcatgaagtaattaggtttaaaagatccgtctcataaattagtcgtaatatgtacaattagttatttttttaagcatatatttaatatgtttaaacgttcgatgcgatgagaaatttcggttgggatctaccctcaggcaagcaacggcataaataaggcgacacatcccaagaagaccaccaggggaagcaaaggagggttcatggttgcgggtcagaaactcagaatagaagaagattgttccgtggaaaaaagaaaatagaagaagaaaggtatggaggatctagtactagtagtgaaatcaagaacgtcactccctatcgctttctcttctccccgaaggaaggaaagaaacaatccaatcatattatagctagtatccaatattcttgttgtctttcaccttttggtctaggttgtctagtgcttgctattcttctactagtagtattataactgggttgttcattatttgaagattttcttttcattggggggaccgggctagaacgatttttcaccatctttatctggtcggtttcatgataaaactgtgaaaagttgtgtcttcttccaaagctgtgtgggtatggaagggtttgtacgaggagagcgcatggagggtttgggggaaagaagaaaagattcacgccttcttttgccgcggcgatggggttttgggccgtgggcggatgcggccgagagagagagacctcccgcgcggcggccgagagcagccgaggcaggggggacggccggcggcggcgaccacgaagccgtcggtttgttttgttactactccatttctgttccccctccctgatcaagtaaactagtttgtaggatcgcatcaactcggatgaggaatttttgccgattagatttagttttcaagctggaaatatggtgattcacgggcctttttcttgtggtggttgtcgttgttgttcatgccatttttctgaagtgaaagatgaacaaaaatttccactgaaaagtaatattttgacactgcaggtttgttgaaaaacgatgggcacatcgtgcgaaagatgcagacggcgcgatgagcaggactacaggaatttggatgattcccaaaaacacttcttgctaactatgatgggtgattttcaacatgagatggtaagccaaatatttttttttatgaaatgcaatgctgcttcttttcttttcccttgccgtttgtattttttttttgtttctttgcttcttacaagttctgtttggtacaagcatgatcttccttgcaaatttcaataattcggtgactagattgtaccctcttaaaagaaacaagtattgatgcccggatttaagccaataatatgataccacattaggtttgttggttagcaccagatgtaat

SEQ ID NO: 53810 - DNA, 1501 bp, Oryza sativa; identical to SEQ ID NO: 53805

SEQ ID NO: 53811 - DNA, 1216 bp, Oryza sativa
gacggcgacggcgcggccgcggcgatgagatggcgatggcgacggtggctcggcggcaggcgacgagggagagggggaaagaggaggagctgggttaggggaccgcgtcgaataccttaggtgcaatgaacagtaccgttttctaattaacccgattttagtgtattttccatataaatttgattccacaattcttaattttgcatatatgcattttactcaatatttgtgttatcttaactaatgaattcaccctagattaatattactcatattttatttttatataatttatttgagttttaattagggttaattcttattccatcgtatttaaatttaattgatccaaatatagtcgcgataatattttatttatttctatccccacctaatctttattttaatttgtatgtattttaccaattttgtttttacggtttactcctaattaactattctttactcacgattaataatcttcgagatcaaatccaggtaaaatagacgaataagatcggcatgatgcaattaatttaaaaagtttttgaaaatccgtatttttagagttttgattttgtcggtcgaattttcagggtgttacaattaattaggcttaaaaatccgtctcgcagtttttagacgagttatggaattagtattttcattcgtgtctaaaaccccttccaacatccggtcaaacgttcgatgtgacacctaaaaattttctattcgcgaactaaccaagtcctaaaagtgatgggctctcagaaaagcccataaattaaaaaaaaggccgtgtgcttgtattcacatgagcggccttgtttagtccatttgggccttctactattccacggaggcccagcccatctcgcgaggctctgtacaacaacgctaacgagaaccgtccatttctcctcggctctctccccaccgttcgatattcaccgtctgatctcacgcttttttcttttaccaccccgagtcccgacacgaagtacctgttcactttggtgccattttcaatcttaccaaattttgataaagttgtttaaaaaatggctatttagtttattgtcaaatttttataactatataagaaatactgccaaaattttgacaatttttaacaactataccaaaaattggtaatgttttttttacgtcaaagtgaacaggtcgaaagctgttggttacaccacctttttacagt

SEQ ID NO: 53812 - DNA, 1501 bp, Oryza sativa
tattgccctgggtcagaatctctcaggccatcggacatcacgtagggaacggttgaaagctccacacccgacgctgggggcggtgggttgtcggcgatcgtatgtcctccgtggatatctatcggatgacaagaatgaaaaggatgatgatgatgacgatgggtcactcggctccggtgtccgattccgaggacgacgttcgggttctcaagagttctgtcgtcgtccaccattgttgtcctggcgctgatccccattatcatcgtcgtcatgtcggcgtcctcgaccagtatcgtccggcgtccgctgttcgcgatcatcgcggtcgtgggggttgtgacgattatcatggtgtcggtcttcgttcgagcggcctcctcgttcttcgttctcgcgacgtcgtgaagagacacgatgtcgggagcgattctcgttgtctcgcgcgcgtcctgcttctcggcggccattcagatggtcgcggagatcgccggtgccgcgaggtggaggggtagctcgtctaggcgacgtccgttgctccggtggttcgccgtcggcaccgccagctatcggatgttctggttgtgctctggtagcggcctcctcgaacgcgttactgagattggctaccgattcctgtagtcgttatgtccatcatgcgagatcatcgttaagtacaggatcatagggggtttctgtcagtattgcgttgatggtgccgaggtgttgggccggtgtgaccgcttgattctccgcctctgcgttagcgtgtgcagacgtgctggtcccaccgatggcaaatacgtcgcgtggtgtactggaggatgatgagccatagtcttcgagcaagtgtaggactgacgactcgtggggatcgatgtcgattactccaatgaatcgatccgagatcaacgtcgctccttgttccttgtctgcatccttaagagagatttttgattgctggaccttaggaagcggcgtcttaatggcgcagagaaggaccttgtagcttgagaagtcgtgattcttcatcttgtgaataggacaatagacatcacgagttagagaagtacgctggattccatgctctttgcaggcatgaatttcagcttgtacgttgagaaaaacccagcaagcttgcaagttgtgtttcctggacttgtggataggacactagggctttgttatctcggaagttgtccttgtcggctcgtggttcttgtcggaaggacaaggtttggccgcactaggaaccttctcaggctcgtatgacgtcgacgtttcgttctccgctacggcgggaggatccttcgacatggagttgcccggggttatagccacggcgttctcatttccggtcattgatggaccagccgagataggtaccgtggtgtaaaccgggaagacgatttcgtcgacttgagtccacactagcattgttgaagtagggactccttggatggggccggtgttgacgctgttgtcgatgaagcttgatgtcata

SEQ ID NO: 53813 - DNA, 557 bp, Oryza sativa
ggagtatgatttatatataagaaaatagagcgagccccaacattaaaccatagtcagcctaacattggaaacactcgcataacatatattgtatatataaaaacatgctctaggtaaacataataaattatggatctggcaatattgtatgatctgaaaaataggtacggtaaattgtatataaaatattgcgtacctttgtagatacatgccggatgtatctacgaaattaatatattaatttaaaataattaaactagtaattacctttgtttgtgtactgattggtctgaatgcaagcgtcatgtgtgttgatgtgtcatggagtcgacctatctctgctcctgcatcatgcttgtgtagcccaattggtttcttcggcacagcatcccgtcgtatccgagaacaagtcaaaactcaatcatgagggccatcggacttggtcggcggtggtaagtgtgcatgtataaaccagggaacaataaaaaacacatgagcagtactaaaagaacgagaccgatataactatgattacaaccagaagtagaacggttaac

SEQ ID NO: 53814 - DNA, 324 bp, Oryza sativa
ctcaacataatcacaagagcgttttgagcctcctctatatattgtgcaactttgtcgtgtatgcaaaccctttagttatctccattttgaaccaacttaaagacttacccgctcaattttgaagattttcctgcaggggttagtccatatctatacaaccaagatctatacaaacattaactctaaggttcactaagcaaactagacaccatatctaatttgattaaagaagactttttaacctagcaccatgcttaatttgaatagcctttgaatggacttcaaaattcaaaccagagcatgtgagaatagataaaggaagca

SEQ ID NO: 53815 - DNA, 1259 bp, Oryza sativa
caaatgtataagatataaataacacttaaagtactatgagtaataaaacaactcataacaaaataaattataattacgtaaattttttgaataagacgaatggtcaaatatgtgagaaaaagtcaacggcgtcatctattaaaaaacggtggtagtacttgcttatggtttacataatgtctgatatttaatctgctcgctatatcctgataatactagaaagttcatgcagttttttaagtacatactcgatattctctgctatatatcttgccttctagaaaatatttttcaggaacaactgagcactcaagtaggttatggtcgagtgcaccccatcatcgagaacgctctcgacaaatgcttagttgtcacacgcaacctaccaacgaagaccgacgacctatcacataaatagcgacggctacggctgaactatttgggaataggttgttaatggataattcctcgcaaacgttgtcggcttgatcacccgacatgattgcgaacatacatccagatatgctataagttgggtatatgagtcatgctggccacatgagatgcacatgtaataaccaactctagcgcccctataggtgattaagagatgcctactcctagttattgaccagatagttgtagcgacatcccgccgcctatcaatttaaattcacttgtggaccgttgaactccatctatcactgtcgaaagctccatgtctctacggtcttacaccgggatcgaccaagtgagtacggcagatattgataaggggagtcgtggataacaagagatgctttcgtgaatacggtttgtttccgtatgcctatcagttgcctataggtggtcgagatacacctacacctggtcctcgaccagtagatcatagcgatctctcactacctaaaaattcatcttcaggtgatcgagatacgcctactcctgatcttcgaccagtcggttacagcaatctcacgacacctaacgcgacaatcaacattgtcgtgatagcgacaaccaagaccgactagatcgccgttgtcgccaagacgacaacgtccaggactaacgacattaggatgacaacggacaaggttaacgacatcacaacatcacacgacgacgaaaaaactcaagatccccagacttatagagggcccgaggatgaggtagtaggtccaggagcggaacctcagactacgataattcctcactccttcgtcgtcatcaagaggcagttctcgcaggtcgcgaga

SEQ ID NO: 53816 - DNA, 400 bp, Oryza sativa
tccgtaaaatctcaatgatttccttaacgaacatggatccttttcgtatacttgaggatataccgtattcgtatatctcataactcataggatagaggatataccttatccataaccctgacattagcccccgacttcaaatcaaataagtactcgttctcgcacccagacttctcaatcaacgacgtcgtattatcttggtcattctcaaaaaaaaatttgagaagacatgaaacattcaatgttaatgacagaagagcaatggtcctttaacaaatttgaatttaagtctaaacaactgccataaacaatcctaagaaaatcacggcggcattctctctccattccttggaattcgaactgtcagatagtgagcttatgaattctggttccaagaacc

SEQ ID NO: 53817 - DNA, 372 bp, Oryza sativa
cctgcagccctgaaacaaaattcaaacaaaaatttgttttgcataacgaaaaaaaaggatgcttctccgtctacggaacaagattataatcaattttttgtggaatgatagatcaatgttggtgtcagtcattactttcttcaattttttgggcgttgtactgttacacgtggtactctagcagtatcttagggaaagtcttcagacccttaccccatccatgactcacaaacaagcaggatgaaataacaggattttgatagagccataggctaacagtgactcattcatagatgacatcgaattcgagtggggaaatgcatttattagaatttcaaacttgaatatgatgcaaaatttcttgaatgcaga

SEQ ID NO: 53818 - DNA, 1501 bp, Oryza sativa
gagaggcggaggcgcagttgccattgcggaggaaggaagcggagtaaggggatacgattgattgcgcgatcgatctcccaccgcatgacccccaccgcgtgacctcgcgtcgcgtgagccccactgtcgttggatgtgaaacattgaatgattttcatccgttggatttgatgaatgaagtatgaaggatgtaaacatcagttggtgcattatagggtagattaataacaaaatgtattaattgttgctaatcaattactaatgatcaagagtagcaaaggtggatttcctcatctgaccaatttggccagatacactcatccaacatcttcatggactattcagtctccaggtcgtcctatccaccattgcccaccaactaaatatactcaaaaaactatatcaccatgcaccatctcctatccaatgatatatctccaaccaaagacaacctaaatttgcaaaccggtcatgcttcctttctggagcatcagggtgttttgactaaaataatttgaaaaactgcacacagataactagtgagtgttcttcaaagaaataaatatagaccaatgattataaaatgtctgctaggttgatatggatgataaaatcccagtgcatgatgataaaatgcaaggtactcgtgataaaatccaattaccatagtttgaaagctatatatcacaatatggtttgcaattatagttagaataaaggctagttcaagaagcaaataagatggttattcataaattaatcattaccaatatgattgtgattgtgcaatatgttgatcctttagttcatgccttaagcatgcttgcgtgctcgtctcgctgctccagctccattgatgtagcaacggggattcttgatctttcgatgagaggatgatagcttcgatttgagagaggggggagtcgacattggcggtccgactacaactaccataggagtgttgcgccttagtaagtacatgaacttcagattgttgttgttcttcctgtgccaagaacaatcttgaacctgatggtgagactatataaatctaaaagtgaatggagtaatttatagtttagggtatggtgaggctggacaaatctaaaagtttatgacaagatcttacgaacaagtactcaattgcccaaaaggagctcgtatgcaaatttggtagccatttgaattcaatgcaatctcaggtggccgaattggattctagagtgtggggttgatctccatccctgatgtgtacatcttccatgtgcatcccaataatgtatgtcactcctaaactaacagataaaataggggcttgtgatgaaatgaatttacatgatattttatgtgagcaatcgttttataaatagtagtcatggtcatatcatccacaactgcttgaccgtcttggcttgcggcaataggtactagctagcttgtggtagtattaactcttggctcattagacatgacatcacgtccaactactagagtaactcac

SEQ ID NO: 53819 - DNA, 212 bp, Oryza sativa
caggtcgactctagaggatccccttttttgtcatgctttttttggctttgtacaaccttggtcgatgtagaggctaggagtttatcacttcctatatgtatgaaaaagtgaaactatgtgtgtgtaggtaattttgaaatgaattctaacatgtatatatatgaaacattttgcaattgtagtgcaggtatgcctaagatgggtgtatgagt

SEQ ID NO: 53820 - DNA, 1501 bp, Oryza sativa
aaggaagagtggagtgggggagtgagagagagaggtggctggtgctttcattgtgttccttgagcatccattgggcatggggggacggtggatgcagtgaggggagagtgggaggctgtcatgtgggtcccagagggtgtggggcccactgtcagtgaaagaaattcgaatagttttactattccataccaggagctaatcaaattattaccaattatagcatcatttactatggtgagaagggtgagactaatcacgaaagacattgttagacccgcccataaccacgggcacggctattcgaatagttttactctgatcagaggtgtaccactgtacccacaagacacaaccccacatcatgtcaccatgtgcctcaataccaccacggtacctcggaaaggagttgtgacaatacccctcacataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgtccatcgtgaactatcaataagccatcatgaaataatagtgaatcattagttatcccataaatgtgctaaggtttctaagcagggctaagcaattatatctaatatctagttgaaccaatataaataaagctcaactagtcaaattattataacccaaggtatcaaggaataaagtaatcaagaacaaaagggctataataatcaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcacaaaaacagcacataaacaagcatgaacagtacatgtggatatttttaatgtgtagatctcaattttagaaaaatttagagacttgaaccaactaaaacggagctaagatgaattagttatgaatttttaaagatttaatcggattaaaacacttaaatcggttaaaattgaattatgacgcaataatgaattatttttgaaaaggaaaagagggtttattgcgtcagcggctagggttttggtggaccgggcgcacgggcggcggttcacgcgaacggacggccgagatcgatccaatccaaaacggacggccgagatcgaacgatccacgaccggctcacggcggacgaccccga

SEQ ID NO: 53821 - DNA, 1059 bp, Oryza sativa
cccctccctaccagtccagcctagcccacacctccttccctccccacgggcctccctgcctcctccccgcgcgcgcctccctccctcctggtgaccccgcgcacgcctccctcccccttttttctctctctcggggctactcttttttttctcccttctcttccggctactcctcccaatctccctcctcattttttttcttttttttctctccctcctcttcccggctcctcctcctaatctctccatccggtttcttttttctaaaaaaaagaaaaataaattaagagaatttaaaacttgaaaccatgatctcatggttcacggaaaactcccctaaccaattcaccttatgacactaagtgattacaggttatcgtttgtttgctttatatgtttgttcgaatcagttatatttactatagaaatcgaagcttcttactttaatttggaactagcattatcgcagaagtgcttaacatggtacgttactgcgaaatgtataagtcgttactatgaaatttataggtcgttactgcacgttttgcagtaacatcatgatgaaattacagtaatagagaacatatgatagtaaaggtactactacagtaccactgcttgtgcatagctaaatttttaaatctcaatcttgtgcaaaacacaagtgctaaaaaatacttctctttgtccatacaaagatacatagtagcaagcttagtacaagtaaacttttagaattctaatctttaaacaataatatctctcacatcacatattattttttagaactgttttcaccataattctttaaaacaatgttacaacgagacaataatcctgttactacacgatgatcgagacaataatgcttttataacgttgttactacggaaagtagttgtgttactgcacattgatcatcgcgttactacgccgttctaaagagacgagaacttaaaaaaagtaaatctcaatctttagagagcaatatctcccacgttatatagaatttttctaatcggtctgcaccatgatgttcataaaaaaatgtatccatca

SEQ ID NO: 53822 - DNA, 1501 bp, Oryza sativa
cagatctaactccaaaccaggagctaagcaaattattaccaggtataacatccataattgttatgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaacaaggcatggactccccagcgacccccgtgggcttatctccgccacttctcagtctggtgctccgcaatgaaccatgttatacaaaaggtaaagccgttgcccacgctggcttgtggttggcacggttaatgtttcacaacagtagctcgcgaaccggtccttaattgtcatgagcatgactctcaaaaccatgtgctcacaacccaccattatcaagttttagttggcaagtaattaattaaccaatcacgattaaccatcgtgaactatcattaaaccatcattaaataataatgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaaaaggccataacaaaggaatagattcacaccacccaatgacattcgaaaataaatgcacagttgaaataaatagagaatttaaatataggatcaacatgctcaaaggattgtgtttaggatctgtgtgacttgccttgcaataatcggtcttcaaataatcttcttgaacacttccgacgcactcgcgaaccttcgcaacgacggaaacgacaagctaacacgcaaaatgaagaaaaagactaataaaaaccaaataaacagtacatataaagtaaacaaacatgtagatcataattttagatgaattatgagacttgaacggcctcattctgacttcagatgaatttattatgaattttactagattaaatctaattaaagcccatttaaaaagaattaaataaatttaattcaatttatggataattttaatatgtagatctttattttatacaacttttgcaacttgaaccacattaaactgagttacaaagaattagatatgaatttttaaagattaaatcggattaaaacctttatatagattttaattgaattatgacgcaataatgaattatttttgaaaaggaaaagggaattattgcgtcagcggctagggtttgcggtgaaccgggtgcacggcggccgctcacggaaacgaacggccgagatcgattctatccaaaaccggtggccgagatcaacttgatctaccgcggttcacgggacaaggcgacgatgacgtcagcgg

SEQ ID NO: 53823 - DNA, 1274 bp, Oryza sativa
ggtccgccgccgtcgtcgccccggaccgtttcccgccccggcgtcgcctccttcggcttcgccgcaccgtcgccgtcccgttcaccccctcgtcgagctcgccaaccgccggagcgccgccgtccccgtcgacccaagccgcgccgccgccttcctctgctccggccgcctttttcgtcgtcgccgtcgacctagggtgagccgtggaccgccgcctcttttcccccttcccttcccctctctcggccgcctctacgccgtgcctatggccgctgccggcgaccataggggcgcgcgcgccgcctcctgccgaccgtgccggcatggccgcccccgggcgcgccgagtggctgccgcgtggggcccggccgtcagccgcccgcgccatcgggtgcggctgacgtgtggggtccacggcgctggccggtgcgagcccgggtgcgcccggtccaccgtggaccgtgaggctgccgtgtgggccccactcccgtggacccggtccgcgcgccccctcccctcggctgacgcaataaaccttttttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctttttatatggagtttattagagtaaaagcctttttcttttccgttggtcgtgtagacgctgcagcttcggaagatccactcttcgtggaggttgaagctgacgtttgggaaagcgagcaaggcaagtcacatcatccttgaacatattgaatcccagtttataaaattattttgatttaaattaatgcattatcgctttatttaaattcccgcgttatcactgttttatctagccatgcctatttacctttgttttgaccttattattgttattgttattattaccttgttcaccctagactaaacaaaacccccaactagtgggtaccctatgcatggtaccactagtatgaatttaggtagatgtttcgctggttaattaggcaacattaggtggttttacaactctagattttgggaatgttcatatcacctggacactatggaatggttggattattgtggaattggattcacacctccccctctattcaaaatcctcaaaatggttttaggctgggctcagggtgcatggttttgatagtagcacctcggccatataaggaccggt

SEQ ID NO: 53824 - DNA, 1501 bp, Oryza sativa
cgtctcggatttgttcttcccgagctttccttcgccgttgccgtcgcgtgggccttcgccgccgcctccgagcccctttaaaaggacccccggtgtctcctctacccgtcgccaccttcgccttcgcctctcgtcgtcggaatcgctctagcgccgtgtgccctagcttcgccgtcgccgccgccgctccagccgtgctccgccgctgttccagacgtcgccgtcgctcgggaagaccgtcgtcgtggtcgccaagtcgtcgccgtcctcgtccgccccttcgccgtcgccggagatcgtcggagcttcgtcgccgtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctagtgccgccgttcaccggcgagcgtgcgccacccgagccgtccgctccgccgagccgccgccgctgtcggtgacgtcattgccgacgtcatcggggtcgtccgccgtgagccggtcgtggatcgttcgatctcggccgtccgttttggattggatcgatctcggccgtccgttcgcgtgaaccgccgcccgtgcgcccggtccaccaaaaccctagccgctgacgcaataaaccctcttttccttttcaaaaataattcattattgcgtcataattcaattttaaccgatttaagtgttttaatccgattaaatctttaaaaattcataactaattcatcttagctccgttttagttggttcaagtctctaaatttttctaaaattgagatctacacattaaaaatatccacatgtactgttcatgcttgtttatgtgctgtttttgtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattattatagcccttttgttcttgattactttattccttgataccttgggttataataatttgactagttgagctttatttatattggttcaactagatattagatataattgcttagccctgcttagaaaccttagcacatttatgggataactaatgattcactattatttcatgatggcttattgatagttcacgatggacaatcgtgattggttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggca

SEQ ID NO: 53825 - DNA, 1501 bp, Oryza sativa
tatcacattgaaggcatctcctactgttgatatttgtcggtccccaaataatactcatctttgcaaaatttttctttccttgaattattcaatgtcttagagtacatgaccttgcaatgccacttccttcttgttgcagcacattattcagtttgcgttatgaatcaaaaagtggttatagtagatagaaatagtttggaagaacagggagcctaaagatcctttcagtggatgtccgtgtttgggcggcttgagaccatcttaatattgtaggtgcaggaaattaaactaaggtaaaagcgagatgctgatgttaggtgtagatgatatggatacctgaatcagtccaaacctgcttaggttggagctacttctcgataggaatccaaatatcagagggaaggttgtccttgtacaaattgtcaatctagcaagaagtacagtggaacacagaggaagcaataaaagaagtggattacaaagtgtcatccttatttaccatcatatattgttttaatgaaaatattttattttattatgcatctgattgttattgtaaatgttatgagggatagtatgaattttatactatatgagtgcattgttttccgacagaaaaataatgagttggacaatttcagaggatgtgacacaaactgccatcagccaagcccactaattatgtttgagtttttgagttgcttcccatcttttagtgattatttcatactctgtggataatgttttacaccgtgcaacagagttgcctgaatatgagataatgttacggaatgaaaagcactaccattatgttagatctcatcttacaatgcttcttaatagatctgtatagctttgctcaagatctagaaagggaatgcaaatatcactccatatatataactctctttatcatttctttcttaagtgaattataaattaagttacgccgtaacgttagtacgggcatattactagttagtaattaacttgttaaaattagtgttgattagatataattagtctattttatagttcattagaatatattttggctttattaactataattaatatatattattatcaattaatatttattgttccaaacaagaaattgaaatagccatgtttgttgatcagtctagtacgttcaagaagcgggtattgggaaccttttcccccggtcgtttgtttttcttgtgcctcccatgatgacacaccgtcgtcactcgcgacgaggagcaaacgaggaacttggcccagcttagctgtggtgcacacacgcggacacgccttatccacactcacctcaccctcacccccggccctctcccatagtagtatcgtcatcacgaaacaaattaaccatagcagcagcatatcctctcccatgcttccatggattccttctagcttcgccttagcttctcctcctctacagtctacacgcgcgcatgcatagcatctatagagagagaacaaattaattattaggatt

SEQ ID NO: 53826 - DNA, 913 bp, Oryza sativa
ccggcatgcaagctttaatttgtgctaaattaggattggttactctggattccgttgcttaatttgtgggctgggaatgcaactccacgaccagctcaccgatcgccggacactggtggatccagtgtgactgattccgctaatcctcccattcgccagccggcactgctttggggaactctagctctcattaggcacctgttgtgatcaatcatgccaccgaactgaagccgaccatcccactgcctttgatcgattgcctgtgtatcaggtagtgctacagctactttgttttctgtacttgctacaaaataagttgatgtcaatttatggatttatgacctgctctcccctttttttcacatttcttgactgtgagagaaataataatagaaattctttgtaataataataataataataataataataataataataataataataataataataataataataataataatataatcaatatgcagattcactgttgagtttgaaaataaattctttgtaatgacgttactgctatatcttatatacccttctttgtaattaacagtaatggcatcaacgttagttcaatttgaactaaccaatatgccatacattaaaaacaaatggagcgtgaaaatagcatttttcgaggtcatatgactaattcccttgaacaaagaactttaaaatagaaagggagaaaagaactgattcaatttaattatatgactcgttgcaggctgttgatgttttgtaagtcacaattggggaaaaaatttgaacttgtgatggctgaaggaacacgataactttgggttgcatcccgatgtgaacaggtaatgtgttgagttgctttttttttctccaaatgacttattaatttgcagtggtacaccatggcacctgc

SEQ ID NO: 53827 - DNA, 592 bp, Oryza sativa
aagattttgcaggatgctagtagaatcattaccaatgggcacagtgttagcaatattctaaaatacggtgcaaatgtcatcacggaaaaatcaaaatgtaacatcagcttttgctaatttctcccaccacatccttcttaagaaatcaggacaaggaaataaaagcaaacatactatattgtacatctagaaaatatttttaaactgaagcacatgaatattttattctaggtacgctatggacttctgcttgcttcttggacctgttcattgaactgagaatcttccatttgacagtctatttaaaactagaaactataatttacaaattaagtaagaatctattgtgtgacatgttccgatatagctttcatgcatttggttcatttcgcttggatttgtatgatagctattttctcaggaaggaatatgctaactaggagtgtgtggtattataaattgagtttcttaaatggaaaatcacatcgttacaattttgtcacacgtgacttctcatgaaaaaatattaaccacaaattgagcatcaaaaatttttagctgcaactacaaatatcggccattcaacatggct

SEQ ID NO: 53828 - DNA, 380 bp, Oryza sativa
ccggcatgcaagctttaatttgtgctaaattaggattggttactctggattccgttgcttaatttgtgggctgggaatgcaactccacgaccagctcaccgatcgccggacactggtggatccagtgtgactgattccgctaatcctcccattcgccagccggcactgctttggggaactctagctctcattaggcacctgttgtgatcaatcatgccaccgaactgaagccgaccatcccactgcctttgatcgattgcctgtgtatcaggtagtgctacagctactttgttttctgtacttgctacaaaataagttgatgtcaatttatggatttatgacctgctctcccctttttttcacatttcttgactgtgaga

SEQ ID NO: 53829 - DNA, 1501 bp, Oryza sativa
acaagcataaatatttttttcatcataatataatcatgtaagatcttgatgtacagatataattgcaacgaaacgatgtaatcgggtcgtagatcagataagtaatttaagagaaaaaattatttgaaatttagatgggtaatgaggatgcaagtggcaggtgctactacttttagtaagaagggtaacaagttgattacacactgcactatttttggtaaaaagcatggtcgctggttagcacaaccgagtgcatgcgctccctgtagtcgcatccataagaaaaataatcaaaaaaaaaaaggaaaagtactagaacgtgaggattttatcagccaggcctccgacattgttgctacccaccaaaaatggccaccatcgccccgcttctagtgtggcccttccctctcccgcgttcatctcactaccgctagttccatccccttctccacttctccgaggcgattccccttctccaatccattcattccaccctcttccgatccccaaccgccgctggtccgtatccattccactctcctccgacccctaccgctgccggagtgctaggtgcgtcaggatctaatccctctttgtgtgcttcgtttcctacggcaattttgaattgtttatacaaaattttggggcgcatgatttgacagtgagaccgtgatggatcgatcttgaggcgctgaacgtactgcttgccaaaatttctcggttttgcgtcgtggtgcgggtgtgtgaggagcgttttgcattttaattttagggtatgaatattgacttgtcagtgcataattatatgaaatcatggaatagcattttgtagaaaaaaagaaaatgtgagtcctaggcactgttggcatgattgatagaaaactgtgtacattttttatgatgcaaggtcaggatcatgtgatgagtattaaaatcaggttatggattttcttttcacattatattatctgtgcattcttatgtaatagctttcttgtttatttgacatttatagttatccggtttgatttccctatctatctattgtgataaaaaggatacatggcagggtaccttccctggcccttttcgtcatacttgtttggcttcttgtctcatatgctctttttgtcttgctatatgcgatatgatatgatcatcggaccatggctatctaacagttctagatgctgaaggatgttggttccatggcccacaaatcccaattagttttttaaggatgttagtttaatgtgcatgtgtttgtattctatgattacaataggcttatccttactaggaaaatcctgacacttgtactgttattggttattttaagagcacgataacattattcaggtattcatctgttactattgttccagtatattatgggcatcacatgtcttgactggttatatctgtggcccatatttatcattctgatgatttaacatttactcatgtattcctctatcagggcatcacacgatgagtgttg

SEQ ID NO: 53830 - DNA, 1501 bp, Oryza sativa
ggtagcgtatgtttgtatgcatcttttatgtaataaaagaaaatatagaggatttgtttggttggaagctaacttttttaccagaacctaacttgctaaaagtatgacaaatcacacgtaagtacataagtacgtatagccaataaattgttggccgtatagcaatatttagctacaaaattatccagtgaccctgtctgggaagctttaaaattatgaaaaatagcttatgagaatcttctggcttctttattttttagattttactagaaaaaatattcgtgcgttgcaacgggtgaagattattttaatcttgtaattgttatatggtttagctagggtgaaattcaccgtggaaatttgcttggatattctattttagaaaatcatgagatgcagttaggagtctgacttttatctcaagttagcatgcaagtttttttttaaagagatttcttatacgactccttaggggtgaaaacggatcggataatatccgagatccgatccgctccgaatccatccgaaacgaggatatggtataggcttttagaaatccggcggatacggatgcggatgcggatatggtatctctaatatccaacggatgcggattatccaacatttttttcggattatccgataggccatttgccggataatccgaaaatatcaacatatgtgaccactctatctattgcatataacataaattggtacatccaatgtcctaattcatcaattaacatagatattttagtcaaaggcttttatcgtctcatgtcacactcaagtagctatatttttatattatgggcatcatgtattcatgttgtttagcacttaatcatataattattacgatgagtcatttattgattattgtactattgttccttggattgttaactcaatgttgtattgattgcatatacatgtagcatccgataaatttaatccgtttccgaaccaattccacaccgactccgcaccatttccgacatccgaaaacaatccgctccgcatccgcatccgtacactatccgcacctgctccgaatccgcttagaaaatatggtttaggatatggtatgaccactatccgtccgaatccgctctgtcttcacccctacgactccttttgtatttccaaaagcaaacgaacttaaaatctgactgaaatacggatttatatttctaaaagcgaacagacttaaaaaccgacttaaacacggatgacgtaccaaaataccggtaaaaacatctttaatttttataatagtagagatagagatatggtttagttacggtgaaattcactgtgttaaatttgcttggatatatattttgctagaaaatcatgtgctgcaaataggagtccgatcatcttaaattagcatgcaagtttttaaaaaagatttcttatacgattctttctatattttcaaaagcgaacaaacttaaaaaccaactcaaatacggatttatgtttccaaaagcga

SEQ ID NO: 53831 - DNA, 610 bp, Oryza sativa
atgtttgtgaggatggtagaaaaaatggaacagtatactcaagccttttgttaggacatgaagggtgtctatatttactttattatgcatttctgttagccaaacttagtcaaatttctcttggaggaaaggaataccaaggtgcaaaagcattgactatgtttgggagaaagtacttttaggttggctttagtgttatctttgagtatgagtaatgctcttcagaggtgcatagttggacattctcttttagttagttcagcctcctatgagtatatgaccatcattattctgtcattcacttatttctgttcttcctttttatcatgaggaatcaagctagcacggttaattgcctacatagcaatgcaggatctatttgtttttatacttacgtttttatacatagcaatgccaaacataatgaattaattagttgactgaagttgagaaaggaaaggacggctgtactgagcaatacggattattttcttaacttgtgatgctatttttttatttttatttggacttactcgccagctctgttttaaatgcagagagtgtcacagtagtcaataatacattagtaaatggcactgcaacagctagc

SEQ ID NO: 53832 - DNA, 1501 bp, Oryza sativa
aacaacagtacaacttcaacaacctggctgttcactttgagtttcctacacagccaaatacatgttattgtcttcctttccattcttcaatggtgttgggctgtgggcatatataattatcttcagtgactagatattgttaaacctacattattctagcacgttgtattcttctgtatctaaggtgctctccgttcaacaaatgctcatatatatttgtctgcgcttagtttcctttggtcctttactccttttacatctgaccagcagttcttttttcctgatctatctttttttattctttctcacaatttctctcgtacagaaaatttagatacaatttccaatatgaaatctgctttcccttttatgcacctttttttagttttgtttagtacaaacttttaatttgatataaggatgcttcttatttccagttacagcaagaaacatgttatatgcaatcaaatataaacttttttctattttatgtaccatcatgttaacatatttcacttactgtttgtagggaaagatttattgaatgagggaatgttgtgtgccaattttctgattgtgatgaacatcattccaaacttatctttgaaaccagccttatcttaactgtttcaggtaccatatggtgtgcatttcaagtataactattttgttcgagaggagaatgacgcctcttctgatatcatatggaggccaggtcctgagtactccttgtcaatacccccagttggccggaaaaaacatgtcattgttgtgaaagatctgtggatgaaaactagtgtggcaggcattcccactccttcctggggatcatggctgatggaagctaattttcttgaagaccaatttgctaagagtggagagcatcaaaacattgtgaaagcccattctgtcattgatacggtggatcgagcctcatcagtaggtaatgttgcgctatcttgcattcacttttatagaaatagtacatgtttccttagtgttgctgaacacttaaatgtttccagttgattggcaggtgaacatattattctgaggcttgggaacggcacacctttacatgtcaagaatatatcagagaatccatctgccagtgtccatgatgattttactgtaaccgataaagcaaattcaattaaatcaagtataagtgaacatgaaaggaatcagcctgttgaggaaccatggatccttggatctgtcatggcagcaaagaaatctgttgcagcagggaagcacgagaaaaacagatggaagtttgtcaataagaaacagaacttgagtgaagtaagtgaaaacatacctgaacaggatcaacctgtagaggagccatggctatttcaatccaaggtggtagcaaaaaaacctgtagttcaaactaaaggcaaaatagaagcaaaggatattatcagaaagctaaggaaaatggataaacctccagcgcctttggaggaggataaggcaactagtggagagccttcat

SEQ ID NO: 53833 - DNA, 162 bp, Oryza sativa
gtgggataagtttgcaatcacaccagtaattgaagaagaaagtttcgagccaaaaacaagaaatctcatgtggctcaattaaaagaagatatacaagagaattattaaaggcaagacccgagttgacaaagggagaattgcaacttcaagtatatgaaacca

SEQ ID NO: 53834 - DNA, 1501 bp, Oryza sativa
acctgttgtacctggttttccggttgaaggacgaaaatcggattcgttgacaagttaagggaccttagataacttattccgagaaaaaatggagggaaaagaaaaaagagaatggaatgggccaaatgaggagtttttggcccaaattgaatagagaattttggtaattttatatgaagggaattgaatagaatgcaaaggagataaaatctaaagaaagttatttggggactttggtcaaggaatttaaaggagatggaaatcaaaggatggatgtggatctttttggattttggctaaggaattcaaaagaaatagatctaaagaaaaatgttagtggatctttttgaaattttagaaaaggaattttaaaatagattttttaaaatgctaaagaggtttgaaatattttaaaaataaaactaaagatatttatttttgaaatataaacttgaaaaggattcaaaataaagatgctccaattttaatagaattcaataagaaccaaatatataaaacttgtcacaaaatatttcctctaatattttaaaatgtaagattgaaataatcaaatggaaggaaagaaaatagaaataattaatctactaactttggataaatatttgggatggtggtaaaaatggatggaggaataaataggattttagtccccagatatgcggtatgaatttctggtgattcggtggtgggctaaagaaaattcggactttatatggaagggattagaaattaggtttcttagcacaagagcaattattggtgataatattattcttgtgccaaggatgcgatcaagccatggtaatcaaattggcggctcgattaaaataagaacttaaccataaaatattttggatcggatggaaggaggtaaaggttttttgtggatagatctagataggggtgatccaaaataaattccaacaaaatttggaattacaccggccggtttagcctcagggttataaatggataatttggaggaacgagatttcaaagggaaaataattgtgggagtacagaactggattcggaagtatatgtggataggaatttttataggaacggaattagtggtagattgataaactctaaaggatgggtatgttgactcaaaaggggattgaaaaggatattttatggactctgggaaatataggtggagtctaaaggaaaggtatcaacatttcatgtactctagagatattcgggtagagttcaaagggagagtattatctttgaggaaattggaaattgtcatttttatgtactctagggtggttagagaatggcatttcatgtattctggagatagttgggtggagatcaaaaggaaagtattggttccggggagaataagaattggtattccatgtattctagggaggttgatatttcatgtgctctagggatggttaagcgggaattgaaagggtattcgttggaggtgttcgggaatgggttcaaaggaaatataatt

SEQ ID NO: 53835 - DNA, 1501 bp, Oryza sativa
ggcgcgccgttggagcggcgcaatccggcgacggaggtaatcgccgtacaccatggccccggtgagcccctgggatcgcaggcccgccaggcggtcgaggacggcgtcgtactcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcgattcaacaccggcccccgcggctggaagtagcagccgccaaccaccgacggcggtgacaccgactgcacggtgaagaaccaccggaacagctgaagagaggggcgcaccccaataaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactgtctcccgaccggtggcggactcaggcatgaagcggcgcggcagtccggcgtgcctctcgttcacgatgcgggaaggcggtagtacactgccgtcgagcagagcagagccccgtgccatggcggttgaggaagagatgattgagaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctagtttcccgtgcccacgcttccactaatcccattcgcccgcttacggcgcgtgaagtggatatgcggttgtggcaatcgaaacggattgtatcgtgcgcgcgttaattacgctcgccgactgaagcggcgttaccgtatctccgagcgagacaaatctgctcacccagattcgcgcgctgctcaagtgatgtggcagtcttgaatagaccgcccattatggacaaccaaagttatcaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggtcgggttgcttttgccccgaccccgagggccgaagcaccccgaccccttaaaggagtct

SEQ ID NO: 53836 - DNA, 155 bp, Oryza sativa
tcggtcagatcggcccccagtcagacgggctgcacaccctctgtcagacgggcctcgaagaaatttttctgaaaattctcgaattgattttgcacgtggatatatgcctattggatcttctggtcgtgtgtctcagtactggattcctaaatttt

SEQ ID NO: 53837 - DNA, 1501 bp, Oryza sativa
cctactcctgtgttttggtggatctgtgtatgaaagaactacaaagtgtgagccgacctctcccttgttctaggctctgaatctggaaagaatcatcccccttctctatgggcaaggtcctccttttatacttcaaggggataccacatgcacccttctctttccaaactggacttttcttctctttatggacggagattggtatggttgctgtccgaatgacactttgatgggacagcccacacctacctccactcccagcggagacgggcgcaacgtgggatcgtggctgcccgttgctgacgcgaccagtgtcagaccggtcattcttgtccaccacgcgtcagtttaatagcatgcatgtttgcccttcttcgtgtaacaccttgtctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttgcatgcagcgtgacacgcttgaccaaactgcaataaatgctgttaggtgagcacagctgtgctcacttatcccatatatgtggcgcagactcctttaaggggtcggggtgcttcggccctcggggtcggggcaaaagcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattgataactttggttgtccataatgggcggtctattcaagactgccacatcacttgagcagcgcgcgaatctgggtgagcagatttgtctcgctcggagatacggtaacgccgcttcagtcggcgagcgtaattaacgcgcgcacgatacaatccgtttcgattgccacaaccgcatatccacttcacgcgccgtaagcgggcgaatgggattagtggaagcgtgggcacgggaaactagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttctcaatcatctcttcctcaaccgcca

SEQ ID NO: 53838 - DNA, 1501 bp, Oryza sativa
gagcaccacctgccggcggggcgctccctgctgggagtaccagcctctttctttttgtcgctcgcaggcctcccctttcgagtggcccgcgaagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtggtctggggctctttggaagcgatcttttcgagcatgcggttgtgtcgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgtggatatgtgccttggaagttcatggtgaactgttggcacagatcctcccaggagtggaccgacgcgggtggcaagttcatcagccaaccccgcgcctgtccctttagggccatgggaaagaaattcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctattacgccggcgctcgatgttgaggcgggcatccggctccccatgctgatcctcccgagtcgagggtgtcgacgagggagtggcagccgaatgccgtgcagccgccgccgctcgctgcgccctccgccttgacgacacggagccggtggtagcggcgccggaggtcttggtggtggcggaccgtccaccagcacccaggcgctgctgtgccgtcatgaccaagttggccacgtcttccagccatcgctgggctggagactcagggtcatggacgacgggcgggtgacgtaggagcgcgccagcagcctgaagcgcaccctgaggcgtgctgccgtcgccgtagacgaggaggcgacgctccccatctcgctgttcccctgcatcacctgcgactggtgatgctgcggatttattcaccctctcgagcgcctccccctgcttaggactttggtgtggaggtgggggagtacgagctcgacgacgtgggtttggctctccgtcgtcgccgctcacactcggagagaggtcgtgcgcctttgcttgctcggccattaggctgaacaagggaagcttggcggacacggaagagtatgagagctcagaaaacacacgctgagccccctacctgg

SEQ ID NO: 53839 - DNA, 1501 bp, Oryza sativa
attaccaggtatatacgtttcgttggaggttaattctatttgctagagaactaatgatattacatgataaaagtttgttgcgcttcttttcatatgtacacttctatgggcaagatcatacactaagcggagagtaatggctatgatggatacaacaatttctcatcacatcataggtaaagccattgttacttttctaggtaaagccgtgatcggttagatgacgtttttctcgttactgaaccccgaaacttatctcatgcattccaattcctatttgcaatattgcattgcttttatcttgttcttactagttttttacatttgtttcaggaatatggttgatctttcttgacaagaccaacaacccacgaagaggtgtatcgatcgctgttgatatttcttaacgatattactagaaatatattttccagcaatgacgtagaaatattcatggtatatttatggtcacagatttgatccacaagcgcacggatataccattatagcatttcacccgggagtattccaatgtatcgtatttatttaatcccaagggaagatatgataaaagagtactatgctaatagtttatatattacttatatacatcaaggtctatccaggggttaagtaattcaaagggtatgtgcaacacagaagaaagaaatatgatactctcacaaaaatataatatatgctaagtggaggaagaataagaaaagaaatcattcctatacttctaatatacaaacatctttagtttacacttgttagtatacaattatgcaaccaataccccctaacagtgccctcctggtgttttgagagaccacctcggattgccgagttccttacgacaacctatcatggccgtccaaccggggctaaatatggaggagtaccctccctaggaaagtgtctaggaatatatactatcgtggaggaatacccatactgagctgtcaccatcagcagcccacctcgactgacctgtaccatatatgcccagatagtgatacttattaatctagacactaggtctacattattgaatactactctatatcccccgagatgacatagagccaccgagtaatcagacactaaacccacaccattgcacctcactggtaggctagctacacaactatattgatacaagtataaaatgaagttggtactcagataatataaatggaataaaataccgaagatgtataaagaggaatattctattaattcaattagtcttacaaaagaagagaggaaaggtactagagccatacctgaattctcctgaagatccgaggactaagaatactattctaattcctactccactaacactaggatactactaaacttgagagagggagagagctcttcttcttgagtgtgtgcaagagtgaaggatgagagctccttaaatagcctcccaatgacggttgtggtggttgaaatggtcagaaatgccctccaaccgtcattggggagtgat

SEQ ID NO: 53840 - DNA, 1501 bp, Oryza sativa
tacatcaacgagactacgagagcagagttatcaaagttggtaattagggatgagaagtgctatagcacgctacacgcattgtttaactacaacatgtgcctctctcttcgttcctccatatgacattttttcttattattcaccggattattaattatttttatattattcaccggattattgaaacaaattacttactacatgcttcacaaattacattttgttaaaaaaaatctactatattacttaaccatttgttttaagttatttgttaagtttatttataaaaaaaatatttatccttagataccgcgtcttattgcctaatcttaccaaataattgcttttcaattttagttcgcctacaattaggcttccagcatatatttctctccaacagttattttgtaacatatctctactgttataaaaattgaagatgtttttgcctgtacttactttggtacgtcatctgtgtatgagtcggtttttaatttcgtttgcctttagaaatacatatccgtatttgagtcggtttttaaattcattcatttttggaaatacagaaaggactcctaattgcatctcgtgattttgtaaaaaaaaatatccaaatgaatttctacagtgaatttcatcttagctaaaccgtacaatagtaataagattaaaatagccttcaactgttgcaacgcacgggcattttttttctagtatatttaatttatgagttggtccatgtgttttgactaaaaaacagaaaacatatgagcatctgatttaatgttgggttttatgacttaatagaaataatgtagtttttgataattctccatctaaattttatatgcagttagtcttcaaactaacatattggtttcggttttgggtccaactacaaaagtgtgaagaggataaggaattcttttgtgttgcatgctattagttagagacaacgatcatgcaaattttcatcaattttggatagaaatttactaatataattgctatttgaataaattatatctctccctcatgttggaggtggctttttaatgtgtcatcaatttattctttgttatatacttttattcttagttttaagccatgaactttgtaataagtggttatagcttctacagaagcaaaggtttaatttaattcataatattaaaaaaatggtttcaatttcccttgagttgagagcaaggaatgtgtgtcgcgatattttcctaataaaagagaatcctgttctgcaaacccaacaacgctttttctaccgaaaatcatatctcgaagtgacatttcggtctaaactagacaaactatgttttctttttaggactctgtcatatgttctcacgtcagtctccctttgagaccgaatcgttatttccaccataccagtccatcttttttgtttcctagtcattgtgcaaaattctttagaaaaaaacatttcagggttggattcgagttccgtttgtaacaaggggctcaa

SEQ ID NO: 53841 - DNA, 331 bp, Oryza sativa
ttgcggtgatcctagaggcgccaaccaccttgatctagcaaagagctaaacctagatgggttttgataactaaaccggctagtggagccgatttctagataactacccgtctcgtgggcaaaacggaaggttttcaggacaaacctacaaagagatgtcgcactctcgcagcggcgtcggacggtttacggcgcaaaccgacaaagatggacaaactaagagaaaactaaaagcaatatgaaaaacgattcgattgattgattgtagattggttttttacaatgaaccagccatgtcccttatatagggggttggtattgccctctacagg

SEQ ID NO: 53842 - DNA, 519 bp, Oryza sativa
gccgcatgcgaaaataggcccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattaga

SEQ ID NO: 53843 - DNA, 164 bp, Oryza sativa
gtctggactggagaaaggctttctgttgtatcaaaatagatcacatcgtgtcttaagatgagatttttttttcgaatgtagaaaatgctactgtatcgagacatcctaatagatcaaaatacaccttatacttcttaaaagtaggtagcagtaaatcctaccga

SEQ ID NO: 53844 - DNA, 1501 bp, Oryza sativa
ctgtgacccgtcacaaatgaccttgtatctatggtgggttatccctataaccatacctaaaatgtgatacttttcgacctgttagagatgagtcatctccaacgagtagcattagcttgtcacggatgtctggatctatagttgtgtcgtggtactacttcttaagggatggcccacatgtcagctagtgagaaatgtgatttggattggttggtcagtttttaagagacaaggtcaatttggatctttgtgcaatcccatctacctccaaactaaatacctaaaaaatagaatcaacccaacccgacccatcctatcccttgaactaaacatacgcttaggatcatatgtggcgcaaacatggttgtcaccttccctcttctctctcatctctccttgtttctttcccatagtgggaccatacaaaaaaatttcttttatttcatagagaattccacaatgagccacttatttcacttaatttagactagataagtttgcaaaaaggatccattttataccacttacgtacatatcttcctctctttatctccagcatgtagccaaacttgctggtgagctcctgagaaggcaaaaatgtgcatgataagctcttagctgtgataccacttaatatgctcacatctctgattagtttgatcttttggtgagttgatgataactacaatttggaacaaacattgacaacccgactacaactgtacaagacataattgtgttgtgccattgttggtatttgttacgatcacaaataaatccgcaagcgcacagataccgttgtagcatttcattcgtgagtatttagggtatcgttatttgtttttccgcaggggaggcggcggtttaaagaatgggctaatatattcatgatcatagtatgattaataaaccacggtctaagcaggggtaaatgataatatagatgtagtgtgacatatagaagatcatctcgataaaagataaactagattgtggagaaggacaaaagagagctatggtttattatatacttctatatttacgatacatagttcacagacaaacatacgtatgcatatacatatacaagcttaggacttcgttctatgcatataggcactaccgagagaccgctccctactggtctgccagtgtggttatgacattttaccaattcttgcgtcgtacccgaacatggagtattacaaaggacggacatggttgtcaccatgtgctgcctaagctctataacccgtggggtatacccgcatccaacaacatttaatcaacccaagaaccatgtttgcgttgctaaataatgcatatagctcccccgaaaatcccaccctacagatggaaaagtaagaactagctcacccattaaaatcactaaaacgatgccatggcatagatcgactagcctaaacatatatagcatatgaaataagtataaaaacatcaaggaaacatataattgacaaagtagtatatgaaccacgaa

SEQ ID NO: 53845 - DNA, 1354 bp, Oryza sativa
attttgttggtgattacgtgtttttcttgaaaaaaaaagcatgcgattgttttttatattttaaaaagtaaatcattttgttggtgattacgttgttttttattttatttttaaatagtaaaatagcatctatttttatctgatctctggtacacgtgagtccaaactttataattcagtgtttataccgacgtgcaagcctcatatttaagcaggtgcttgagtgcttctcaagctgtggggaagttattcgtgttacagtaccacgatgctacagtctcggttgctacagtaccgtgcagtactgtgctggctggtgctcctctgttatgtgggctggctgttgggttgagactgctgggccggccttatactgctttggttgggctgcttgctagctttctgttttttcttttctcttttatttgtgggtgtaagagatctccatcacgcttacggattgtggattagcgacaaaatattgtgtgggcccatgcttaacgacggacgaatgattaaccggaagctttacttatttttttaattaggtactgcggactctaatatgtcgtgttttgttgatgacgaaaaaaaaagatgtttaattttcaaattaaaattgattcattataagatttctgaatcataaaatatctgttgaagaaagcggtgttaaacgtttgatttttcagtgcatggtccgtgctagtggcagagagaaaaaaattgggattaaatagaatttgagatgtgagaggcaaaatagacttattctgagtaataattagtgttcaatttttttaaacggtagtgcagcatatgagaggccggcccgtactcagtgcaaaaggttaggcatatgagaggccggcccatactcagtgcaacggtagtgcagcatatgagaggccagcccatactcagtgaaaaaggttaggcataggaataagtttaccggaggtccctcaacttaacagcgagattttctgaggtcccttaaccacaaaaccagaaatctccacccctaaactatacaaaaccgttcactcaagctccctaggcagtatatatgggtggtttcgctgacgtggcatcctagtcagcaaaaataattaaaaaaatacgtggggcccacatgtcagccctgcatattttttttggcaaaatttgctacaggacatctaaaaaacgtgtaattagttagaagataccgcaagaatgtttatttgttgtagggcattgtaaaaaactggtaattagctgatgggcaccaacaagattattttattatatttggaggaatatgagagagaaacaagcattaaataccagtttacccttgcctcaaattagt

SEQ ID NO: 53846 - DNA, 342 bp, Oryza sativa
aataattttaattttttttaataagacgagtggtcaaacaatgcaagcaaaaactcaaaatcccttatattataggacaaagggagtagaaccgtacttacacagctgtttctctctctaatttttttagatataataaaataattccgcgggtgtccagcagctaattaccaattttttgcagtccctacagcaaaaacgcgttattgcgatgtcttctagctaattacacgttttttgaatgtactgttagcaaattttgcctattttttttcttctctgttcttcctcttctgttctcttttctctcttctctcttctctcttgacttcttgggtgagg

SEQ ID NO: 53847 - DNA, 190 bp, Oryza sativa
  unsure (1)..(190): unsure at all n locations
tcaaggggataanccattcctgnagaaggagcggcagcagggaaaggggaaggaatgaaaatagctgacctatgtggttgtcgctgtcgtccccgaccactgccaaagccagatccaccttcctcgatgcccagcaccacctgatgatgagaagcggtggcggcagggnaaaaggaaggaccagagggga

SEQ ID NO: 53848 - DNA, 435 bp, Oryza sativa
cggccgtcccttagtttacttgttcttttcttagcactttatcgaagatactataaatattcagggatatttactgtatcataaatatgatctatcaaaggaggaaaatccaagcgaaaaaaccatgttaccaataacgtcaccaatatgagcatatcagtgattaccagctcctaagattcgatcggtccaaaaggcacatttgcacctaatcaactgaagcagatgcaggatccgaagtattcgactccggtccggctcagacgaaccgagggatcatctccactggcgtgctttctcccccccccccatcgtttcgccaacaaagaatgaatcccttgagtccggccccccccaggtatcgacacgcggcttaatcccgatcacatcctgaggcaataatagagcgaataattctgagagtctgttgaattg

SEQ ID NO: 53849 - DNA, 190 bp, Oryza sativa
tttgacaatatgacaaatctaaatagcatttgtaaatattacatgactttaaatgggaaagccataaacagctaacttgtacagctaatcaagatctacaacttttattttggtcacttcttcatctgacaaagtgatagtaccaatgtttacaaaattaacatatctgtgttgatatttgtaaaccaga

SEQ ID NO: 53850 - DNA, 373 bp, Oryza sativa
caaagcccgattgaaatagattaatctctatcggccgtaaaccaaggcccgtcaccgatgactcattttccatctttcatttgttgtgagtgcaaaatatatagcctatataatttttattttggtcattattctatataatttttttcccaacagcttgaaattatttcgacaatatgacaaatctaattaacagcatttgtaaatactaaacgatttcaaattgaaatatggtcaacaacaaagttgatcctctcatcacgatctacaacttttattttggtcatgtgtaataaaacaaaattagccatattaatgactacacatatcaagtctttgcaataaaacaaaatacttcattcattacaataga

SEQ ID NO: 53851 - DNA, 170 bp, Oryza sativa
tgttccattttcataacaagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttc

SEQ ID NO: 53852 - DNA, 533 bp, Oryza sativa
cactcggatcctgttattcagggattcacaccgcatatgctatatattaatattaagtcacttggttgactataattatcaaaaccactcagttggtgcatctattaggtacatctattcgatgcacctgagtttatttttcagccctccacagtcttcatatttggtaaaagtactcgggagatcatggcgaagatgattgaagcactcggctttgaagtaatctagttcgagagaagattatctttccgactgtgaaggtctcaggggctactgtggagattatgggtaccgcatacccacacggcatggttatccgactagtcataggggatagcttatatctatggaatatgtaaccgatcatgacttgggtattacgtttccttttatattatggagcggcctaaagtcctgatttgataatattgtaaaatagatttaggaaaccgatactgtattggttaaagtttctatcttgtaatcctgtcccccatcctatataaggtgggcaggaggccctctagggggca

SEQ ID NO: 53853 - DNA, 479 bp, Oryza sativa
tactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtaga

SEQ ID NO: 53854 - DNA, 276 bp, Oryza sativa
tctatttgcatatgctctgttttgggtgctcgcacaagacatctataggctttttaaattaagcatggtgcttaggttaaaatagtctggtttaatcaaattggacatggagtttagtttgactaatgaatttcggagttaatatgttcatagacattggatgcatatcttttgtgaactaacccactgcaggaaaatattcaaattgacgggtgagtccacaagtttaatttacaatgaaggtaggtcagggcgggaacaaatcaattgctgaca

SEQ ID NO: 53855 - DNA, 578 bp, Oryza sativa
ctattctctcaaatgtttattgaatgatgtttatgcaaataagctatagtatgccatcctttgttatcctgtgcacttgcatatttgctgtgtggcttgttgagtatgtcatatggtcattcttgcaatattcattcatcagaggaggagtacttcagtgaaggtgatgattaggaggattaggctttgttcatgatcaggaggattaggctttgttcgggtcaagttgcttgtggagtggagtcgccatagctgtttagtcttttgtttatttttccgctgtgtagaattttattcttttgagaggaactatccacctctataatattttattattttgcgaatattaattagttgtttgataggactcaattatcaatttgttattgtgtgcctcggctgattcctggacgaggatttaacacacatgtaagcctttggaattttggatagaaattctgggcgtgacaaccttccccacttcgccggcgcaatagggccccttcctggccacgactcgcctcccccgctcctatttaagcacccccgcatctccctctcttctttccttttgtagc

SEQ ID NO: 53856 - DNA, 565 bp, Oryza sativa
tttgcgggaggatttccaaacgaatccgagagagagagagagggaaaagtggggggaaagagggagggaatcacggggagtgatttccccctctttattgcgcgcgggggcggcgggatgcggcggaatccgcggcggcggcggcgctagggcacgggcgaggcggcgggcgcggcgcgaggtaggggatgacgggtgggccccacccgtcagcgagggtggcgggcgggcccgcctgtcagcgacgcgcgcgcgggggaaggccgatgggccgcgggggagaggagagagagggagggagctgggccgagccggcccaagagaggaagggggggggaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctttgcataatttcgagga

SEQ ID NO: 53857 - DNA, 702 bp, Oryza sativa
atatatatatatatgggggacactcatatggggcaccatggtgcccgggcaccatggtatctaatgcacaaaatcactcaaatttttcaaaattttcaaattgtgagtatatacctagttataataattcgattcatacctatacttatcaacaaaacaactcaaatttaactttatttcacaatccatgattacatatctaactaattatatatatggatgctatatacctataatcaaaatctaacaaaaacaagttcaaattcagttcaaacttgctttgaactagttagtaaagtagttaatgttaatacctaagtaattgaaaaagtttcatactcatttgaattgggtatatactcaatttcaacaatggtgcccgggcaccatggagcaccaaacaaatttactatatatatgtacatatatatatatatatgtatatatgtatatgtacatatacatatatacatatatatgaaaatgtcgtcaacctaaaccgacaacatatgctgtgtcatattgtcggattcggctcaatcggctaaccccgtccgactcgaactctgtcgatcttagtcgtagccgattcggacttcagccaatcttcactctgtttccgggacaatctctatctcgatttccatctcaattcctccttcacatccgatccttggattaccagatttggtcattaacaca

SEQ ID NO: 53858 - DNA, 284 bp, Oryza sativa
tcaccctaggaaaataaaaccccaactagtgggtactctatttatggttccactagtatgaacttaggtagatgcttcgctggttaattaggcaacattaggtggttttataactttagactttgggaattctcatatcacttagacactatggaatggttggattatggtggaattggacacatacctccccctctattcaaaacccccaaaatggttttaggctgggctcgaggtgcgtggttgggttttgtttgtcgtaccttgggtactataaggattaa

SEQ ID NO: 53859 - DNA, 476 bp, Oryza sativa
gacatggattcaagccatatatatatatatatatatatatatatatatatatatatatatatatatatatatacacacacacacacatatatgtatatatgtgtgtacacatatatatatacatacatatacatacatgtacatatacatatatatatatatatatacatacatgtacatatatacatatatatatatatatatatatatacatatatacatatatacatatatacatatatacatatatatataacatattgtcagggttatggataccacatatctaatagtcgtcgtcgccactgccggtttccggtgaggaggttcgtcgctgccgtcaccgccggtggcgtggtttcgtgtgtaatttattttaatctattcttatattttggcggggtttcggttcaactgtttcgcaggttgagtactataacaatttttctttgtttgtcaagaccttaagacgggaa

SEQ ID NO: 53860 - DNA, 1358 bp, Oryza sativa
ttccggagcgccgccatcgccggagcatcgccaactccctccgccgagcttcgcgggctgccgcccaaccgctcgcctccgtgcctttttggccgccgcccctcggtgagcatactctccctctccctctatctccccttcgtcggctgctctgtgtcgcgcctccatcgccggtggccgtcctggcgggctgtcgccgccgcttccgccgagcgccgctcccgcgccgacacaggctggccgcctccccttggcccccgccgtggtcgatctgggccgttggatcggtctcgtcctccatctacgccgtccttgtggcgttccccctcggccacgcgtcggtgccctcgtggcgccacgtcagcaccacctcaccccgctgtgccgccatggccgccacgtggtcttccttgttaagtgcgcacgcgcttgtgccacggtggaccgagtccaccgtgggctgcccccttgactcactgactcgtggggcccgcctgtcggtgcctgctccccttgctgacgttagcggtagaccatttcctttgggaaaatatttaataaatgcgccataaaccgataataattatagaaaatgatttaaatggctcaaaacttccaaaattcataactaattcatatgaactccaaattgggccattcaagttgcaaaattcatctcaaattgagatctacatgtttgtttactttttatgtactgtttacttggtttttattagtgttttttcctttttttgcgttctagcacgtagatgtcgccgttccggaagatggcgatagcgaagaaaagagtttagaagattgtttgagcaaggcaagtcacacattccccttcagcattttgagcctacttttacaaatgttttatcatttgcaaataaatatgcattgttttgctaattacatgggattagggtttacctatctgctcgcccgtgccatgtttatttgatatccatcttttgtcaaccttgggtgataattcgactagcttgtgttacttacattgacctagctaaaatcatatatgcttaggcatgcttagttaccactagcttggttgatgggataattacagttttagatctcttagtatcatgatgagttgcgtgctcgagacatccgaccatgtttctatggccataattatcaaactaaaatgcgactgaatggtgggctgtgggtgcatggttttgctggtcacacccatggcaattaaggaccggttcgtgggatgcactggaagacatacagcgcttgccacaagcgggaatgggtaattgcctgacttgaagtatagcttttctctggctgacgcatccaggcaagggtgggcgtga

SEQ ID NO: 53861 - DNA, 578 bp, Oryza sativa
atgacattctaaaacaatgcaatttaatagaaagcaggggattttataaaataggttcatcatgatcaatgttgtatgtatggcttgccttgctcttgagctgacggaacctcggcaaccacttcgaaataaactagatcaccggaactgccagaatctaaatgacaaacaaagcatacaagaaatacaaccttaatcatttattacatattaatgcccacagataaatagatcaatagaaatatatctccggtaagcaagcctcatgaattagcgactcaacgagccaacacttcgtgacacgggaccatccaaacggtcaactgaaccggcgactcagaacgactctaaactaaagaacgactcggaatgaccgaatgaactaaaactttggtaatactacgtccgagcgaatggttcgcggcttaacgaacggctgcagcaaaatcagcaactaaacacagtttgtggcaacgactcggtacggcaaactaaaggccggtaacgactcaggtttatgactatggataggcaacttggctaccaagctacggatagcggctagggagaatctaaca

SEQ ID NO: 53862 - DNA, 224 bp, Oryza sativa
tatgggccttcgttatttagctagtttgaggtggtcctgtatgattctcccttcaattaaaaaagggtcgagttgccttctagcgagcgctataacaccacttgtcatttttagggatgtgtttttttttaacaaagcactttttaggtgcaataggaggagcggcacggagaggagatcgcttggcgcgagctctctagctccagtccacctcaccggtcagt

SEQ ID NO: 53863 - DNA, 412 bp, Oryza sativa
cgcagcaactttctaagcaaccaggcactacaaattccctggcctgccaatcaagatttgtaaactagtgtttccaatttagttacagagaatagtagcaagatttactaactgagattgacactgatgtacggattttgtaatctgaaattctgaaagattgttactgcaaatatgcaatggaattgtgttatgtcatttgataatgagattgagtcaagtggaaccataaaattttcaggatgacagatgaactgtcatacttcttgttctgcattttctgcacatgtgctagagcacaacagcttgatacaggtttagtttcatgtattgtcatatattgatggcaaacatgtctcggataagaagctcttgttgcagttcatattttggcagcatctgccggactcca

SEQ ID NO: 53864 - DNA, 1228 bp, Oryza sativa
atccgttccaaagcaaaaacatattactaataattataaaattaagaattaatgtaggtgacacatttgtgcgggcatgtatcctagactgagtttgataaatttataggaacggaaatcaaccgtatgacacctacctaccacacttcaatatataatatttagttcatccctataagcaatatttttgtagaaaattttctaacaaacactaccagaataatgttttagagacattttctctttgatttttctcattatttctctttgctttttcgttgtagctgcaggcatgaggtaagctaccttgtttcccgttgaaattgactggttgtgcattctgtattattttggatggttgtgcatatttaagatatctcgttgatattgaatattagatgattaaatcactacattaactataaaagatatgagaaatctatactacattaagtacttgttatgaattacatccctagactattgggagagtacgagttagaattacccctctaaaaaaaacagacatctttcaccctcaactatcaaactattgctagttgaggatgaaagatgtatggttttcgggtttggagggtaattcgtgcattatggtgaattgtgtttacaaacttaaaggcattttataaaatgtctcaatgtcttatgacatcttaatagatgcacttctttatgtttataagaggatataggcattttttagagtgcattacatatataattaattgcacatttcactataaaatacatccaaattaacataaaaaaaacatatctacacaaatatcacttttaaagatgcatctgcgcatcaacaaaacatatatgcacatttccattcccacaaaaaaatgttctgcacattttccattcacagaaagtgttatgtacatttttcattcacacaaacctatacacaaataaaaatacatttttacactctacggcacatttgactacatcatttttaaactgcacacatgtgcaccagctctatacataatacatttccaactgcaaaacaactttgcccataacacatctctaacatattttccgaacaaatgcacaatttgcatcacaagaggtatacacatttcaaattgcagtgcacattgaacaaaatgaggaaaagtgaaaaacacatcataacatggtgcacttcacaaaccagcaaatgggtaggggtttccggtgaatatgacca

SEQ ID NO: 53865 - DNA, 1501 bp, Oryza sativa
cgcacttaatctgcttgtcccgtctgcaaggcagattggcagacctacctaatttgttgcatttgaccctcccattgtaattgttataccatgctcccttgtacccacctagtcgcgcctcggtaatcatgcactctgcacgggtatcgacggtcgccttcgaacttaaaatctgagaaacatcttgggcaaaacttgggttttacaaaagacttggaaaacccgacacctgggtcggtgcttgcgaactaaatgaatttccaaaaccgtggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatagcgaacctgtgtcggctttcaaaatgccttgtcatgaaagccttaaggtctctagtcgtggccgttctgcacgaactggatgatccgggttagtaatgtcgtgtgcgtaaagtgtaccccctctgcagaggttgttaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggcccgggtggccgtttgaaagctgttggccgggagccaatcttaatcaattcaaaagactgatacattgcacatactccgaccggacgagacgcactgtctcacccgtgtcatttgagaagcactcccttagttgtttcagaaaagagttcaaataaataattgcaaaaacaacagcctttctttgaagcctacattaaacacttatttcccatggcttgctgagtactcccgtactcacccttgctctatataaataatctccccccagttgctgaagaagataaagcggatcccgctgacgaggagttcttccaggagcaagccggctacgatgagttttagggtttcggcctagttcccaagtcgcgcctgtgatgtttggtccaagcctggcttccgtttcccttttgtaatgcagttgtgagctcgggatctgtccgcagcccaacatgactgtactcctactctataataaagagacctctgttgctgtgatattctgtcttcctgtgataccagcactgtttcctgggactggtatcggttaacaggttaatttggagcgtcatgggctagttccgctcgggactagttcggggcgtgacaaataaattaaatcattatgtgcttataatttcaacaatccaaaaaccttattataggcgctgtgattttacta

SEQ ID NO: 53866 - DNA, 1501 bp, Oryza sativa
accagtcggcgaaggccagccggtcggtgaagacgtggacacccatcaacagcggcataatagaccagccgtgtaggtcgagacaccagtcggcggtggcgaaggcaagccggctgtgaagatgaagatgcctagcaatggttggaaaatgctaggatatgtcctcacacatgtttgctcccaatctgctcgcacacgtgtatatatgtgcatacggcagagtgcaaattatgagtgtgagcagctcgctccagccagatcagggcgacgtcagccggatggataggccaacgatgattaatttgcatgtccatgcatctgaaagtattgcactccactgtgcttgcatctgcccctgtaaccaacagtccttcagcatgatgccgtcgtcggaggtaatcatggagccgtcaaacgccagtatatgcacgcgagagaaaacgaagaatcaaagggcagatcaatctatgattaaaaaaaaatcataattataataatagattggaacgataaattagccgatgccggatagcagtttttatccatgcatgcatgtgtttatgcgtgtagatgcagagccgatccttgcgtgtccaagtgcatgtgcggacggatgattgctatcccggcgagtagctgtcttcacacggctgatagatggctgcggtggatgacgcactgctacacgcctccgccgaggcgccgagtccgcgtcgaactcgaagcgtccagtttgatctcagcaatcaatctcaccgagcataacagaaaacggcgatgacgacgacgactggatcggaggctcgattgctatccggtgcgtgtgaacatccatcgctccagcacgcctgtccagatagcagtggtgactcccgtggccgacctccatgcagagcagtacgatcaagcagggttgtgcaggctggtagctggagacgtggccgatgatctcttggatacagatgatttttttttttttggctacggactgtatagcggctccagccggcatcttggcgagctgcatcttgaggattcaccaccattggtgacgtcggagattggagtgatccaacttgctgaggttgattttccttgctagattgaatctgattcggcgccttctaattggttccatctcacttctcgtagataactcgacgcacccctacctggcgcgccaactgtcgaaacatgaattcggcaataataaaacggggtaacgcacgagacctaaaagtggatggatgcagagagaaaggatttagacaggttcaggccctctcaatgagaggtaataccctactcctgtttggggaattgaatccgccgagtgtgtattgatctgacgatcaggttgtctcatatctgccccctagagggcctcctgcccaccttatataggatggggggcaggattacaagatagaaaccttaaccaatacggtatcggtttcctaaatcaggactttaggccgttccgtaatatacaaggaaacgt

SEQ ID NO: 53867 - DNA, 1501 bp, Oryza sativa
agcctctttgaccctaggttatgccaaatggttatccatagaagccctctaaaaatattggaaaagtagaactgttctcctccctttctcttttaattaaaccaaactaatggcacatgtacttcataatctcttttaatggttctcattaaaaatttatttcagtgttattagtactgtacatctattactgtactaatggctcatttaccagcaaaagttttacaatactgttttatttaatcttgctgcaataaaataaatttagcatgttgattttataattttctttcttttcttttgaaaccagttattcaaaattacaaaatttgtgacctcgtttccaactgttttaacttatctcgcaaagcttggtttactttatttacttaccttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcagttggccgacactgagtatcgctaccatcctcgccaaccccagggaagtgaccgtggcagttaccttgagactgaaggaattgagaatgatgctaccacgaagcatttggttgagatgttgtgggctatggatgaaagtcgtgcggagactgtgttagccgctcaagatcgtgaagaccggaatcgcggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtgatggagaaagaagttgccccagctcaagcggatcctccggtcatcatcataagtagtgatgaagaagaagaatccaagcgcaacaattccaagattgagtgggtagcatctcaagatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtattaatgaaactcagttaagatcaataaaagttaaagtaattctctgtcc

SEQ ID NO: 53868 - DNA, 864 bp, Oryza sativa
atcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcacttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttatccatagaagccctctaaaaatattggaaaagtagaactgttctcctccctttctcttttaattaaaccaaactaatggcacatgtacttcataatctcttttaatggttctcattaaaaatttatttcagtgttattagtactgtacatctattactgtactaatggctcatttaccagcaaaagttttacaatactgttttatttaatcttgctgcaataaaataaatttagcatgttgattttataattttctttcttttcttttgaaaccagttattcaaaattacaaaatttgtgacctcgtttccaactgttttaacttatctcgcaaagcttggtttactttatttacttaccttttactctgattttctaactttattcaaattaatccaaaaacttgtgctattaattggataaaggtcttaactccctcctttcacttgtctttaga

SEQ ID NO: 53869 - DNA, 769 bp, Oryza sativa
acagtagttcatcaaaatacttttaaagcgtggcaggtgccatacagttgatattttgcccgtataaatttatcgaactcgttctacaatacatacctacacaaatgcacgggttacctttatagtcttatagttactaataatattaccgtgctttacaacggatcaggtgtatataattagggattgactcgattggtggattgaggagaaagtcttacagtggttatgcacccacaaaggaatgcacgacctcctactcatgtttagaaagggatggaaaagaaacgactgcggctgtgaacttaattatatactcatcttgcttgccacttgacgtcagaatcagtttaaagtacttaatgtaatattaatttctcatatctttcatacttaatgcaatgatttaatcgtgcaatattcaatatcagtgagatatcttcattatgaacaaccatccaagataatattgaatgcacaatttcaacggaggtagcttacctcatgcctgcagctgcaatgaaaaagcatagagaaacacagaaaaacaatgacaaataatctcatatatagcatcatcttccaagtctcatcttccatagtctcaatcaaatgcatgctagccaaattctttggtcatgaatccatttgtagattcatttgtttgagctcagctgaatccctttcttcaccatcaatccccttctcaccatcttccattgaaatcgttgtttgtccatatccttgtccatggcgtgcgtgaggtcac

SEQ ID NO: 53870 - DNA, 1287 bp, Oryza sativa
aaaaaaattatataagagttttcttttaaataaatcaaaaatatttcgaagtttataataattactccctccgtttcacaatgtaagtcattctagcatttcccacatttatattgatgttaatgaatttatacatatatatctatttagattcattaacattaatatgaatgtgggaaatactagaatgacttacattgcgaaacggatgaagtcttatgctaatgactcgtctcatttagctaaacaaacgtgctatttcgaacatgccctaagtaacaagcaagagcatatctctaggcacatttatggcaccagatagctagagtgatgcgatgagtggacaaaattgttttgtttatttaggaaaggagctttgaacctttttgctgtgtggcaaatttgtatcttgtttgtttgagtagcaaaacatgtgtctcgtagtcatactttatgtactcatacttcacttgctgcatgtgtctcgtagcggacgagtccatggttggaaattagtggctcggtgatggctggttttttataactattcatgggcacaaacaaataactaactgctataagatagaaaaatttatttaaataagttttctaagaaattcatatacgaagagtttttttttttgaatattgctgattttgtgaaaattgctgaatggaatggttgtattcctctagaaattcatatatggatgtttttttttgaaactatagcttgaaaaagaacaaaccatgttggtataccatgactaagaatgcaacttttaaaagttcaatattggtgatggtttgtcttttacccacacttttcaaaaaaaaaatattggttagttttttttttttgataaagttggtaattgtgatgtcagaaagtaaagatatacacttgtctggtagaatgcatattgtacaactcatgtttatcgatggtattttgtacaaaagtgttaatagcactttatataatttctctatatcactaaaaacacatgtggctgcatcatttgtggtatcttatcactagctggagaatgttcgctcgctgcagcacctcagtctactactacacccttctatagttggtggttcaaggtggtcaagggagttacttacataatcatcaacgaatcaaaattaaatgaagaatgggaaatgtcagggtgtggtataaaaatacattcggtgtcagggtgaccggccggccaggtcgttgtggtctgattatatgaactgaacagtacaaatggttgtgctcaattaatagctaga

SEQ ID NO: 53871 - DNA, 1501 bp, Oryza sativa
atacccggctgtacagatctaactccaaatcaggagctaagcaaattattaccaggtataacatccataattattgtgagaggtgtgagactaatcacgaaaaacattgctcaacccgcccataaccgcgggcacggctattcaaatagttttactctggccagaggtgtaccactgtacccacaagacacagccccacaacatgtcaccatgtgcctcaataccaccacggtacctcggaaaggagctatgacaataccccttgcacaacataatccaccacagcgcacctttcctggatcataatcacccccttataaacaggcatggactccccagcgacccccgtgggcttatctccgccacttctcagtctggtgctccacaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgcgagctatcattaagccatcattaaataataatgaaacattaattatcccaatagtgtgctaatgtttctaagcatggctaagcaatcatatctaatatctagctgaaccaatatatatagcccaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttggatacttccggcgcactcgtaaaccttcgcaacgacggaaacgacaagctaacacgcaaaacaaagaaaaagactaataaaaaccaaataaacagtacataaaaagtaaacaaacatgtagatcataattttagatgaattatgagacttgaacggcctcattctgacttcaaatgaatttattaagaattttactagattaaatctaattaaagcccatttaaaaaggattaaataaatttaattcaatttatggataattttaatatgtagatctttattttatacaacttttgcaacttgaaccacataaaactgagttacaatgaattagttatgaatttttaaagattaaatcggattaaaacacttatatggattttaattgaattatgacgcaataatgaattattttttaaaaggaaaagggaattattgcgtcagcggctagggtttgcggtggaccgggtgcacggcggcggctcacggaaatgaacgaccgagatcgatcctatccaaaacggacggccgagatcgaacggtccatgactgggccacgacggatggtcccga

SEQ ID NO: 53872 - DNA, 1501 bp, Oryza sativa
cgacgcagacaacacgatctcacggaagaagacatccctcatgttgctcaacttgatgggcttggtggcaccagaaatgtagtgcagaatccacgccccgtcgaccatggacaccgtcttgtaggacgccatggcgacgttcctgtcggccggcgggagcgcgacggcggcgccggtgaacgggttcagcagcgtgacggccgcggcgccgtccatgagcgccagccacccgtgggacatgccgcaggcgaccttgccgcgtacctcggggaggcgcaggtcgatggtggcctcgtcgtcgtcgtccatggcgcagtagaaggtgaccacggcggcgtcgccgtccggtgagtccggatcgaaggggagcatcagcatcgggtagaacgtctccagcggcagcgcggcgcaccacggcgagcagaccaggcggaaggaggcggcgtcgcgcccggacggcagcttcttggcgatgaactcgagcagcttccgtgggaggcccgagctccagtccggctccgatctcctctcagcaggcgcagccatggacaagaacagtatgatgcccaagaagatgctgaaaggggattagatgatgcagaaaggggattcagctcaaacaaacggattcaggaagatgaagatcgaaaggggatttgatatgatgatgcagaaaggagattcagctcaaacaaacggattcacgtacgagcaacaatttggctgtgagagactacgcgagctgaggatttggggagaattcgatctctgctccgatgaaaccgaggaattatgttaggagcaagagaggaactcgatcggtgaaaagagtcagcaaaagtaataatggcaaaagatctgtgagcgttttgtgggaagaaatttgtcttttctcccattttttgtctttgctttttgattcttcatcgcatgctctgaggggtgaggtgcgtgagcctgctgctgaatcaccggcgcgcgtacgtagccagttagtaaaggagtttacgtaagtgatgttccgaacttccgatggttccatgatgacacgaataaaccaccagattcactacaaaacatattgatgaggattattagattttttatcaactgcctcgtttactgtaaacctataaacggtgtgatttcttaaaagaaaacttttatataaaagtttttttaaaaaattcaaatataaacctatttttttaagtttataaaaattaatacttaattagttattttctagtgattcgtctcgttttgcatatggtcatttagctaaccgaacatgctacttcgaacaagccctaagtaacaagcaagagcatatctccgggcacatttatggcaccacatagctagagtgacgatgtagctagagtgatgtgataagtattttttttgaacgactcgtacgagacggtgcgaagttctattgatagagcaggaaaaaattacaagattacaaccctggcggatcgtaaccaggaaaaatgaa

SEQ ID NO: 53873 - DNA, 1501 bp, Oryza sativa
cctcctcccgcatcaccgacgtcaccaccggctctctcggcacctccaccgctgcacccgtcgtctggccgcgccgccgtgctcgggtactggagccagctccggcagcgtctcccgccaggtcgaccacccaaacccaccgccaaacctcgccgccgagctaccaggacgccgccgcccgtcgctgggggaccggatccgggcaccacggcactggatctggacgccgccggtcggcgccgacgccatgccctgagctcctgccgtgccgatgtcccgaccgtcttgaccgcgagcgagggagagagagccccgccaccgccgtacttgcagccgcctggctttgccggcggcggctcgggcggcggcgaggctgggagggggggggaagagaagggcggggacggcgcggcttgttcgccgcccgcgtcgcccccggacagagcgaccgggcagcactgagcaagtgtgtcagtttatgcgataagtatggacaaaattgttttgtttatatgggaaaggagctttgaactttttgctgtgtggcaagtttgtatcttgttgtttcgctagcaaaacatgtgtctcgcaatcatactttatgtactcatacttaacttgctgcatgtgtcttagcggacgagtccatgtttgagaattagtggatctggtggatccatgcatgatttatactgcaaaccaggctccatagatagttggtttttgataactattcatgggcacaaacaaataaactaactgttataagatagaaaaatgtatttaaataagttttctaagaaattcatatacgggaagttctttttgtttttttttttttgaaaattgctgaattgaatggttctattcctttagatattcgaatatgcaaggtttttgtaactatagtttgcaaaagaacaaaccatgttggtataccatgactaaaagaatacaacttttaaaagttcagtatttgtgatggtttgtcttttacccatacttttcacaaaaaaattggttaattttttttgataaatttgataatggtgatgtcaaaaagtaaatatatacacttgtctgatagcatgtatattgtacaactcatgtttatcgatggcattttgtatgagcaagtgttgataacactttgtatattttctctatatcactaaaaacacaggtggctgcatcatttgtgagaagtctttgtctttttttcctcattatttccgtttgatttttcatacttcataagacatgctgcagtggtgaggtgagccttcagaatcagcggcgtagccagttcttaaagaattgtaactgatgtttcgatggttgtccataatgacacatctggttgatctcggattatgtgattaaaccactacattcaatacaaaagatttgaagtattactacattaagtgttgtgcaagatgcatatctcggaggatgcaggcactaaaaacaaccccatgtaaaaacattttctttaaat

SEQ ID NO: 53874 - DNA, 1501 bp, Oryza sativa
ttcataactaattcattgtaactcagttttatgtggttcaagttgcaaaagttgtataaaataaagatctacatattaaaattatccataaattgaattaaatttatttaatcctttttaaatgggctttaattagatttaatctagtaaaattcttaataaattcatttgaagtcagaatgaggccgttcaagtctcataattcatctaaaattatgatctacatgtttgtttactttttatgtactgtttatttggtttttattagtctttttctttgttttgcgtgttagcttgtcgtttccgtcgttgcgaaggtttacgagtgcgccggaagtatccaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactattgggataattaatgtttcattattatttaatgatggcttaatgatagctcgcgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatgattcattgtggagcaccagactgagaagtggcggagataagcccacgggggtcgctggggagtccatgcctgtttataagggggtgattatgatccaggaaaggtgcgctgtggtggattatgttgtgcaaggggtattgtcatagctcctttccgaggtaccgtggtggtattgaggcacatggtgacatgttgtggggctgtgtcttgtgggtacagtggtacacctctggccagagtaaaactatttgaatagccgtgcccgcggttatgggcgggttgagcaatgtttttcgtgattagtctcacacctctcacaataattatggatgttatacctggtaataatttgcttagctcctgatttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagt

SEQ ID NO: 53875 - DNA, 1501 bp, Oryza sativa
ttaatatctccctatacattttgtttgtgcaaatgttttgtgattgtatggacctaacctggcagaaactagtagcgtagtaactattaatcaagctacagcaatctattgagattgaaagaaatgagaaccatgaggctctttcaattgttttgaaggactctatacagttcatctcccagtgctgctaaagtgactggtttttggatcagaccgtttattcctgcctgctggcaccgatcccgaacggtgtcatcggtgcttgccgcaagagcaactatcaacggtggccaacaattccccctgaacttcctgattgcaagagctacatcaaatccatccattgtacgcatggtgaggtcaagaaccaccagctggaaagatgactcagcactggcaaaggagttgatgcattggatgccggaagtaaccgagaggactaggcaaccaagcttctccaggagcttgtgagttacggcccgattggtgtcatcactgtccacaagaatgacttggagtccattaaaattgggaattggcgctgatcggaacaagtccgaggatgctccagagaccggagtcacatgctgcagctggaactgaagggcaagcatgatagtttctccaaggccttttgaatcagagactgaccaaatattaccattcatcatctgcagcagaaaaaaagggggctcatatcagaaaaaaagaactctttcagtttattcatcagacaagacattgcaacttgcataatttgatgattaagaaattagacttatcgagaaacaattaatcgcatcttttatagaaaaatctgtcctggttttggcaatctgacagcgtttgtaaacatatatgcacatccttgaattgggaataatagtagcaaagcaagagtagtctggctatgtgatcatgtagcaatgtacatctcgatccattataagtaatacaagatgagaaaaaaaaaacaatcaagcaatgttgatacattttgctttgttgcagacatagaacattaaagagtttatagtatacctgcacaattttcttgcacatgttgaagctaagccccatctcagaactggtagagttgggcccttgaagtctccgactggatgacgaactcaaaagattacctctggactctctaatcctaatctcaaacttaacacacacatagctgccagagaagtttgctcttcgcagcatccaatcctgattgtgcctctcttccttctcattgtaagtattcacatacaaggatagacagcctgcattacacctctgtattagagtacctaccatgtgcaggacgatgtggaaaaccctcttctcatcaccgacgaccctttcgggcaaagaattatccacttcaaactcaaaatcaatccccttgcagccagttaggcatcttacaacactgattgcctccttaaccaacgaatgaaggttgaatgccctcctcaccaaagacaaatactcacgatttacggtt

SEQ ID NO: 53876 - DNA, 1501 bp, Oryza sativa
aagagagatacctgttcgaatactttcgcataaagagaaagagccacaggagcgctatatattcctgcacaaccacaggagcattcttttctccgtttatcatgaggagcactgtcagtaccaagaaagtattgtttactcccacttgttaccgcagacacaattgcttgtcctgagataggcaattcaaaattgtttagcataccaagttctccctaaagcagaaaagtggaatacaaacatatttttggcatgacatatatatacacaatgcaagtacagtgttgtcatagatctactttttcattaccatttaaggaacatctgggtcaaaggtcattttgttgaaccaaagaaatcttaatgtgcatgtacagccaagtttcctctatgttttgcctatacgattgcgtgtaattatagatatgtgaatactagatcatgcaggagttaggggagtaggacaattggaacatactatgagtttctcttttcagtactggtaagcaatagttgtgtggctgcaagccaccctgaaataacgcattcctgttgagaagaagatgttggggagtcaccgttgcagcaacatgacctgatgaaaatgaaattttagaaccatagatatgcacagaagtataatgctattgtagtggtgcacaccttctttgcatgattctacgaagttaaccgcatccatagtggtgatatgttccataacaattttcagctgtggcagtctttgtacaagtggtgccaatattttctcaatgaaaaccttctcacgatcaaaggtatcaacatgctgatctgtgacttctccatgaaccttaaggaaaaaaacaagggcataaggtcaattttactatctatacagctgacaatgcaagaaagtcactaattagaggcaacatcatttcagtgaattaggcattgtcaaggaacaaaggcaagtaaaagtagcattccgaagtaaaagtaggagaaaggatcgagacatgaataagaacttcaaaacaaatgggaaaaatatatgctgaaagaagagcatcagaactatacttacaagcaaaggcatctcctgcctagccatttcctcaagcacaggcaagcacttcccaaatatatcagtgacaccatcttgggagttggtagttgctccagaagggtacaacttcacagcaaaaaccacgccactcttttctaatgtcaatatgaaacaatatgcaacataaacatcacatacaaaactctgcaaccgatagactgggagaggaaataagaaggcaacatttataatacggcacttttaaatcatgatggctagtattttaagaacgtcaagtttgttctagcttctaagagatacaaatgcgactgccaaatcactgcacaagtgtacataagcactgagcgcgacaaatagacacttcaacttacagtagcaatgtagctaatgaaagaacggtgttagtgagagttcgtacttgcgagcttgatc

SEQ ID NO: 53877 - DNA, 1501 bp, Oryza sativa
gcgccacatgatttgatgttgagcaaaagggtcagatttaaaataagttttggcagcggtttatttgtaaaattagtttttgcaaagggtcaaattgttaaaatttgtgtgttttcttcctgtttctcccttttcgggagtaaatgaacgatcagtatggactatgggatgggccatcgttttgtagcacgaagttgtagtacgtccttgacacgtgtagaacttttctcctactgtgttacgaggtagtacaagttagatatgactgtgctgtaactcctggtgagcccaattagaatgtgaaccggttgaagggtgtggacaatgattcccactgttaacatcactccgcgcttaccattgaattttgatttacatcagatatcttcctgataagatagagtattactccattatttggaattgatcatgggcagatgggatcatggcaagagcataactctgttgaccatatgctggtgtattttttacaatttaaccctttacaaaaacttattttaagaataaactgcgccaaaaacttattttaagaataaaccgcgccaaaaacttatttcaaaaataagccgcaacctcagcgccatcagtattggcgctgagttacaacatctcaacgccgcaaatattggtgctgacctccatccgaggtggcatgtattaaccacgtaattagaggtcagcgctatattctttggcgctgacttttgtacaggttaaagaatcaaacctctccatttataactagatggtatgatagctcagttgtggaattgctctaatccgacacagaggggccaaggttcgaacccacggtacagcaccatttttcttgtttcatctattttacattttttccctaccatgctcgaaacttataactaaataatatgaattaatgttatgtatattattattattatcagtaggaagaatttgagaacatattttctcaattttattaaaataaaaataaatttagaaagcatatgacgatatacatgaaatttacaactaggaataactataaatgacaattaaaggtatatagaaatttgagaacattcacaacattcttcttacatattttctgaagttcaaaataatttttgaatgttggaaaaatattataaaattattactctataataattggaaatatctaaaaagttttataatatgtatccttttcatatttgtcaagtccagaataaaatgattttcataagccaaacttatgatcttggtagcaaattaggctagcagattgcaagagaaagtattaaaaaaatgtacatgttgcagagttcaaatccaagatcttcaatcttcagttctgtaaccactacaccagcgatacctataagatataaatcaccgtttcttagttttagccactgtaaaggttagcgctaaagagtatggcgctgacctcttataacgtggctaatatatgccacctcggatggagtcagcgctgaga

SEQ ID NO: 53878 - DNA, 393 bp, Oryza sativa
atgtttgatacagcttcaactcctaaatttagctctaggagttgggtctggagtggagttgtggagctgcctaaacccagctctacaactctagtttattttgtgagagagctccacccagctccactcccagttttagtggagttaaaattgtttagctgagcaacagctctaggaagggtggagctggagctggagctggagctgtgccaaacatgccctgaagcttgagaagtcgagactcgagagacctgccggctttgcttctagtctgaaggctaacctgtagacttgtacagtacctcagttacccgggcccccgaacccccaaacccccgccgtctcccgcttccaaaaccctagctcatcgtcgtccggcggcggggatgccag

SEQ ID NO: 53879 - DNA, 1501 bp, Oryza sativa
actactacgtagaagatttttcttccatgaagtgtgaatgttgttgtccagatatgattggcagatattgctttgaaatttcgcaaagtgataccaaacagtgaaaggaatctaaatttacttattaatattattaatatgttggaccctccactgctactagatagtataacgtataagtagggtcatacttaaaactaggtagagcctataaaagcaacatgctttaatttacaaaataacacgacgtacatcattaccaacggttcatgcaattttgttagagtgtattgaacacctttgttgaataaatgaatggtctaaaatcaattaaaagtggcaattgtggacttatgtagcaaatcaagtgccaaagttatcgaagacaataattacattacagtatgggacatattttcttgaagaaaactagacattaggttactgtgtgacacaagacggagtatgctcaatatatatgctggcaccaatcggacatggatttttattaaaaaagatcacacatttttagtttttaaccccatcgatttttgtttataaaaagtaattattacgctttgaagagtcgcgcgcatgactggtcaaaagcgtcaaatataagttttgagaaggtatgtttttaaagttatcggaaaagctttaaaaataaaaaatatcatacatgctcatgctcctaattaatgtatggcaatagtttcagctatttttttaatataattttgcttggctagttcgcacaaaattatgtacatgcctaatttgtacaattggtgattatgcagatatgcagaaatatagacatggagcatcagagcatgagctttttcacgtacggctcttaaaaaggtattacaaggtacattagttccagaattgatctggatgcggtgttatgcttccacctagggactaccctcgagatgcccgaagagcttcatgcttcttgacccgatgcgatccacgtgccacggctcaaagcgactctagccaaagatgacaagttgcgcgagggggcatgtggttgcccggggcggaacatttactatggggacctggttcttatgtcaccgacaatcttattttctagtgtcaagtgatacattacgctagaaaaacaaggtatcttcctagcccattgactgtaaatgttgcccagagcatctattgtgcttgtatgaaatcaatgtattctatgacttgaaccaggtatggcctataagccaatggcagtatggcacacatttttgaacaatggtgttagatgataagaatagttagctagatagattggttcttatcttcagtttgttgtaactaacagagagataggataagatctctcatcctttgtatgtaccacgctaggggttattcctagcctatataacacgcaggcatacctgtaggaagggtatcgcttccatcacatggtatcagagccttccaccctccaccaatcaatctttcaatctaatctccc

SEQ ID NO: 53880 - DNA, 1501 bp, Oryza sativa
aacccattacagtagcaatagaagatattttcctacgagcaattgcgtacaaagatgttttcctcaattaaattcaatactaaataattggatgaagtataatttaataggtacacgtacacctagctggtaatcatttaattgaggttataaccaagatttctttcgctgagctgagagcgttcctctccagctatcctctaaaagacgtgaaagatcagcatatggtttttctcactagctcgcacgccattgcggcgctactggaagcagagtggcagagcacaagacaaataaaaagggaacccaagaggctgtagtgcaggtagacagaaagccggagaaccggagcccacccaccacgggggcgcagcttgattgggcgattggctgccatgcatgccatcgtccaagccggtgggccaatgcgcacgagattgggccccccatgatgcggaagtgggcagcaacagcgagctagctatggcccatctagcgcaatttggatgttagccctcctagtatctcaacattgcgttggactggaattctggaatcagcagtggctcacactcatttacaggccctttcttgcgttcaaaccaaaatccgagtgatgaacggcaaatctgaaataacgaactgtgaaaaaactagaatattagggaaggacctaatatcaaataattaggaggagtgaggctttaaatccaagtcgtctagcccaccaccttgtggagctagccggaaaacccctgggcatttctcagtaacgaactgtgatatggctggtagtactactagtacttcccatcctgccaagaaaaagttgtactagtactagtcctatgggagcaaaatgcaaggcaatgtttgacctaataatgcatgttcctaaagtttaactagtttaggaatagcgtgaaatgaaatgagcgctgttgaaactagtggcaccagatcaatttggcaaaggcagcagtaaaatgtcaattccatgaaactctattggcggatatgtaattgatgacttttgatcttgtagaaaccgattaacaagcagcaggtcagaatcgagctcagttcagtggtgtcacggtacaccgacgaattagtacgtggtggcttccagtgtgaattgcagttcgtacttcgtatactattcatatgtgaagatgacccatagtgaaacctagatccgcccctgattagcgttgtgggtaactcatataataaagatgttgaactaacacgctcacttgaatctagctagctagttgcagcaaccttcatccccaaaggttgtatgtgtttgcatgcatggatgattagcaacacactgtgccggacggtgccagtctctatcatttgctacgtacttaagttgacattagctagctaggcctgtaggccagatcaaaattcaaatgatgtcactgaatattgtggagtaggccggtacttacgatgataaagtagcatagtcataaaagatttacat

SEQ ID NO: 53881 - DNA, 1501 bp, Oryza sativa
ttgccggtgaggtttgttggcccaatttggtggtttggtctgaatatgcaagtcgaacaaatcaaatcagtataccactactctgatacggccatgtggtgaatagaattatggtaccattgacattgaattcgaatcatatactgtgctgcttagtgccattagcatggtcagtactcagaaagactgttactggcctaagtttgctgatctgaaacttttccggaatgttagcttccaaacttccagtctaaaccaagtctaaattagtagtacactgtcacttgttgatttacattgcacaacaaatagtaaagcctgtttctgaaactcggaaacacggagttgggatgtggctatgtacggtttatgatttgcttgctgttgatttccttttatgtaattaataatgaaattgaaattgcattcagggttgagtttattgataacctggaatcgacattgattggaggtgccttaacgtcctcgacgaaaaaacttgtgatcttcaattgcctgtaattgtatttgaggtgccgcgtcgtcgaggaagagctatgcaatctatattttcttgtgcgcatctattatttctattgtctgtatgtaattgaatttgtgtatcatgtattttagcctgcaaaaaaatctgtgcaatcacgttagtggagtgcgctaaaaatagctaaaagaaaaccaggatagaatctgactcggggcgctaaaaatagaatcctggacaaattagaattggtgtgtatgggcttatagaatttggtgtgtgtgggcttatagaattgtgggcttaatcctggacaaatcagaaccggtagaattctagacaaattagattagatagattagattggaattggtgtgagtatgggcttgtagatggacctagaatactgaaatcagtttgggcttgtattgtacttccatatggaccgaaccaaaacagaatcgggcggatgaatcggatcggatgagtttagcgcgattaatgatggacgaaaatccgtgattactgcgatgtgacgaccggaaaaatccaaatatttatattagttatatatgtgtgcctagattcattaccatctatatgaatgtgggtaatactagaaagttttataacctgaaacggaggtagtagcaatgtaatacactaactctaagtaaaattattttttataaggatctagttggctaattaatttctttgaagctgggcaaaagtgaatctggacgaccctgtccctaaacatgatcattatgccagttgccagcattaatgaaagaccgatggaggaataatttcccgggtagcgacgcgccaacaacggacgggcgacgacggcaccgatcgacccgacgtcgcgcgtggaccactttccccacccctcctcactctagtcacgtgagagcgagattccgactccatggcgccactgccattgcaggtgtttgtgagcccaaaccaaccgaccggcccgatccagca

SEQ ID NO: 53882 - DNA, 1338 bp, Oryza sativa
cttcgcgagctgctggacttgtgagcgcagttctcccatctcgtcgcgtaactctgccaccgtcttctccaccgttggcttccatcccaccaactcagcaaccatgggcttgatttcttctattgatcccaccgaagtctggattgcaacattatgtttttgaatcgcctccatggctgccatgagatctcccaactgctgctccatctcctggaccttgagttgagcacgacagtggtagcgtggcttctcaagatactccagggccgattgctctgataccaattttgtcacaacctctctcaggaatttgaccgagcacttggggaggaagagagatgaacagagggagagagggaagaagcagaggttgttggggattagtttttctattttcaattcgataactagctcgattacagcatagcctttatatacacaggctgaacactcacgccacccactctgcccactgacgcgtggattgggccgcttactcctactgggcctaagcttaacagggttggtaacatttttataaaaacaaagtacttccattttaactactgtaaactattttccttagtataaactccatttacacgtgctaaacatcagtagatagttgatacagaatttcagagacgggtcttggtatgcctggacaattaagctctttagggataacgtggcagctaacacctagtttgtccgaaagctgcattattcggtacaagatgcgctgccgtggcccgtgaccatttcttctacacatcgcaaccaatcctctatattacacacacacgtcctagcagaatctttaaaccgtgtaaccttttccttcatttctgatcccctttttcatcccccatttgcacataaccaatgtattttggtctacgtattttgcatcctagaaaatactgtataagacgagcatcccaactactcccagaaaccaaaacaaggaatcaaatcaaacaaatctgaacagaacaatacatcattctgaaatacgaatcagtttggtcggtttgggtagcttcatggatcacccaaacaaagcttgaccttgccaactcccaacttccaaagtactccacaaaactgcttctgcttaagtattctagttaacccaagattcgtacaccatgtcattagttgtccttaacttgccctagctgcatcatcttcctcctctcctccgccattgccgcttgcttcactcccccgcaactctcctcctacgccactcaacgcatccgaagcccgcgccattacatagctgcgcgcgagctcgccccgatcttggtgcatctcacagcgcggcggacacga

SEQ ID NO: 53883 - DNA, 1501 bp, Oryza sativa
ttatactcattcgatttaagcgggtagaaaaatcaatctacaactcttggattgtttataatggcaatatatactaccagtatagtgtacctgtaaaaagcaccaaattaaaataggagtacataaaccaaaaccaatgctggattaaacataatagaatcaaagtcactggattagccaaaaaaatggcagacaacatcgatcgatcatgtaatgccattttcagttgagaaacataattaattaactggtctagaaaaccctaaaagaaatcaatgatagatatatatttcaattatgagtaacattctacaatatttacctagaaccaattgcaatacacgtacgtatgcgacgtcgcaacttccattttggcaaattaaagggccatatctaattaagggcatagtccgatctgattaagtagatagcgagtaggtggcaagcgccgaatccaatttaatcccctccgtcgggtacaccattttagtgctgatagtgccatgccatgcatgtcccttgtcataggaaataagccatcagcagttttgtactactggcctgcacaaggaagctatatcagtggttttgtagaaacatgtgctttatatcttagtgatcatcaccaaagccagcctccaactacctagctatataaggattttcatactgtaaacttgagtgtaattatgaatgcaaatttcactatatataggagcctcaaaatttgtgtaatttactactggacatcgtagaaatatgtcatagctggattgaaaaaagttagtaatttgctggatgacattttcgacccaattagaaagataaattctataaaaaaaaaggatagtgcccctagagccacaagcttctaacctaacggtacagtggagataaaaaattgtagccgaggggtatttttatctttttgaaaagtctctctttccaattagaccggaaatatcctcttacaaattattattactattcattgttctctagtcataatacgtttttgcgatgtcctctaacaaattacacaaacttcgagcgtcatatagcaacatttatcaattatgaaattaatcctccatctcatactgtaacctctgttaatttgtaggataccggccattggccaagctgatcatgggtgcagggccaggagcattactgaaatctgatggtactctgaatttgtcataatacagaactgtgatctaatgaagcatccatatgcaaatcattcagctagcggtgtgaggccagccaggagatgactgtagtattagtataccgatatgatcgagctggatggatcaacggatgcattcaatggaggccaactgcccttatgccttggcagcattgcagcaagatcgatcatatcgatcacacttcacacaccaccgtccatgcaatgcagcaaacaacacggtaggtgcagcccttcacctgtatatatacactgcaggagcagtgtctcacactcactcaaccc

SEQ ID NO: 53884 - DNA, 169 bp, Oryza sativa
aaatagtcgccatgtatttacattgtaagtccctaaatacatatgtaattttagtgtatttatcatgtaagtttcaaaattacatatgtaagttcaatgtaattataatgtaagtacaatgtaattatgcaacgtctatattttgcattgtagattacatatatttata

SEQ ID NO: 53885 - DNA, 1029 bp, Oryza sativa
actgttcggtctgaacacccattatattagatctctagctagatatcatggaaagtctaaaggcgtagcaattatgctccatcaagtcaaaacaagtgtcaatcgactgcatataaattattgtgattataactgctagctacactgcaacagtgatagtacttgatacacatatagccagtacaagcttgctagttggtagtggctatttactctgatttagttttattatgacatcgtcaaactaagcagggccaaacatatattatggcaacattcaaacagtgcaaggtactgttttatctattttttctattaactttttttgacaaccacagctacagaaatacaaatagatgctgactgggaacctagtgctggtttttctaaccgacacataggcgtcaattatgggagaaataaaaagtgccggttttggaactggcatctttaaggttatgttaacgccaaaatttagtaagattgtttagtggattcggttaaggaatcgtgaagacgtggcatgacggcgtaattctatatattaattaggcatgatttagtagtttccttttatctttagaaaagtgtgtttagtgtccgataagaactttatatttttccctttaatctttaggaaaatttatttcttgtttaagaatgactcgtatctacccatgggtataagtttgtgcacccggggtcattgtaaactatctccgatcaataaaaatactctcggcgtatcgccaccatctttttcgaggtttttacttatcatccggtgaaacttggcacctgacacggggctgcatcagctttcgatcttcggtgaaggggtaagtcctactgtttgccggcccagacagttgtatcggctacattggtgttgttcaaggcttcatcgcttcgatctcttgcatcgctctggtttggttagtatatttgcctatctatttatcatatatcttagttaatctagtttgatagctcgattaactgtataggctgggatgtgctttagggttt

SEQ ID NO: 53886 - DNA, 339 bp, Oryza sativa
actgttcggtctgaacacccattatattagatctctagctagatatcatggaaagtctaaaggcgtagcaattatgctccatcaagtcaaaacaagtgtcaatcgactgcatataaattattgtgattataactgctagctacactgcaacagtgatagtacttgatacacatatagccagtacaagcttgctagttggtagtggctatttactctgatttagttttattatgacatcgtcaaactaagcagggccaaacatatattatggcaacattcaaacagtgcaaggtactgttttatctattttttctattaactttttttgacaaccacagc

SEQ ID NO: 53887 - DNA, 417 bp, Oryza sativa
cctttccccctcctgggaaaatgatttttttgccagctaggaaaacgatttttctagtagtgattgtgcattactggagaacagatctttgctgggtcagcctaaaaccacattagtcccaatttcaataggattcgggattaaaaatcatttttttccggttaaagagccgcacgcacttttatggactaaagatcatttttagtctcggtttagaaatcgtccggccccttactatctttagtcccagttgttattaccaactggaactaaaattcaacgcatattatataatcccttgctcgtattttctcctcctcgcgcgcaaacacttcctcctccctttcctcctctctccactctctttttcctccctcttatccttttctttttctctattaacctctattttgcaga

SEQ ID NO: 53888 - DNA, 583 bp, Oryza sativa
ttcctgcagcccgcaatggcgagctgatcaaacaactgtacacacaaacacttagccactacgtgagctcgaatggagagcacgagagaccgtgtcgagaggaggagatacgtgggggggttttagtagtggttggtgggagcgcgcggtgacggcgacgtctcaccggacgcgcgcgcgctcttctctcctctctcgccatcgacgtccttgtcgtcgtcagcaacgctccatcctcgcccaatctcactacatctgtatccatccatctatctatatatctatctgaatctgatttacctcaaattctccattgtttattaattaatttgttcttctccgagtgacggagtgagtgaatatgtttatttgtgtttaccgggtcaagaagagagagcgactaccatggatgcaacggataaatttcggaaagaaccgttgcaacacttgggagaaaacaattgtttacaaaagttcataacaatctttgataccagtcttgtttatttcgtctctctgttgcttataaaagaagtttctttagtgatgaggacatcactccattggatatacacaacaatcc

SEQ ID NO: 53889 - DNA, 437 bp, Oryza sativa
aaaatcagtcaagggcttgattgtctagatattatgtttcttttcatacttagtgctgcatcagttaagtttgatctactaagtcgtgcttagaaccataatctctagtcttcttcttggttgccaataagggtttcatcagggtttcagccggtaagttatcaggacgttgcatcggtttataaggataacatgcaagttggatttagccaatggcaacaaaggtttcactgtttatctaatcatttagattttatgacatcggatctccagccgatgtatgctttaaccatcggattagtgtttattctattatattgttagccgattggtttctactagattattctattgttatcatcagcggattgtcttcatatcattatttacatcgtgtcagactctacattaaacatttagccaatagctcaaatcct

SEQ ID NO: 53890 - DNA, 212 bp, Oryza sativa
tcctgcagcccaaatttttataacttttactttcaataagttgaaaaatatgttagtttaatgcatagaccatcatatacagatttgtattgtaaagtactaagtaaaagtaaaagtaaaaatgtatttattgattgtatatattataatagaaaaacttagttaaagatatattttgaagatcgtgtcattgtaaaaaatatcaggaatta

SEQ ID NO: 53891 - DNA, 692 bp, Oryza sativa
ccaatgccttatgtgcaagttctccgcggtaaattctctttgatgtagtacaagcacaccgaagaaacgatccttcggctctgcctgtgctttccacaacatagggaagttttcatccatttttgatccatataattgcaaaaggtgatttgctattaaactacttgaggttgataacttacagaatagttattccctaatcaagtatttcatagcaatggacccaactctaatggagtcaaagagtctgagaaggcctatcgaggatacttggaccatcattaaagtacttttgaacaatgtggtctcagaaggaaggctaaatttgtattcattcaaatcatttttaagttcgtcatttcttaattagtatatgcgtagcaatgtttgttttgaaatttgttgcatcagacttgaattttgttatttatctttgacttcagactgagttgaggaatgctggccccaaacaatcattcattgttagcaatgagtcatctacaagccattccataaatattagatacgcaaacaatcctagtaacaaaaattgttggatatgccaacaatctttttaaccaaaattgttagatacacaaacgatccatttaactaaaaatgttagatacacaaataattttcatactaaaatgttagacacacaaagtggtatgcagaaaagcacaacaata

SEQ ID NO: 53892 - DNA, 258 bp, Oryza sativa
tgctccaaagtatatacggcaaaatcgactaccggtacatctcatctcaggaggcacttcacaagcaagtgcctcaagaaaaagggctcactgaggaccttgctaagctcaccagtacaaagaaggccggtaaaattcgttagtgatatatgcgacttaaatatattaattgcagtttcaaatttaagtaaggcaagggtatggtatgctcgaattgtactgtcggtgctaatatctgtattttttttatttttaagg

SEQ ID NO: 53893 - DNA, 215 bp, Oryza sativa
ctaaaagcaactatataaaattaatgcagagctgctgatatgttaaaaactagggaatttcttttgatcactttaaaaggcatatggaaatatgctggacactatttttaatgatcatatatttgaccaatgcttggtccaaatttaacgttctaaataagctctgatgagtttgagctacctaccttactcatgctaccttctttccctgcaga

SEQ ID NO: 53894 - DNA, 376 bp, Oryza sativa
tatcatctaatccacttaatttgctattacatcatgatcctgctaaataatctgttacatgcaccccccttggttgtttttctgtacatggacctgaaatcttgccctatgttcatatgttggattcaaggttgcagcagactatgtttgtctttgatcataaaaatgtaaatagtggtaattcccctgtctggagaaaagagactgctgatcttatcagttctaaatgtgtaacagcatttagtagaagctttagttttatttttctcaaatggaatcttaggggttaagcagacattgtttaaagctcaggggggttatctggactttcgccttaactctactttagttggtgcctatgttgttatcctatctt

SEQ ID NO: 53895 - DNA, 1501 bp, Oryza sativa
agagttttctataattagcctatgaaacataaattatattttttttaaaaaattaatacatgcaaattgaaaaatccacacacacttcatgtgatgtatggagactatgtaaaaattttatatattttttatacttctagtaggtaaattaattgtcaaccctctatatcttgaagggcgttttaggcattttaaaaaaagtatgcaccctaatgacatattgtagaaaaaaatgacaaagtcggcgatatatctattatatactaaaagtctattaaactctctacaaacgctcctaaaccaccatgtgtcatcctataaacgctctcgagttaccacgtggcactctaataaaatatagaatatcataaaaaatctaataaacatctagccattgattttctgttaaatcggtggacccatatattttaaccattaaaaatccggtagccctcatccccatcgtgcatatatgcggcatgtgcaggtacgtgctatacctccctccctccggcctctctctttctctcctcttttctcggtgactactcctattttttagctaacacctatatctatcttcagattttctagattttctaaaatatgaaatatgactatcaaaaatagatggagggagtaatacggatgcccacgcattgcgtgggccacctttctagttatagaaatagataaaatcaatgacaaatcgttgagctagagtaaactcacgggcatataatatattctctcttgaatatattgttttcgctagtaagataggtcgtgtgctagggcgatagggagatgaggcgaggtgggggtagatcgtccgggttgcgacaactgtggtgacaagtagctagagtgggccatgtcatggttgcagtaaatcaaaagagatgaaaagaggagggggctaggttaggactacaaactaacgcataaatctcgaatattcccaattgtaaaaaaaaaaaccctaagattttgaaaataaaaaccaggcgactgataatacaatactttctagaaagcttcctggtgcgcgcaaataaaatccaaaatgcatggccattataagtgcaaacaaggaacgacatggctccctatattatatctcggccatcaagctcggatccaatggctctgatccagtttctacacctgttcatcaaaatactatcatgtatacttgatcacaatcctccacaaacaactgcagatccaaccaaacagcaactccaaaccagaagctcccaccactgaatagaaaacccttaacaagaaaagctcccttagcccttttcttttcccttaggcaaccatgtccatgcatcccccaccattattacctccctttaaatacccctcccctccctcccttctcttcctcgtgccaaaaccccaaccaaaccaaccaccaaatcatcccacacaaacaccacaagctcatcgatccctctctcaattattattcgagacaagatcaattaattgc

SEQ ID NO: 53896 - DNA, 1501 bp, Oryza sativa
tgagaaacacatatgcatatttttttaaaaaaaaagactaagcaattaagagatcgttgatgttaagttttatcaagtctcgaaatttagtcaaatactctattcatggttctaaatgcccctgtttgcaggtagctagcccaaaatacaggcagtgacgtttattttcttgattgcccttgaggtcgacgcctatgtctccttttcctctttggcgaccgatgtgcacacacggtgcaggcgcacttgttgcgtttgcttttgtttagttacctttattagctgacgagcctagctatttcgatccatatatacatcttcacgcgcgtgtgtgtgcaggagtcttgtttgtcaatcattgttaagcctaaaagcgcagacgacacatgtaatgccggctgcgattgtgccgctagctattgagcggagtacatattttttaagataatggaataaaaatcacagcctctacatcatgtgatgcacacagccgaactatcgagctacatgtgtgtgtatatgtgctcctctgatcatcaaagatggaaacactgaaagaggagtagctatctatctagctttctttcctccttcctccttttggtagtgaagggctttggaccatgtcagtatacatagctagatactggtccctgcagccgtgcgggctccctaaaccgtgggcaaaatgcaagattcgaatataatgtgctactaacacgtataaaagtgaatttattttggaacgggcagagtactgctgagctataacgctgatcatgcatgtatttttgatttcccaatctttcaaatttgtattcagttgcatggagcatatggatcactcactttagccaaaaagtttaaattgacaagaaaataataataattcacttatactttcatagaatatactggcataactctatccatgatataagctacgaccaacttaaaattttaaataatttaattggggttcctttcatcaaatccgtcactcaatttgtacatgtcgcccaccacctctcatcatcctctcacacctttatctgacatatatccataaaggtttagaaatataaataaatgcaagaaaacatttctcatgacaaaactattggtgtttattttcccacatgaaattataatgctagtttctaaacaacgcgttaaatacgagtaacctttttgcgcatatcgaaagtaaattatcaagatcgagcaacaaaataaaggttcaggacaggcccatggtggcaccccctttgttccctataaggtcgatcggtcgatcggtcagccggtcaagccaaccttgatcgatcttgtattgccatcctacactgcaaagcacgccattggagagagatcgatagatatagatggagaccccagtgatcgagatgggccgggagagaaaaggaattaggaaggatggatggatgagggtgtggtttggaagccgccacttggtggagcagctttagttttgctgcta

SEQ ID NO: 53897 - DNA, 1501 bp, Oryza sativa
cagtcaagtagcagctacagggcacatcattgttcataaacatatgtatgatcagagtctgattcaaaaaaaaaaacagagaagaaaatctagcttaattatatcactttcagatgtagctagccaacacaatattgagcatatttttagacatttaaatccatgctttgatgaaggagctacagtcaatatagtaattgttaaaaaatctgctcatgatgagcacgcaccaacaagtctataatagcacacaaaacattaggaagcgatgcacactagaaatgtctagaccctacaattattgaagcttaattatgaatcttcattcgtttcattcgtagttggtgaacatccgcataaacattgtttctaggttacggcgtacagtcaacataagtttgttgtcctcgtcacatctttgttgctgtgctcaaatattaagcgtaaagctaggtgtattgggttatcatgcaaattaattgccactgaaaccaatactgttacagcatgtggacatgatactgcacttaatttgtgcttggcttaaaacttaaattaattatctcagcagtaccctagcagcttaactaatttactcaatcacttgctaataatcacactgcgtgttagggagggaaacggttgagactgagatatctcaagttacagatcaagaggagcatcgatcatgtacgtatatctgaacaattaatcttcttttcgggtgcatgcgcatgatctatttgtgcaggaatataccaagaattaatcgatccacccatagattcagtccgggtcgaatcaggggagatctagagagagagagatgagagaaaaagaaggaatccagatcatgagatgtgcaggttccatcgaacagaaaagagtgagctttcactaaatgatttataagattctgtgatgtttgacaacgtactcgtaccaccagatcgaccaaaaggttgtaatatatagatcaacgatgttctagcacaatacgtagatcgaattaaagccaaagcagatcaggccccttaaaattgtggccaaggcaagaagaaaccaatttactagcacacagcagaaaaaaatctttgatgacaacgaaatgctacgtggaatggacctgatcttgcatgaaacgtattgtacagtatgattataaggttaattaaatcatggcagatatatatgtctagctacttaattactctgtgaacaaaatcatatatatcagccaaatattccaatcaaatcattgagcctcccatgtatagacgtacatatatacatagcttctttttttcatgacttgaattctattaattcatcaatcatatttgcacacaagcttgatcaatcaacataaacaagctaggcaagattgcacagtactagcagctactacctaggctaatacagtactagtatataataagtactattaattctagatttattaatatagtgcatatacatatatgcatggattctaagcatg

SEQ ID NO: 53898 - DNA, 1501 bp, Oryza sativa; identical to SEQ ID NO: 21836

SEQ ID NO: 53899 - DNA, 1501 bp, Oryza sativa
ccctcggattcgtttggaaacctctcccctaacctcgccggcgccattaatggcggccgggtctcccgcgcccatttccccctcctccggccgccctctctcactcccaaccctatataaaccctccccgcacctcctccgtccgtttccgcctctcgccgccctctctccccgccggaatcgagctcgcgccgtcgctctctctctccgccgtcaccgccgagctccggtccgccgccgtcgtcgccccggaccatctcccacctcggcgccgcctccttcggcttcaccgcatcctcgccgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgccgcctcccgtcgctgcgccggcgtggccgccttcgggcgcaccgagcggctgccgcgtggggcccggctgtcagccgcccgcgccctcgggtgcggctgacgcgtgggaccaacggcgccggccggtgtgagcccgggtgcgcccggtccaccgtggaccgtggggctgccgcgtgggccccactcccgtggacccggtccgcgcgcccctcccctcggctgacgcaataaaccttttttttaattaaaatttaaatgaagaaattcgcaaatattcatttaaagagcatataaacttcaaatggccataacttggccatttgaactcggaattggaccgttcaagtctctaatttttccttaataagtcaagaacccatttttgtgctttgttcctgcttgttatatggagtttattagagtaaaagccttttctttttttcgttggtcgtgtagacgccgcagcttcggaagatccgctcttcgtggaagttgaagccgacgtttgggaaagcgagcaaggcaagtcacatcatccttgaacatattaaatcccagtttataaaattattttgatttaaattattgcattatcgctttatttaaattcccgcgttatcactgttttatctagccatgcctatttacctttgttatgaccttattatttttattgttattatttccttgttcaccctagaataaacaaaaccccaactagtagacactctactcatggtaccactagtataattttaggtagatgcttcgctaattaattaggtaacattaggtggttttacaactctagactttgggagattcatatcacctggacactatggaatggtttgattattgtggaattggattcacacctcaccctctattcaaaatctccaaaatggttttaggctgggctcggggtgcatggttttgatagtagcacctcggccatataaggaccggt

SEQ ID NO: 53900 - DNA, 1501 bp, Oryza sativa
ctcgacttcattgaaggattgccgcactcgtcgggatttgattgcattatggtagtggtggacaagttttcaaaatatgcccattttgtggctttggctcatcccttctcggcgtttgatgtggctcaagcttatctcaccaatatctataagctccatggctttcctcaatcactgatttctgatcgtgatcgcatctttacaagcacactctagacttctctgtttaaattggcggacacccagcttcggatgagttcggcttatcacccacagaccgacggccaaaccgagtgggttaatcagtgcttggaaacctttttgaggtgttttgtccatgcctgtcctaagaagtggtatcaatggctggcgcttgcgaagttttggtacaatacttctctttactcagctctggggacaacaccctttgaggtactttatgggcatcctcctcggcactttggtattgtggatattgcagcttgtgctgttccagatttgcaagcatggttctaggaccgtggggtggtccttactctgttgtgtcaacatctgcatcgcgctcaacaacgtatgaaggttcaagcggataagaagcggtccgagcgccaatttgctgtgagcgattgggtgtttttgaaggctcaaccttatgttcaatcattgtgtttttgaagattgggatcgcctgaaggagcgtgtcacgaccggaattgacccaacgggcgttccttacgtgcgtgtattattccttgtcccaggaggcaaggtacaccaaaagttgatacatttcagagtttatcaagcggaagcgtaaatagttaattcattacatgggcagcgaaggcccagcacacacaaagacaaacgagaaacagcggaagactagggcgacgaccacaggcgcttgacagcaggcacgagctagacaccaaagccttcatcttccagggactcctcttctgggtttggaaaaattgagcaagactgagtacaaccaccgtactcaacaagacacacccacaagtgcaggataaatgtaaaggagtacaaggggggttatgatataaagggttagggtttgcagtaacagcattaaaagacacttagttgctcaaagctattttgtaaacacgtttccagagctatacaatattattaatcaaggccgtgaacccacacgagcctgccttaacccaaggcctctgatgattcagaccgaactagcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgtcacataccaccacggtatacggacggaagacatgacatagtttccaacccatcctagc

SEQ ID NO: 53901 - DNA, 1501 bp, Oryza sativa
gtggttgcgttgactcagtcggagactcggagtaacgtagtggggaaagaacccccaaatatcgattattcactttgtttagttgatcaccttcataaacaaaaacttaatgtaatgagtttttacaatcgacgggagggatgtacagtactgcatctctctggatatttcttggtgtccgtgctgttgtaacgtggcctgtcagctctgttgcacaaatttgtccaaatcgtcaattgtacagtactactttatatgtacggatagcgtacaatacttccaatagggagttctttttaccccattgtttcttcaagtttcactgaccatagatcaacttttactagatagtttaaattgtgtatgagtttttgttttttttaaatatattttgaatcaaatggaccagctcctggtggcataacaaagattgtggtgtttgaacttgaaatttcagccaggtccaagaatcataccatctgatatcctgatgagctcttttcatctgctgctgattaatgtaggagaagatattttttgtaatgatcatttggatacttcattgattttcatgtgttggtcaaatgtccttctcagtgtcgctattgctattaaatgtcacccttgtgtatttcattagacttcaataaaaaaatgaaggtggtttttatgttttcacttttccactcattagtttattataggattgttataggacttcaagcattttgcttctactgctctcacgcacacaatgtaattctatcctatctctaagcattgttcttctgcactcacaccaaccgtgtcttatgcatacttgaagcagagacaatgaccctctctttggaattgggttttttgctggcaaagttggattgaattcttcgcttgccacggttggcaggctgttatttcctggcaacattcatatgtcccaaaatccagaataacagtctgttggtaatttgtaatgcaaataataccaaggaagaaggaatagaatttgcccccctttttttagataataggaatcccgcatggttggagtgattatatacacctgttggaatttgtgaaggagtgaaatgtagccctttttgtcagcactaggtagtccatccaggtcttcaggaggtgttctgttgcatcaaagaagatgttgaacttagacagaaggtcctaactctcctaaaagttagtttctttggtttgtcatgtttgctccagttgttgatttccttctggtagtaaattcttttttccctgaacctatcctggacatcctccataaatttccagagcccctctattagtgtttttttaggaaaaaaaggaaaaagaacgtgtcatctctaatttgttcttcttcatgcatatggagacaactatttagggtattgacactgcaactaaagctggacttctaattattcttgacatgctggacttctaattattcttgacatctatcttattctaccgtgatatgctgttgaat

SEQ ID NO: 53902 - DNA, 1501 bp, Oryza sativa
gctctgaaggagcattcttgttcagcatggctatttcctccgtattctcctttagagacattaacctttcattaatgtgagggtttcattatatgaaaccaaagctgacataaaagctaagttgagcaatcagattttttttaaagaaaattagggcaaatattagaacctttagtgttatttatctttctctaccttcatatccttaaaaaactaagttgaggaacataggttttaaatgattttcggaggtttgcaatcctttggaattgtttcttatgagcttgtttggaagaaaggaataggtttgttggattccttcggaaaagtagcaatttctccattcataggaaataaaacatctactttgatccgaaggaaaatatcctttgcttcatgcttgcataaggggacgtgatttaaactgcctaaattgcatcttcccgtcttttgaattccttagttttcaactttacactatatcatattcatgtattttcattctcggatttaataattgtgggtcttttattttgtgttgttgcttattagtttgtgtttgttttatgttaacttggtgtgtttttggtctcattacatcgtgaatgcttttgatgatttgatataacaattggttgtagcttgttgagaaaaacaagaaatatatattccattcttaaaaaaaatgtgttttttgttatcatgttttcatttcttttttcaaacatgacctaaaaactgtttttttttcttggccctactctaatttggtggtgcgctggtgcccttcacatttttttcaagctgagaaatcaattttcaaacacaagcactgttgaaggtgtccacatgaagaattgccacggcccacgtgcatagaaccactgcacctagtagtagtactagaaggtaaagtaccactccatacttctagaagcgaagttccaattccaagaggaaaagaaaaaaagcttactccttctagaagcctatgataagatggacggcatcacggcaacgtcaatatatccatccatccccacacaaatcccccaaaatacaaggacctccaaaaaaaaaacaaaaaaggcctccaacaatacagaaatctactacctcatttttttaaatagataacaccgttaacgatttatcacatatttgatcatttatcttatttaaaaaatttacataatcataacttattttgctgtgtgttattttatcacttaaaaagtacttaaaccatgatttatattttatatattgatacaaaacttttaaataagacggaatagtcagacaagtgttcaaaagtcgacatcgttatcgtttactgtacggtacaccaggggtataccgtatacggtacactatatactccagtgtttacatacgtcacacacgtataaatacaccccccccccccccccaacacggatatactaccccactagctggaaggcgccatttttatagtagtagcccacacacacacacc

SEQ ID NO: 53903 - DNA, 1501 bp, Oryza sativa
gaataagatagatgtcaagaataattagaagtccagcatgtcaagaataattagaagtccagctttagttgcagtgtcaataccctaaatagttgtctccatatgcatgaagaagaacaaattagagatgacacgttctttttcctttttttcctaaaaaaacactaatagaggggctctggaaatttatggaggatgtccaggataggttcagggaaaaaagaatttactaccagaaggaaatcaacaactggagcaaacatgacaaaccaaagaaactaacttttaggagagttaggaccttctgtctaagttcaacatcttctttgatgcaacagaacacctcctgaagacctggatggactacctagtgctgacaaaaagggctacatttcactccttcacaaattccaacaggtgtatataatcactccaaccatgcgggattcctattatctaaaaaaaggggggcaaattctattccttcttccttggtattatttgcattacaaattaccaacagactgttattctggattttgggacatatgaatgttgccaggaaataacagcctgccaaccgtggcaagcgaagaattcaatccaactttgccagcaaaaaacccaattccaaagagagggtcattgtctctgcttcaagtatgcataagacacggttggtgtgagtgcagaagaacaatgcttagagataggatagaattacattgtgtgcgtgagagcagtagaagcaaaatgcttgaagtcctataacaatcctataataaactaatgagtggaaaagtgaaaacataaaaaccaccttcatttttttattgaagtctaatgaaatacacaagggtgacatttaatagcaatagcgacactgagaaggacatttgaccaacacatgaaaatcaatgaagtatccaaatgatcattacaaaaaatatcttctcctacattaatcagcagcagatgaaaagagctcatcaggatatcagatggtatgattcttggacctggctgaaatttcaagttcaaacaccacaatctttgttatgccaccaggagctggtccatttgattcaaaatatatttaaaaaaaacaaaaactcatacacaatttaaactatctagtaaaagttgatctatggtcagtgaaacttgaagaaacaatggggtaaaaagaactccctattggaagtattgtacgctatccgtacatataaagtagtactgtacaattgacgatttggacaaatttgtgcaacagagctgacaggccacgttacaacagcacggacaccaagaaatatccagagagatgcagtactgtacatccctcccgtcgattgtaaaaactcattacattaagtttttgtttatgaaggtgatcaactaaacaaagtgaataatcgatatttgggggttctttccccactacgttactccgagtctccgactgagtcaacgcaaccaccgcccaattgatcaaagatca

SEQ ID NO: 53904 - DNA, 173 bp, Oryza sativa
actctctaaggttatgtttatttagacgcagtgtcagccaattgaagacactcactgtcatagtgcttacacatcgaaagccatttataatttcactcactccataaaaatcagtactacattttgttggactttatatcggataaataattaatctgcctgacattcacaga

SEQ ID NO: 53905 - DNA, 1501 bp, Oryza sativa; identical to SEQ ID NO: 24217

SEQ ID NO: 53906 - DNA, 1501 bp, Oryza sativa
aatggctcatatttgttagattttcgggctgcaatgggctgagagcaaatgcttatggaggaaaatttggcccaacaaatactagacttacttttttttaagaggaaagtactccctctgttgcaaaatgtttgacaccgttgactttttagcacatgtttgaccgttcgttttattcgaaaaaatttgtgaaatatgtaaaactatatgtgcacatgaaagtatatttaacaatgaatcaaatgatatgaaaagaataaataattacttaaaattttttgaataaaacaaattgtcaaacacgtactaaaaagtcaacggtgtcaaatattttgaaacagagggagtactagacttactagtactgttttttaccactatttctgaacaccgtttggcgcatccaaccattatcataatttcaatttatggcagtaaagacataaacatcttgcctcttcttgatcatattagaatatgagaaagttgagagtttaactcatgaacctatgaacctatgtctcgaatcttaactcatgaaccatcattgtcgacaggtgatgcccgtagaccggatatagagggtattggggtactttggtacaaggatctacgtagtacgacatcaagcgaacaaaagacaagaattatactggttcaggccccttgataggtaatagccctaatccagttgatgtgggattatatggtagaaaacacaggttacaaagggaacaatgaacttgtcgaatccggcgaaatcgtagtcgagttgattcgactagatctcgatggcttggctccttgcaggctccggcttcgtaggttatgtgggttgtgtcggctctgagattcgatcctttaagccctcaccaggggtcccttttatatcacagatctggaggtctccaagtagaactcggagatatcagaccctattcgatacgtcaacgacccaatcttgtccgagtaggattcttcccatccgtagattccgtgaagtatttccatagaatatataggaagtatctgtatgcgcgtgggtataccataccgatatgtaacatatatcgaagggtaaagggtatgcctaacccgtaaccctgacagtagcccccgacttctgcttaaaatgggctcgtgtaaccattcacgacttcgggtgtcgagattgttgtcgttcccggtgcgaggatcgcggagacaggccgtagtcgagcacgccattcaaagcccaacggtcacgagcgaattttaaactgaagtccagaaaaccgccgcgcgtaacggacccagaaatttccggcgggcatctctctctgtccttggaattcgcaccgtcggtagtgcgcctatttaaaggaattttggagatccattttgaagtccgccaaccgtgttgaaaacattccacctgtaagcgctcttcgccttcttcgccgtcacaagaaaccctagttcatcaacctaggccctttctccggcgatcttgaatcagcaa

SEQ ID NO: 53907 - DNA, 636 bp, Oryza sativa
atccatatcatggataacgacaatatcatttaccgttaaagaaaaaatgacaataccatttaacatatactggtataattagctactttctttacatagataatactcgtcgtttggaattggctaatgtcaaactttggcctagattagctcccaactttttcttcaaacttccaactttttcatcacatcaaaacttttctacacacataaacttcgaacttttccatcatatcgttccaattttaatcaaacttccaatttaatttggcgtgaaataaacacacccttttaaactttttaactataaatattttaaaattatttgttttaaaatatgaagactatatgtatatattagtcttaaaaagtacatcaatgaaattatattattacaatatttctatttatattatgatggaggaaagtggtcaaaattgtttttcgagaccgtttacttatctaaaacaataagtattatgaacttggtgggtgtgagcttattttcttatatagctcttgttcaagttcagaaatcttttttaaaagaaaatatagtgggtaaaaaaaatgatgattgtcagggttacgggttaggcataccctttacccttcgatatatgttacatatcagta

SEQ ID NO: 53908 - DNA, 244 bp, Oryza sativa
ctccgttgagcgacaaaccataggaagtagcgacactgagaggggcaaaaaagcgccagattggtaggtgctaaaatgagatcctgcctgggaagagggcaaggtaagccgaccgggtagagtacgaccccgaactctcccacctctagatgaaagaatcaggatggtcctttgagagagttgttgtctgcaacaacgaccaatctgcaagtattgcagcattgcctggactcccaaggagcca

SEQ ID NO: 53909 - DNA, 378 bp, Oryza sativa
tttgaccggatacgaatgaaaaaactaatttcataactcgcctggaaaccgcgagacgaatcttctgagcctaattaatctgtcattagcacatgtgggttactgtagcatcattcgtagtattttgaatatctatttaactattcgtcttattaaaaaatacgtaattcatatttattttgttctaagttgttttatcactaaaatagtactttaagcatcttatgcaattgcataatttttttaataaaacaaatgatcaatatgtgtctaaaagtcaatgacatcatctattaaaaaaccagagatagttaataactacttagtagataatttgtatgtatagaacccgataatattaacttctgttgtgtgtgg

SEQ ID NO: 53910 - DNA, 183 bp, Oryza sativa
tcataaacttattggattttataaacttatcctaatataaaattggttgctggaattttaaaaggttgaccaaatctttgtgctaagtgtcaaacatttatgaccagagggagtaatttgtaggggtgtttatggatctaacctttggaacaatgtgttggactaatgttattaacttatgtc

SEQ ID NO: 53911 - DNA, 1501 bp, Oryza sativa
aaataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcactaggtgcttcttggattatcttaccgcccgatttaattggacactagttgatttatccgtatgttaaattttaaatttgtttcttatacgcatttcggtattgagttttgcattgtttgtttgatgaacagatcacagttgcga

SEQ ID NO: 53912 - DNA, 1174 bp, Oryza sativa
ccacatgtcagcctgaagtaccgcacatgctctgcaggggatctcaattgagcagatgatattgatctcttaggtctaaatttcataagtaaactatttataaggtattgtttgagttgttgataaaacctaactaacaagctttaatacgtagagaaaaagaagattcctacaacattgtactccctccgtccctaatataaggattttaactttttgcctgtactgtttgaccattcgtcttatttaaaaaaatttagaattattatttattttatttgtgacttactttattatccaaagtattttaagtataacttttcgtttttatatttgcacaattttttttaaataagacgagtggttgaacagtgcacacaaaatatcaaaatcccttatattatgggatggagggagtactgtcttaaccaaattcctcatgttatttcccatcttcgtctactgtggaggagctctaactcattactcatccgttataattatcattttctttaggacaaaactcggtttagtatgtaacatttgatatactacccggtcgaaccgtaccaagctttcttgtaacatatatgatggtgttggagatctctagccaatcttatgccacatcgcatatatttcttttaactatgtatgtgccctaaataaacttagacatttattcgagccctagttttaaagacaaattctatctacccaaattgtaccgattctacccagcacacatgctaaaggaattttgcaaaattatgtatgctcgtgtggctgatctctcctctctactacacatccattgtataaaaacgagatttgaagggagagatacccctctaaacttttttttgtaaaatgaattgataaacatgtcaaaaattaaacacgagattttaaaatggaaaccacacgctctttacaactgcaccgtgaagtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccaga

SEQ ID NO: 53913 - DNA, 1450 bp, Oryza sativa
aggagagagagagtgaaagagagggtgtctctcgtgggagaaggcggcgcggttggtttatttgtgtttttttttaaaaatatatgatctaattcgttggctaatttgattgtttttggtttatattttaaatatacgtgtttgtgaattgtggttgaatatatatatatatatatatatatatatatatatatatatatatatatatatatatatatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagtcaaagatttgaaggtttgactttactctgcttcaaaatgataagtattaccagttcgaatggagtatagtacattgtttctccttaaaaaatctacatcatgttatccgcgtcacattactaaaatcataaagagatgtgacacttcataatactacgaatctagactaagagacggttcagattcgtaatactagaaaatatattcctccagaatcgcttatattatgggacggacgtaacatatagaagttgatttagaatattaaaactcaactaatcaatcacatggtaatgactttttcttttgtttttggtggcttaacttcatctcaaccaaatctaaattcgacctgctatatctgctcatccagttagatctcgaccgtcgaatctgcacgatccacgatatcaaattcgcgatatatatatttttttaaaaaatacaaaattccaagaacacaagttgccaatatgccctgacaaagacaacaaaaaaaagaacagaagaaaaaaaaaattaccaagacaaaattcccctatctattgactaacccaaacccaaagcacataagcatgtgattagcaaaagacgccgtactctctctctcatcaaactgctgacgtacgcacgccgtgagacgccgccgcagcaaaagcttccc

SEQ ID NO: 53914 - DNA, 533 bp, Oryza sativa
tcctatggaatgtctcaatccatataagttttggaggaatttgaaaatgaggttcaacctcatggaaatttttatttgtctttatctctcctcgaagttcatgcatctttcacgtggtctaaccaaacggtcgttccttatttttcctatgtgttttgtagttctctattttacacttttattcctattaaaatattgtgttttctatttctccattttcctaatcccgtgtttcaaagaagccttaattattgcctgctgaactaacttgatatatctcataatattttcttcctcaatctcttgtttacttcaagagtagacaacaattagctagcagtagatgcctagcatgacaacaagttaaaatatgatgcatgcatgcatgacaacaagtaacagctgtgcatgcaaaaccttttttgtgaagcaggggcagtgcgagtggaagcaagcaaggatatactatgctcatatgctagcataaaaaaagaagcttgagactttgatcgatcgatacggtggtgtgcagt

SEQ ID NO: 53915 - DNA, 297 bp, Oryza sativa
gtcaagagtcagtgtgttcatgagctaaatgagagtcacttttatgtgaatctcccatcagcaactgagattaagttccaaatcttgctgggatgaaagtgcgccgtcattactctattttgatgaatcggtgaagtttcagttttcaaagtgagggcttttgtaagcaagagaagtgttggttatttttcaaggacaatagtccaattgttcctagtcaggagaaagtaagactactccatgtaaggggggtaggtctcgaagatgagttttggctcacttcgtcgctgttttagt

SEQ ID NO: 53916 - DNA, 247 bp, Oryza sativa
caaaaactgatgagtagttgtattagtatgtgctttctgttgaaatgaaaaatgtataaggggaattagtttgagttcttttcagcaataatgacaattttcttattttccgttatcatactttccaaatagttaaacattgtgttttgtgaaaaaaaaatatttacatattttttaaaaaaaatcaaagaactctactttttaagtttataatggctaataatcatgctctaatggttgttctagt

SEQ ID NO: 53917 - DNA, 501 bp, Oryza sativa
  unsure (1)..(501): unsure at all n locations
atatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagttcataaaaactaaacaaacatgtagagctcaattttagatgaattttgcaagttgaataggctcaattttcagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgnagc

SEQ ID NO: 53918 - DNA, 325 bp, Oryza sativa
gatcggatgtcggaaaatgttttcagacacgaatgaaaaaactaatttcataacttgtctagaaaccgcgagacaaatttattaagcctaattaatccaccagtagcacacgtgagttactgtaacacttatggctaatcatgactaattaggtttaaaagattcgtctcgtgatttccatgcaaactgtgcaattagttttcgttttatctatagttaatgctacatgtatgtgtccaaagattcaatgtgatattttttgaaaaaaaaggggaactaaacaaggccttacttagcttcccaaggtaagcagcttgtgcgctac

SEQ ID NO: 53919 - DNA, 232 bp, Oryza sativa
attttccattaaaataatattatttttaaaaaaaattcacgaatctggtgcactcatgcacacacacaatcaggcccctccaatctagatccaaaggctagtgttcaggtgaggtaattttgcaaaaaaagcgcccgcctcttgccctggcattttgcaaaaacccccctcacgattggttttcctatcccctcatctatcagatcgtgtgtcctccgagcgcactaatcca

SEQ ID NO: 53920 - DNA, 534 bp, Oryza sativa
atagcatggtgccagtttggaagcttaacattttccaggaccttgagtcattgactagttctgccatggcatgatgtccacagccactaatcttaaaactcctaattagtgtcctatcatgtggatccattatctaaaaaagtgctatcatgatcattagtccattacatgatcgaatgcaacacaagctgcatgcgacaggaaccgacaactaatgtccaaaccaattaaccatactagccaaacttcaaagatagtataacttacccacgaaaagctatcttgaggagctaatgatcctaaagccttaaatagttaaattgctatctaagagacggctatctatgcccagcgaaggcaaaatttagctcatcattcaagaccattcaacattaatgcatggaagaagctaaaacttttttttttttgctgactctactttgctgcccccatttactcaccttctgctctcgaattcttctcacagtaaaagaacaaaccccccgctactgtcccagcaaaccagaccagcca

SEQ ID NO: 53921 - DNA, 1359 bp, Oryza sativa
aaaacttcttaaaagtttgactaaggttataaaaaaatagaagcactttatagtactaaattagttttattacatctaatatagaaacaattttctttgttctgttaaaattaatattatatttttcttaaatttagttaaacctaaaaacttttgacttagaaaaaaatgaaaccctttattgtatgaaacggaggttgtactactcaattaatcattcgttaatgatttatttgtttcacgtgtagctaaaaggctacccctccgttgtagaataagtcttgggatgaaaatgttattattttttcctacaaacttagtcaaacttgaagcagagtcaaaacgttttataacccgaaacaaaggcagtagcaattgtgaaagcagggaacaaatgcacttggactctaagagtagataaagttgagaatagttgtattgggttttaataaagtagggtattatggttgttttcctttgagtaagttgggaatccttttcctcgaccttaaaatggagcggtagattagtacgtgaataattaagtattagcttaaaaacttaacaatggattaatataatttataaaattattttttcaatatttttttaagaaaacatgctatcatctagtgttttgtaaaatatgtgcatgaaaaataagagagtagaagttactaagggaaaaaagaaaacactatttcagaatggaggtgcaacaaaaacggggcacagtaagtgatggagctagaaagatttttgagtgcggacaaaactacattataactaattaaatttctataacaatatataagtaatttgttatagaaatttcatcataaatttatttataacaatatagaagtttaatgaaattttcgtcggtgagccgcccggggtagccgagcagtggctccttcctgggtgcggtgcaggaggagtaggaccgcgcgcgtgcgcgggtgtggccgtgtgggggaactgacgatgatcgtgcagttgcagtagcgcgagcgcgagcgcgacgttttcctccggtgttttggtccccgctccgctccgctcgccgcgggcgcccgcccatgccatgagtcccgcggctccagcgaaaagggggagtacccccccgctgtggtttttctgtcgctttgcatgcactgcacgggcagtcgggcacggcgatgtgcgcgccaccaaaaaccccaaaaggcggcgcgcctcccgatgcccaccgcaaagcaaagcagagcagagcatattcggacggatcgatggatccccctgctgcttgctcgctcgctcgctcaccctgctgaccatatgcgtgaatgtgatgaaaaaaagggttcatcccaggaa

SEQ ID NO: 53922 - DNA, 1284 bp, Oryza sativa
acatatatacatgtgagaaaattcattttttatatatcttgaacagctcacatgcacatatctactttctctgacaaataattatctgccagaagtacagttttgtaaattcctaagctgtatatattcaccagtcaaaccatacaagccacacaacaaaatggacctgcagccagggcccactgtttttgcatagctagcagtatagctcaatgttcaactggacacggcttgattgattaattgaaaatgaaatgccaaatagtagcagcattcattgtcctgtgctgctttctccccagcttaattaattccccaattaattactgtaggggtcgtcgcaagctttgcaacccccaactgacagcacttagggttcaaggtatggatggaatagatcaatagtgagagccataaatttagatacagtaacagcacgtactaggtagcagagggacagatcgatgatcatcgatcctagtcaccgatcatgaatgtttcaagatgatcgagatcgtggtcaccaattgagagatgcatggttacatcttttagcttttgttttgaattgaatcaaggaaattaatatgtaggaattgcgaataaaaccttaacaacttctcaattacatgaaagtcccacacaccaatgtatatatatatattcgtcaggtttcctccttcgacacatgttcaaatgaactgtgaaaaatcttactccaatgccaaataatacacatgtggtacataaagtactcatatctctacgcgtctaccgcagcatcatcaggcatgattcactaaacctcaaattttggcacatgcaaaatacaaacctgtcttacaattaattattggttcgaccaaatccactcaattattggttcgaaaacgagattttagcaaaatataaaggttggaatgcatgaagtcttctaaaatctaaattattgtatgttggaattgaaccatttcacttcaaaattaaaaactactataagacctctttggaatttttcttttgcatgtattaaactagttctatgaaaatcttaaaaatttctacgttctaagccctaaatactaattaaataggaacttgattttttaaaaaataaactgaggcaacaacctcagggtagtttattaaaacacaattgggagtacacaaggcccctcatagaacattttgaaacatgtaaaaaaagtcctctaaagaaaagtaaaatgtgatcaggtccttcaactccttccaccgagctgatgttccattgttccatccagt

SEQ ID NO: 53923 - DNA, 874 bp, Oryza sativa
acacatccaaaacggtaaaatcaatgttttgattgttattgtgatgaacaattgacatgagattttatttgtattggttttgatatatggtgatttattggcgaagtgattttgtctctgtatgggaccagacagtaggcaccggtcaaactgtaggcatggtggcggtcaaaccggccaaccagacggtttgattgactagctcctgtttggagttggtttggagttgattttttgattaacaatgattgcttcttgcttatggcttccagatgatttctatacgtatgttatatatactgttgtgtgataatattgagtcaagttggaaaagaactaatgcttgaatatggtttcttatttattcatatgtaagtgtgtcttgagatctcaggagagtattgccgatgatggatagggagtcaacttgagagaagttttgtctagatgatcaggagatcttgtggggtactaatcctagaggacaatgcatgtggtgatgaagattttgtatgtcatacaagaggtgttgtatgcatatggaaagcatagttaattttgaatggagtccaagtttgaaaagtttgaagtttaaatttgtaaaggatattgagttggatacttgtacaggtgagtttccgaatggattaggactacttactcatgttggatttgtggcttttgtgcagtcatctcaggatataaatagagaattgtcatgagaaaagttagggtttaacctagatttgagtttagtcgaaagttgagagaggagcgtttttgttgcactttataaacacaattagaagcaataaagttgatctacattcaaagaatttttctgatttatgttctctctattatgatggtcagg

SEQ ID NO: 53924 - DNA, 1501 bp, Oryza sativa
aattactagagcacaggtaaaatggtgagcttgcagagataggccaaagtgtgagcttcctcctgaattttgtttgcagttgcagcatgctagtactattcattttcttagtggttgtgctccactgatttggtgatctggtaacgccaatagagtctgtacaaatgtagaattggtgtaaaactagtgatggttagtgtggttagttgtgacacctaaaccctgtgttctctagatttttggcttgacaatgactgcaaagactccatcgagataatgggtgtcattctttcttgaggactcaccgttgatatcaatcgatttgttgtttaatgatgtgtcgctatggccagctagcatgcattaactttgtggccgacggagtagatgtgtcggtgtttgagtgaggttactacatctgtatacatacatgatacatggcttcttgcttcattgcttgattgtatctactgtacgggcatatcattgcaaaattttcgtcgcagtatggggactacttactactatgcacaagtatatgctgtacacccatgtgtaattgttcagtacatcgtgagaaataaatagtacttatgtgggataatcttctgaagaattttttgaagaggaacttgttgctctatgtgatttggtatcggacagtccgtaatctgtgaccaagagctctcacgctcttgtcgtgagccggtgaatggccaccacggcctcatcacgggggtaaggtaggcagcacatctgcatcacgtagagaaggcctaggagcaaaatactcaaacgccaccggtacgattggcattacacgattgcttatccctttatcagcagctgcctgagctaaacttagtttctggtccaaaccaaagcaggtgtcaagtcactgctagctagtgcatacatacagacatgtaaagaagcgtctgtgtatgtagacgacactgcagaggaatagataacatgccatttccccaactcggtgttaataaaagaagcggtaaggacaagatcacaagagggggcaggcagatgagatggaataacacaagtgtgagcttgggcacgaggctttgcatgtgaagagcagcatgaacgccatgtggtggcacagggagttctcgcctgtgtcttctctactcctctttggggcagcagcggcagtggcacggcaattattgaagagcacagccccaccagctaggctgcttaactccctctctgcccggccattgccattggcattgccttccacatggaagatttgccacttgttccagacaagaatggcctcttgttccagccaagagaaaatggcgcccatttgcattttgcatcgccgttcaatctaggccggtcagatgaggtcgttgtgggggtgtgtgtgatgcatgggtccctgataatactccatctctggtcccagattgttcagttactccactcctactatgttagtactagtatccatgattaagcattgaagata

SEQ ID NO: 53925 - DNA, 301 bp, Oryza sativa
tatttcgtcatttaaaatacaaatgcatcttgcatttcaagtgccaaaaaaattaaaaactaattcgccgttcccggggatcgaacccgggtcacccgcgtgacaggcgggaatactcaccactatactacaacgactttgttgttggcagttctaggaaattattttttatttatttacttccagtgtttaaaaggaagagaagtagagaacttcccatgaatgtgcagtacacatatgaatatatataatagaagatggactcttccacatatatatatatatatatatatatatagga

SEQ ID NO: 53926 - DNA, 397 bp, Oryza sativa
tttcacgaacacacaaaagctttaccttttgatgtaagatgatgaataattcaagtagaagaaacgttgaaatggaaattagcattgtgatttggtgatctgtatatactgacctagtaacagcttacatcaaggacttgtcgggagtaatggcaatcatctactgatctagtacctacaatgctacataattgagaatcttcagtttacatagcaacagtgattgtactgactaagcttctgtttgtggttctgacgacgaatgcacgatgactgtcctctcctacttgaaatcatggagaaatggcagtgattgtacacaaatgctgcacagttttcacaagaatgaacagccagcttgatatagtgatctcacctcacgctgcaagcacgtagt

SEQ ID NO: 53927 - DNA, 1501 bp, Oryza sativa
gtgcacctttccttgctggggtgcatgatttgtatagatactgtcctagttgccatttattgtttttgttgatttggtaggtgctaggttcgttctgatatgttggaaactcgtgttagtgcattcattattcagtatcagcagtgtgcaataattgtccaatgttaatgcaacctctagtgcctccattttgcagttgcgggagtatagtcgcaactgtttcccacaaaggcaaacctgtattctccttgtttgtgagctttcagggtcaactcgattttttttttgacaaattagccattttcaaaaactgatgaaactagaccgtgaaaaaaaaaaaggccgtgggctccatgctcagacccctgccacatcggcgggggggaatggcttggccgccacgctggcaggtgcttagcgtcaagcgtttttttgctaacctcagcgccagaagcattggcgttgaggtcgcggtctatttgcttgaagtatttttttttcacggtctagtttcgaaataagttttataaaatgaccaatttgtcaaaaaaaaacaggagtcaactcttattagtgtcgttttcataaatattattatacatgcccttaatacggagcagtaaataataataagtctttatatttatgggtaattacttttttaacaaagcacatgggtgacttcggtaatatcaaaatatgccgtcagttttttttttacaggtgttcgtaagaaatattatacatgtgtgctttattttcttcttttctggaaaactcaaatgaaaattcactctactcctagttgttactatggaaaacagaagatatgaaccagttgttaggccctctttatttaggttagcttatatcttttataattcggtggatttaaaatcctaaattgaataaaagagacataccttcatcttacgtaagttaaaaatttttcttcaacacaacttttgacttaccgttgtaagagtgacttatagctttaaaaaaaccaaacaaaaaaactgcttcatcttacggaagttaaaaaattttcttcaacataacttttgacttaccgttgtaagagtgacttatagctttaaaaaaaccaaacaaaaaactgcttatttgtttagaattagactaaacaaagagcctataaacaaagatgatctaaatcctggtgtcttgaggactttgaacagatgcgatggatcgaacctggcgtagtggatatatgtccatggtggatacaaaagcgacccgatgttaacgtgcatggactagcgataagaatgtgtacgagagagatacggaaaaaaaaccagcgtcctttcgttcaaaagcgcccttcccttatctctgcatgcagatgcagacaccaccagaccccgcgagtataaagccgtcatttgttctattctgttttcctttcagttcttcttcaactgagagagcagtaggcagagaggggcagtgagatcgatggagcgagcagccgatg

SEQ ID NO: 53928 - DNA, 1501 bp, Oryza sativa
ggcgaccagagctcgacgcagggctaggagagagctaggaatcgtagcccccacacttttagcaaagaatcgtttgaatggatgaagcgaatacaaactttttggtaccaagggaggtaaaccagcgcgcgacacgtgggtaccgcgggaccgcgaggaagagatgggcgagagataaatataagcaataataattctatgtgagcgattatcttcgcgcgagtgcgagaactaaactttccatagccaataatcttcacccacgatcaagccaagctgagtgctgtagccaaccggtggggccaaagccaaccgctacggaagagccagcacagggggccccagacgtcgacgacgcccagagcttgacgcagggctaggatagagctagtaatcgtagccccacacttatagcaaagaatcgcttatatgaataaagcaaacataaaccttgcttgcatgtcgcgacctttcaaacttttagctcgaagagggcctcccatcatgggttcccaaccattttgggaagcctacgaccacttagcaaacgaggtcaggttcccacgagcctgtgtccccacgctacacattctgtttgctctttcctttcggtggcctccttccaatatctcattttctggtggaggagttcattctccgataagcctgctccgttttccgtgccaaaaggattatttcccgtccctcactctcgattgggccctttatttttcaacttgtcttcgcctggtacggcgtcagcaaggactaaacatccattaacaaaaaaaaaccttaagaatttgatataatcttgatcatcatgggcagagtttgggatgcgaaaatattagcaatatcctcgtggtggttgctgcagcaaaaagaaattggcctgcaaaagcgtggcgcgtgtttttttttcttttttttaaggtataggacaaaacaaataaagcgagagttccctgcgtttaaagtggtgtccggtcaaagaccaggcatccagcggagcgtgggttggggtctcaaccaccagccaaacgccgccacaacggctacaactccaccacactccccgcatcatcagggtcgcacacacacaccaccatgtcatgtgcccgcccactactaccacttcgcctccttcccatcgagggcgaggcgatcacaccacgacccggccaaactttgttaacccaaaccaaaaaacaacaacacctgccaattactcctcgcggttgctgccgtcctgcaatgcagccgaggctatcagcagttaatcggccacgcgctttacacaattattataaacgcgtcgttgcgaccccgacctggagtacttataacccacccgatccaccacaaacacgtacacaaaccacaaacccgcatcgtctcctcctcctccacttgttgttcaattccccccccccctctctctctctctctctctccgtcgcagatctcggcaagggggcaacaaggtaggaggcggcga

SEQ ID NO: 53929 - DNA, 1501 bp, Oryza sativa
agattagatccaacggaccagatgtaatgggagctgctatatcataagatcccgttcgaacagtacagagatcggattttgatacctcatcctatcagccgatacttattggtatcatatatgatacttattgatattgtatcaatgctaggctagtactccatccgtctaaaaaaagacaaaccctgatttcattgcccaacgtttgaccttccgtcttatttgaaaaaattataaaaaaaaattaaaaatacaagttacgcataaaatattaatcatgttttatcatctaacaataatgaaaatacgaattataaaaaaaatttatataagatggacagtcaaagttggacacgaaaatctagggtttgtttttttttttacagagggagtagctgatacccggttagtaccacgtcagtatcttttttttctccccctcgatatgttctccgatgacaacgacgtgctgcccagtgacgtactacctccgttttttaatagatgacgccgttgactttttctcatctgtttgaccattcgtcttatttaaaaaatttacataattataatttattttgttatgagttgttttatcactaatagtactttaagtgtgatttatatcttatacatttgcataaaaaattttgaataagatgagtggtcaaatatataagaaaaagtcaacaccgtcatctattaaaaaaacggagagggtatctctcatctccggcgagagcgacgtgcccctgttgacgcgggactcttctccggcaagacccccttccttcccctaccttcctcttcggtgacgaaccctccacctcgcgtaggcatgcttcattgtaccggaagaaagcacatcgttttgccgacgagaagctctggatttgcaacaaaaggctggagcaaactggctccccaacccacacccttatggaaccctgcaacaccaagaacatgtcatacacaaaaacaaaatccttgaccaacgagcgctggggctcgccagcctgatcgccgaacgcaaccatagccatcgccgcccgtcgcaccgctcctctcctaccgtacaccctggagagatggggaagagagggagatggagaggagagagagggccgctgacatgtggagcccacatagataccactcgccatgtcagctaaaaattggtcactatattgcagatggaccaaaatttaacatggtattgtgaatcgagggatatgctatacattgtatttctgttgagggatgaagttcacactccgcaacaacttaaggggcctaaagtgaacttatttcgtgtgcatatgccaccattttctccgtgggccgtcaacgttgattcacatggcccatctactaggccgcagcccagcctactaaaccagtaagccctagctccgaacaacccctcgtctgtctctcttccccaaaccctccacccaacccgcctcctcgagcgacggcgcagccatggcggaagcagcag

SEQ ID NO: 53930 - DNA, 1501 bp, Oryza sativa
tcttgttagcttgtggagatatccttttgttttcgagagaagagaacatctcaaacttgaaatctgcatgcaactattaaggagatcggcctggggatcactggttttggagtgtggaggagtgcaagggcccctgttttttttttctttttctttttctgatgatcgatgcatgccatgctgctatagctgggccaagagctgcactgtttcggctaggctgttgtggtttggttgaggccgcatcaaacagtggcgtcttatatattggtgcgcccacacatgcaaacaaatttcttgagcccggcttcgtggtgcgccatccaaatcgtagtgtctccattttggcgtctttcacatgcacaccctatcatcctttcctttccatgctcaaccaagtcatgggtaaataatatatacggccttcagttaaaatttgccaaagttgttttcttttcttttagaaaaaacacaatacatacgtagatgctcgtataaacacatgtagctatgaacatacacgcacacactatctctataagcacatctctgaagttgatttgagcgagctagttaggttattgctttgtttttcgcacaacactcaaatttgtcgaagttgataggcgtggggattttgaaatgttgttacttccttagactacccgcggccatttttggcgcgagtggcaggtagtctgcagagttcactgaaagagtgaagcagtacatactactagctgccatggcatttcaaaatgaacttctgctgcgtctgagccatgagtcctgcgttcctgaaccccagggtgcatgagggagtagtgaatggatgaggcagtactacttaacagtagtatacccgcatcttacaatagagcgcgtttcgcgagaatagcatatttttggtatgtacgtatgtcccgtttaaatttcacgagaaaagtatgttcaattccaatgtggaaattaacatgaacattttctcacgatctaaattagaggcttaattagccctcctttgaaatagaggggtttcaaaagttcgtaaaattactgttctctaaaggagcccttgtaagatctaagatgaatttgggcatcatttaagaacactatatcacgaaaatcttttttttgacagtgcaatgtctagcgcaagttgttgataacatgatggatagattatattaagacgatgcaggagagaaaacgacgggtaacaactagtgcacgcagaatggagtacgtagtacacattgacatttgacaggtgaggacgaaatctcgatctctcgcggcaaagcagcaatatacagcaatgcatctcactccaacccaatcaaacacacacaccagtcaacactgctacagcatcaatcataccatggccatggcatacattatgcatgcttccaagatcaatcaatcaaacgtagtctctcgcttaattgctctacctagctagctaatacagtagtaattattgtgctcatggatg

SEQ ID NO: 53931 - DNA, 1039 bp, Oryza sativa
gacccactaggctcatgctatacgtaaatgaagtgcatttctcaaaccaaagattgacaatttgccctacaccttcatatgagtttcgaacgtatgagttttacaaaacttccatagaaattagatcaattatcataaatatcctctcaaaccaaagattgacaattttcctacacttctacccttgtgactcctttggaactatgaattttacagaacttggaatttctcaggctgtcaaatactagtattttcagtactgaaccacggccaatcttgtgtgatatttgtcttgtggcattatctgatggacaggtacactacagagaaacgtgtactgttttaatacaagcagtactatcaagtcttcagaattaggcaggtcagcaatatggcatgcatccatgagggcaggcaatagactgatagagggtgccccccttgtttctcctccaattcaatgaactttgggacaggagtacaggaccatgatccagaagatgaattattcaatggcaaaattaaaaggctactctgcatttaatctgctaccaccctaaccttaccaccttacccttctgcctttgatgcttatctgaatctccttttgcagcctgaatataaaacactcctacctttgcaaagatgtaggttaacttgttaagtcactttatcaggattgtgcgtgttccttaactgtctgtcacttttgactcatattcagacactcattttaatgccaactttcagtgaccacaaaaactgtctattctaaataatgtagcccacttatagaattatggataaacaattgttgtggatcatttgatttgataaggtatcatcaccactttctagtagtagtttagaccacagtttttttgcatgtgtctttgttcatttctacagaataccatatgccatgccaaaagtatcatgaaatgacacataaagggagaaaagaaatatcaccttagaaccccaaataatcagatatatgatgaccaaatcttctccacaagttatccatggatggaga

SEQ ID NO: 53932 - DNA, 1501 bp, Oryza sativa
cttcttgccgttggccctcaggtaccagccgagcatctcctccagccacccccagtcatggcccccgccactcatgtggctcatcaccatctcctccatcgaccgccggaagtctccgtacgggtcggccgagtcgatggacatcgccgtcgccccgtcgaacgccgccgcgtcggcgtcgacggcgcgtcccttgacgacgatggagctcgtcgactcgggctcgaagaagaggcggcggttcgacgaccggagcccgcggatgatcacctcgtcgtcgtcgtcgacgacgtcgttgacggcggaggcggcggaggagtaggagcggcaggtggagtggtcgtcgaggaagaaggccgggttcatcacgctcgtcttgtagacgcagtagtcgtcttcctcctcctcctgctgccgccgccgcttgctgtcgtcgtcgtctgcgcttgctggggcgtcgtgcctggcgaaggagagcgtcctcgcctgcgtgcacgaaggccattgccacgacgacgccgtgctcgacgacgacgacaggctacaggcatcattgccgccgccgccgccgccgccgccgccgaggaagagagaggcaacaagcttccgaaccatggctagctaactcctagctagcttacgtgcagctagctgtgtgagagtgatcgatcaatggatgaagcttaagctaggctatgtcggatgtcgctgtaaactgagttggccttttggtcggagcgagctgcgcttagctgtgcttttaaagaggctgctgcggcgtgtgcaagtagctatcaaagatgcgagcgagcgaaagcctgtcttcttcttctcttgcattgcatgttgtttaattaattagcagctacctgcacttaacacgtctaatctaatatgttagctacccatcacacacagcttaattggcagctactgatactaatgctacttaattataactgaaacttgtatgttgtcggtttacgctgcaactggagcataaaaaaaaatgtacgcatgcaggtaaggtaaggtaccaagtacgtaccattttgtcattttgagaacgcagatttgcagtcgtggctgtatgtatgaatggccagcagcaaacagcatatataccacattgatacggatgaattacatgaccgggaggtggaaccgcgcgctaattaattaattatatcatgtgtaatcgcacggccatctgatccatgttttcctgtattttataagaggtagaagttgctagctagcttgatatctattaattatacatgtacagtttagtccactgctcgcattgttctctaccagcaatacacgaagaaagcgcagcgacgtttccctgacacacaattgatcgaaatccaggatcacacgcaggccggtcaggcagcagaaaatgctagtagctctatagtttaattccccttgtgcatgcgtatcagaaatgaatactacatgctgctgcgatggtggccgacttgtcctctat

SEQ ID NO: 53933 - DNA, 1501 bp, Oryza sativa
aaggacttcgtataattattttctataagatacaaattctatggatttcctatgttattcctttcccaaatattcttatggcaagcacaaagcaaccgtagcagctatttagaaatcagaagtggtttcagagttttatgtagtactttgcagcatgctaagcatctctagcaaccttttcatcccactgtttaaatcaaaatttagtaattatggataaaaatcgcacaccaacagtccatccatcccactctccaagtcatccgctaacaaactccttctctcacttgccaaacttaactagcctactcaacttgctattcgtgtcccactacattctattctctttcttccttcatttgggagcggttggcgttgacgggagcgcctctccctcgactccgcctcaacgcgcctcctcgctaccgtggcctcccgctcgccgtcgcctctgacctcgcacgacctccaccgcctcctcccccgtatggattcgactcaggattcgtcgccgtctcctccatctactttactggagacggtgtggggatgcctacagcgacaatggggttgggagtggatggcgagctcgagctccgttgtagcatgggcaccgccacaatgtgcagtctctagagccacctcgccctgttcaccgtgcccgccaacaacctccctttctcccgcgttggttacctcgctccacgcactcatggatcttccatcgttgtccgctgtcaccgtcgctgttcgcctttgcacggacgtcaccaccacagagatggagagggccaaggaggagcttagggatgcccccagtaggagaagagggaaaggggaataaagagaaggaagaagaagaggtagtagatgataacatatgtataccagtagtatagacttagagtagaaatgatagatggagagattattgaagttagcaacgagtttagcttgccaaaccaattaaagatatgcttatataggtatttggagagtctgatttggagtctgttggagatgctctaacactctaactaatttggccatgcttttttagccttttagcagccattcagaagtattgagttcagtatttctactttattatttagaacatttgttgcaagctatgtgttaaagtctttcttcaaatattttattgaaacacttccacatttttttttggcatagtttgtgttcactgcaaaaatcactatgatggtcatgacttcatgctctctactttattgatgcacaatactagtacaattaattaaaagaactagtaataaataagacagatatagtagtattagcattcaggaaaacatttttctacattttctgcagcagcagaccaccgttcgacagtcgccatcgtccaccctccaatctccatcgcttcttccctctaaccacactccgcactctccccctcccctcccgcctccccactccgtccaccccgccgcaccgacactctcctccgccatggatc

SEQ ID NO: 53934 - DNA, 476 bp, Oryza sativa
agtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttatagtcccgtgtccgtagctaatcaatggctaatccacacggtcggtgaacgttcaagctgtccataatctatcctgcaggggcgagc

SEQ ID NO: 53935 - DNA, 1501 bp, Oryza sativa
gccacagtccattctctgtgtcagcaagtgttggccactctcttgcaacatgcatcatatcaactgaaggcgatgaccatgccgagaccggcgtcctctcatggggatggaactgcagctcccagcttggacgacctggcaaagaagacgtgcctgcactagtcgacggtctgaatggagagaggccagtgtcggcctcggctggtcgagttcattcggttgctctcacatcaaagggagaggtttgggcatggggatctggccgaaacggcaggctaggtttgggaagctcgatggatgagcctgagcctttcctcatcgataccctggaaggagcagaggtttcacaggttgctgctgggatggaccatactcttctattggttgctgagtaggctggggttttcttcaccaccgaaagtcctttgattcttgccgttgtcagtggagaggttgtcattgtccatctactggatacgatctttaaaacaaacaggcgatgttactcgatatgcttggaaccatgaaattcagatgtgtttcttccagctagtttgacatcacattccccttgaaagagttaacagaatgaagatagcaaaagctagtcagacgccagtgccagtgtgcattctcaaacctcctcttatagagcatctttgtgtgtgaaaagttcattttcttccatctgtagttgtagactcggtacttatgttctatgccaaagcttaccctattccctgggatttgaggtctttgaaaactcaaaactccttgtaataagttttgtgtggtgaacaatatcctccggcaaaatcttggtgaaattttcattctgtttgaattattgaattccatgtggaagtgcacagagtttgaagtgaacaaagagcgtaaggatgtgttctttaccacatcttttcaacttctactcgctcgtttcatgcggctaaacggtacgttttttttaaaaaaaatatatatagaaaacaacttttttttttaaaaaacatattaatctatttttaaaagtttattttatctaatgcttaattaaccatacactaataattatttcattttgctgcggagggttgaagctgagtgtaaggtcctgtttggcatagctcaaaagatttgaattttgtaccgtggtttaaaatattaaatttcacaaaaaatggaaacaaaatgatttgttcaaatgttatcaacataattatagatttaaatccatggacatgtgaagttacaaatatttagctttaagaaatcttggatccgggctatgccaaagaggacctaattcaacattgctaatgaagccgtgctgctccctaatggcctaatctaggctcatttaggctcgatcgcatcgaaaatgggcttattatgctttgggctataattgggccatttgtcgtcagctcttgggcccagcccaacaaaccgtcaatcccaaataggtttccgggaggtgggtcccacttgtcggtcactg

SEQ ID NO: 53936 - DNA, 549 bp, Oryza sativa
attcctgcagcccctccatgatatattgtttccttttttcttttctttttttggttttaagattgattaatatctcatgtcatatcattttgtcaatttttttggctgaataactggcactagttccatcacaaatgcaggatagaaacaacaccaatctgtgctatccacaaagcctaaacaaaaaaatctcagcaaatgccaacaatccaagaacacaccatgcacagatgcaggaaatgcaaacctcagctgcatgctgtgctggcagctggtaagccactgagaggcagctcccttatctcacctgcccccctgccacgtggcacactcctactgggtccactgatgccctcatctgctaagatgccacctcacaccagaattagatttccccgggcccaccccttttccatggccacaagcacagcacccctgcaaccttgtgttcccctcatcccccttttctagcactcaccaagtttaatttggagcacacatttcagctcaccactgctagcttgggaagaggaggaggagcttgagctt

SEQ ID NO: 53937 - DNA, 186 bp, Oryza sativa
cttgatacggagacagggataacgacgacttcctcaggttagtagtcccttcaccccttgatgccatcccgactagatcagccatgttctcgaaagaggcgtacagcttgacttagtggttatcacattatgcagatctcgagggtgcccttgctagccaagatcgtcatatccaatactggaaga

SEQ ID NO: 53938 - DNA, 1501 bp, Oryza sativa
cacgtgcttaattgaatcaatttaataatactatattagggataacgggttgtttcgattaaacacgtacgcatcgggggtggtatttacaacaaaactaagttgagggtattgcaaaaaaaatgatttatgaggtagaatgttaaattttatgtgacttatgggattgttttttaattttttccacctatatatgaaaatggaggtccctcgactattaaaactaatagattttatccctttgaacggtacgaacgatggttttatccattgtgacgttgagtgagccggctactgatcttgaacgaattcaaggaggggacaacttctataggatgaaacatcaatattaattgaactacaatttctcaaagaataagaaaaaaataaaacaaaagcttttgtcataaaagctataggaaaatttcaaaacaaaagaagaaaaaattatactccctccgtcccataatacaagggattttgagtttttgtttgcactgtttaaccactcgtcttatttaaaaattttttagaattattatttatttttttacttactttattatctaaattactttaaacacaacttttctttttttatatttgcataaattttttaataagacgaaggtatttttatagggggctaaccactcacaagaaaaagaaaatcataatttttggatggtcacttgccaagtttccatggttggtcaagcgccattataacactttatggcgcgtaacagtttccgaggcatgggtcccaccgcccacccccggaggctcgagcagtcgagcagcgttccctatctcgcaacatcgcatcacgttcgtccgatcccctagcgtggccaccgatccgcccgtccctgctctgggcttgccgcctttttccttctcccacgacgacccaccccaagaggcccagacgggagacggcttgccgcctcttctccttcccgctccgcgccatccacctccccctcctctccctcccctccgccgccgcctggcagcttccgcatcggggggaagcgcggtagcagcgctggtctgtccaactcgaggtggtgttatccccaagatcgagaaggtgcatttggggtggtgtttccgctcggagatggtcagagggacatcgacccggcaatactgtttctagaaccaaatgtaggtaaagttcaagctctgctcttgtgagttgtggctagaagatgattacaaggccctgtttagatctcaccctaaaatttttcaccctgtcacattgaaggtttaaacacatatatgaagtattaaatataggctaaaaaaataactaattgtatagactgcgactaatttgcgagatgaatcttttaagcctaattgctctatgatttgacaatgtggtactacagtaaacatttgctaatgacggattaattaggcttaataaattcgtctcgcggtttaccgatgaattctgtaattagttttttttattagtgtctgaaca

SEQ ID NO: 53939 - DNA, 446 bp, Oryza sativa
  unsure (1)..(446): unsure at all n locations
ttttttttgtttttttttttttttttttttttttttttttttttttttttttttttttttttttttttttttttttttttttttttttttttttttgttttttttttttttttttttttttttttttttttttttttttttttttttttttttttttttttttttttttttttttttttttttttttttgttttttttttttttttttttttttttttttttttttttttttttttttttttttttttttttttttttttttttttttttttttttttttttttttttttttttttttttttttttttttttnntttttttttttttttttttnttttttttttttttttttntttntttttttttggtgtggggacgagacgacgaggcccacaccgccgccggcccagaagcggagacgacgaatccgaggcccactaagaaga

SEQ ID NO: 53940 - DNA, 1501 bp, Oryza sativa
agaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgagcggacttcgctggcagtcaccgcgggtggagattccttccccgccgcttgccagaacgccgccctcctcgccatcggcacccttcaccagcgctacccggacgagttgcagcactcgccctaccgctaccaccctcgtcgcggaggagcccgcgacttcgccaccttccgggatgctagctcggaggatgacgctaccatcgtgcacctggcacgcatggtggaggcgtacgacgcggctcgtatcgacttccatcagatggtgcgccgcggtatggtcgagaacaacatgaagatcctggagctgcggcaggagaacctgcagctcaagaaggacctcgacgcggtggaggcgcagctgcatcagctcaagatcgcccagggagaggtctgccgccccaagcgtcgccgcgtctgccgcagccagaagatcaccgcccgcaagagcacctccaggcctgagcttgttcgtcagtccctggcgtggacctgcttcgtcgagacccctcgtgccgagcccgcgcccgtggttccccaggagggggaagcctccggcgttggtagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactgtgtcggagcctgtcttattttatttgcctaagcaacttgaactttaatgaaccaatttaatagcagtaataaatttaagaattatggtagtcgtgggtggttagttttaattgttagcttctctctctctgtttgctggttctgtgtggggttttc

SEQ ID NO: 53941 - DNA, 1501 bp, Oryza sativa; identical to SEQ ID NO: 53600

SEQ ID NO: 53942 - DNA, 1501 bp, Oryza sativa; identical to SEQ ID NO: 39700

SEQ ID NO: 53943 - DNA, 728 bp, Oryza sativa
gacccctcggggagacagagggaggggtggccacgtcaccctcgggcccgaccccttccccccccgaggggggcaggccacgtgggtgaccgcggctacccaagcctctatagtcacgatacccccggccccatgtcaccgacagtagcccccggcgttacgccagggcgatcgcccccctcgagggaagcgctcggacgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgtgcgaatcgggacgagccggttcgtttcgcctggagacatgatgatggcgcatttcacggttggcgggcgtagttaatgcgcgcacgatctgcccatctcaaccgccacggccgcacatctgccgcatgcgccgcaaacgggcgagtggggttagtggaggcgtgggcgcgcgaaacgagggggcgaggtagtgggcgcgggaagcgaggagccgggcatagcgttggcaagggtgtaaagacgccgaggaagggattcgtttctttcctctcgccactcttccccttgccttcgccacttgtgctctaactcttcgtttcctgtgccctacccttgccgcactcgctcgctctcaagctcctcctccgccggcgtca

SEQ ID NO: 53944 - DNA, 520 bp, Oryza sativa
ttcctgcagcccgatggacatatgattttttttaagttcaatgatccggtctaacctctgagtaagagcctgctaagttcagaattgacaatgctggtccagaaacttaaaagttgagcgagagaagggggcatatgtatgggcacaagaatatgattaagtggttgcaagaactaattttcccactcaccctccaaagatattctttaaagttgtctgtcacagtttaccttcccaactatatgaagaataataaactggatggagaataaaaaatcagcatggcaggcataccacctgatcactatcaaccggaattacctacacaacaagtttctgcttatcttgcccatatccaggagtacatcatataaatctttacatggatctaaattgattaaaaaaaacataaccaaggttcaggagagaactttgcagtgctgcgaatggccaataaaatgaaacctaagttactaataaaccaattaaagtaaggagccaaaattactaaaagaaaaga

SEQ ID NO: 53945 - DNA, 375 bp, Oryza sativa
ctgataccaaatcaaggggctttattgatttatcagtagtaaacaaaataccttgtttttcttgttaaaactgtaaaagtctgatgtgttttgccctacaataatgaatgccagagctcaacttatcgataggttgctaacttcagcattaaccacacatcatatttctaatcctgttaggactaagaatttaacaaataacagaggattaccatggtgtatgcccacctatttgacatcagcaatatatatgcaaatagtgcaggttagacaatctggatagcaacaaatcgactgctgttgttgtatgcatctaaaagtttgtagttacaaagaatgtactgtaaatcaaatgggcaccagaagcctgattac

SEQ ID NO: 53946 - DNA, 1501 bp, Oryza sativa
catactcacaagctcatcataggaaacatcatcacaatcatcatcactctcattatcactaagagatgttaccttagaggagccctttgccatgagacaaagtggagcgaagagtgatagagcctccttgatggcaacaacggccatcttcttctttttggagcttgcatcatcaccaccttcttcctcggacccggatgaggcggagctctcctcatttgagtcccattccccgatgaaggcctcaatcttcttgccttccttcttgagcttcttcatgagcttgtagcctccactcttcttcttgcatgacttgtctccatcatcatccttggaagggcacttggaagcaaagtgtcccttctcaccacactcaaagcacctcaagttggagagagtcttgttgggtcttctatttcttctcctattggagttggagccccttcctctctcctttctccttcccaagagatcattgaaccttctagcaagaagggcaatctcttcctccaagtcctcattggcttcattcaccttgcccttgcccttatcttcaacttcggcttggagagcaatgcacttcttggaaggtgaggcttcctccatctccttcttcttcaacttgtacatgtcattggtgttgatcttccccaagaggcttgcgggtgtcatcattgacatgtcggagttgatgagcatggtgacaagggtctcatacttctccggtagagccctaagcatcttttgggcaacctcaagatcgtgtagtttgtcccaagccccttgagatcattcacaatgacattgagccttccatacatgtcattcacactctcatgaggcaacatggagaatgtctcatattggatcttgaggaaatgaagcttggcatccttatactcactcgtgccctcatggatctccgccaacttgttccaaatctcatatgcggtctcaaggttgctcactctatcaaactcctcttggctcaaagagttgaacaaagcattcatggcttgggcattgagttggaggttgcggtgatcaatctccgtcaagggcttgccggtgatagcaaaacctacatcaacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagctctgatacaacttgtaggatcgagatgtcgactagagtgtggtgaataggcgatttaaaactaaatgacacctaatcaaaactaacctaagtcgctaggcttggtgagggtcaactctaactaagcaactaagttatgttttgcaaacctagggtgattgtggctcaactatatctctaagaaagtaaatcacactcctatgtcaatgtttagcaatcctagggtgatatgatatctagtttgtttcta

SEQ ID NO: 53947 - DNA, 1103 bp, Oryza sativa
agggctctaccggagaagtatgagacccttgtcaccatgctcatcaactccgacatgtcaatgatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggagacaagtcatgcaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaaaaagaagaagatggccgttgttgccatcaaggaggctctatcactcttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctatctcttgtgatgatcttgtggatatgtctagctctagctcttgtatttctatctgtgatgcctcacttgttgttgagaacaatgagcttaaggagcaagt

SEQ ID NO: 53948 - DNA, 1145 bp, Oryza sativa
tgggacaaactacacgatcttgaggttgcccaaaagatgcttagggctctaccggagaagtatgagacccttgtcaccatgctcatcaactccgacatgtcaatgatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggagacaagtcatgcaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaaaaagaagaagatggccgttgttgccatcaaggaggctctatcactcttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctatctcttgtgatgatcttgtggatatgtctagctctagctcttgtatttctatctgtgatgcctcacttgttgttgagaacaatgagcttaaggagcaagt

SEQ ID NO: 53949 - DNA, 1501 bp, Oryza sativa; identical to SEQ ID NO: 39699

SEQ ID NO: 53950 - DNA, 1501 bp, Oryza sativa
ccagtttataaacttatgttgatttaaattattgcattatcgctttatttaaattcccgcgttatcactgttttatttagccatgcctatttacctttgttatgaccttattattattgctattgttattattaccttgttcaccctagattaaacaaaaccccaactagtggacactctactcgtggtatcactagtatgattttaggtagatgcttcgcaatttaattaggtaacattaggtggttttacaactttagactttgggaatattcatatcacctgggcactttggaattgttggtttattgtggaattggattcacaccgctccctctattcaaaagcccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggccgtaggcgggattgggtcggtactcttgtctatggctaggatgggttggaaactatgtcacgtcttccgtctgtataccgtggtggtatgtggcacgtggttacacgtgagaaagacgtgtcttgtgggtaaagatgtacacctctgatcagagtttaatctattcgaatagccgcgccctcggttatgggcaagccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgac

SEQ ID NO: 53951 - DNA, 1501 bp, Oryza sativa
ttcggaagtcggaggcgcgcttcgtcggcgaggggggtgtagaaccagtcgctcttccagtcatcccacttcttgtggaggacgcaaggaatgtagcggttcagcaccggcccccgcggctggaagtagcagccaccaaccaccgacggcggcgacaccggctgtacggtgaagaaccaccggaacaaccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatagcggaaccagccctgccattgcgaaagggaggaagaaaacggtccgccccgggtagcgtggcgccgggcgtccctcgcccagcgtaactatctcctggccggtggcagattccggcaggaagcggcgcggcagcccggcctgcctctcgctcacgatgcgggaaagcggcagcacgctaccatcgagtggagcagagccccgtgccatgacgccggaagaagagatgtttgagagcgagcgcgtgtggcgagggtagggcacaggaaacaaggagttagggcgcaagcggcgaagacaaggggaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtgaatatgcggctgtggcagtcgagatggaacatatcgtgcgcgcgttaattgcactcgccgaccgaagtgccatcaccatatctccaggcaaaacgaaccggctcgtcccgattcgtgtgctactcgagtaatgtggcagtcttgaagaggccgctcattattgacagtcgagttaccattgccgatgtgcgtgatttgcgaccgttgggtttctgcccaactgtagagaccagccccacttgtcaccaggcctaagtaagtggcgtcacgcccgaccgcttccctcgaggagggtgatcgccctggcataacgccgggggctactgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtca

SEQ ID NO: 53952 - DNA, 1501 bp, Oryza sativa
ttgcttggagtgtttggtgtcgcggtttctctcgttcttgtcttcgctgaatcgagcagcaccctgcgtcttggttggttcctgtttaccgcggtctggtcctcttttttcgtgttcttcgcttcccgtacccgtgatgttgttgcttgatgcatttgaggcgtggttttctcggagttggatgaggaggtcgacgagcaccgaagcttcatggttggtctccgttcgcctctctcccatcggagcacgttgatcttgacggttcctggcgcgaccaatgcgtgcgcgagaagttagacgccatgaattcgtttctcttctctgctttgtttttttttttggctcctgttttgcagttggtgtgttgcggaggtgtcagtttctgaatttgtataaaccaaatgccctcttcttattctttttgctgttcctgatgcaatctgcccgtcttccttacgtattgatcaagtagaacggcgcctcgttctcttctcgaattttaaggcgtttcggaatccgaaatttgctaagattttacctggccgtgatcatttttttcctcctgttcttggcttccctttcccgtgttgttgttgcttgatgcttttgaagttgggtgtgtgagtttcttggaggaggttgaagagcacggaagcttcatggtgatctcgttcgcctctcctcggaacatgttagtcttgatcttgccttccgtttctctatttggtcttgatcttgccttccgtttctctatttctaccagtgcaagctcgagaaattaaaccacatcaattcgtttctcttttcagtttgttctgttttggtatgctgcggaagtgccagtttctgaatttgtattagctagatgccttcttctgttcatttcgctgctcctgatgcaatatgcaggatgcttcttctctacacgtctctctgttttctgcctcgaaagaactctctgtcctattgtggctttgtttactcgatgctattttttcgttcaatgatttctgcatgtgtcgctccattgaattacttgtaaatcttctgattctttacctatcaaagaaacttccatctcttgaatcttgatttggcttccttctcccttaccgagatattgtgcattttttgtctgtaacctgtttttcacttctctgtgatggcgttcggtgccgtactgtactgttaggttgttcttgctttttttcttctgttcttcattctctgtttgcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcat

SEQ ID NO: 53953 - DNA, 1501 bp, Oryza sativa
tctccgatccccaaaactctcttgcgtcttgctgcccaaactcgtagaaccaaatatttatgtccgaggtgatctccttggtgttagacgaactggatgactttggtacaaatgctgtttcgccatcacgtgtaacaatgtcgacatggatagtctcaggccagtcatacagcctcgggaggaacaccttgttttgcatcaatctaagcttagtcttcctcaacattgtcgtgtatgtcccggtgaacaacgcatgtccttccaatgaccgcatcttctcccactccatcgtctcttcgttgagcttgacgacatggataggcgcaccactgtagccgacgaggacagccatgagcgcgccttggtcggactcaaacaggtggctatcaacttggtgtttgattccaaagcccttaggtttatcgggaactgtaaaattattgtcgtggttgcatggatcatacaccgccatcttcccgtcttcaccaagaacatacaacaaaccaccatggagcaccgggttgctgatcggcgccgccagaagttgcggtccttccacgtcaaagtccgttaattcccagggcccccactcgccgtcgtcttgttgggtcgcacgggcgagctgtagcgcgtacgtcgtgttgacgcaatacatcctccgcgcgtgctcatcgtagacaataaactcgaatgaatagaaaggcatctctggcagctcatacatggtgccggctacgagatcggcttggaggatcaatctaggtagacacagcgtgaggtgttgtccactggagcagcagatcctagccgcaattttgggcaccttgaggagcgtgtcggcgatctcgaaacacctgtggtagtaggggctgtagtacctgacgttcgtgacgccgatgtcggcggcgctcaggaggagaggcgtgatccacgccgggtagaagggcgacacggcggagcgccagtgccggcacgtcaatgcgaagctcgggtgggtcgaccacccgagccgatccaggacgagcacgagcatgtccaacgggagagacgaccagtcccgtagtccctgcgccgccgtcgcagtggcctccatctatctgcttggcgaatctcgagggttcgtgcaccgcaatggcctgcttggcgcgctgcgttttgtgctgctacggagctctgctttcttgacgtgtttcctccggactcatatataggtcggcttccgcttctgcttgtagtttgtatacccggcacggttggtttttgttggttgctatccaatctccatagatgcatatgtggtgatccctctttatccccggcccagattactgtttccttttactgatttaccggcccaaagtactagtactataatttgtttgaattttgatgtcgtgtaggaattcatgtcctaattggtactagtaatcgtaggtcgtaggcgtgcagatttcttcgcttctctttcctatatgccagtaattgcactgctcaaagcctc

SEQ ID NO: 53954 - DNA, 452 bp, Oryza sativa
ctagtgttttttcagtagttcctctgaattctctctttgtacagcttaaaaaaatagtaggggtaaatcttttgaacgatgctttcaaaagatttttcttttaaaactaaaggtttatgttatccaagacgtagcagaatataaggaatggttaaatattaaaccaacgtggcaagataaattttgatatgtatccaatctaaactgcttgaaagattctaaaagaaattgcataaaatatctaaaaaaaaaaggccaaaatgtctttcttttatgatgattttctcgggttttccacttaatattgatattagggggcctcattatccattaacaagataaagaaacaaaccttagtttttatttgcctacatgatccatagagagagtaactagaagcattaattcatgctcgtagcagtcatcacggttgttgtcctcccatctcgtca

SEQ ID NO: 53955 - DNA, 1501 bp, Oryza sativa
acttggtaaattatctttgagaaaatagtttacaaaatattaaaatccagaagaacaaaataagagtcaggttcaactcaaagccaatttttcgagtacagtatatatatgaaaatgggtactcctagggagtacatactcccgctcctattgaccgtccatcgaagcaagccccgatgaagcccgttaccggatccacacgcggtggacaaatttccgtccgcggtaatcggaaaatcgaaacaatgttgagctcgcatataaatccctctcgacagccctgatcgataaatcaggttgtcaacgggcgattcagagcgaacaacggcgattttgtgacatcaatccatggcacaggtgatatgagattctctttccgtcttctttgcttttctcgtggagcttcctcttgttatatcagtttttattgctcatgcacgagaaacgatctttaatacctgttcgagactagtaatcgagactaaactttttgatgtttaattagtaccaattgaaacaacatgtagtaaagatgcatactaagtaaaaaaaaataatagtatgtgagatttgaattcaacatctcgtagcataactgtacaatactagcagatatattcatagttttattttatttcttcttaacccttgtttagttctaaactttttcttcaaactttcaactttttcatcacatcaaaacgttcctacacacacaaacttacaacttttccgtcatatcgtttcaatttcaaccaaacttccaattttgacgtgaactaaacacacccttaacttaactatacctggtaggcattcttttcatttccctgtcctctgctcagaaattgtactcgagcagtacgtgttgagttccgcacacagaatgtaatacgtgcagaatagaacaatactagtactaccattatgtagatgtggatgtttctgttgtaaccatgataaattcatcatggtttcttcgggaagcatgatgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcagatatatgctaggcttcatcccaaccgttacaagcaagacattg

SEQ ID NO: 53956 - DNA, 1501 bp, Oryza sativa
caattttgacgtgaactaaacacacccttaacttaactatacctggtaggcattcttttcatttccctgtcctctgctcagaaattgtactcgagcagtacgtgttgagttccgcacacagaatgtaatacgtgcagaatagaacaatactagtactaccattatgtagatgtggatgtttctgttgtaaccatgataaattcatcatggtttcttcgggaagcatgatgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcagatatatgctaggcttcatcccaaccgttacaagcaagacattgtatgaagaagggtgaacatgcagattgataaactgacgcgtggtggacaagaatgaccgatttgtgaccggtctgacactggtcatgtcgtcggcagacagccatgttcccacgtcgcacctgcttccggcgaaagtggaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacattgcccgtgtcttgtgtgtttccactttcgcgaacattccacagactaggagcttagaacctcacccagggccctcggccgaaccggcaaagggggacctgcgcggtctcccggtgaggagccccacgctccgtcatctgacgcgccaggtagggggttctgcgtgtgtttttctaagctctcatactctttcgtgtgcgccaagcttttcctgttcagcccaa

SEQ ID NO: 53957 - DNA, 217 bp, Oryza sativa
actcatcattgtactgcagcatgtatgatagcctctaagttatgtcacatacacttttgtcagacggaagtacttaagacttacttttaggatgaaaaatggattattcacaggtaatggaaaaggtaaatctagtagcatgcaccagggtgggatagttggcagttggcactgacctcaggggtatacacgtatagaacagcaaagcctcccatga

SEQ ID NO: 53958 - DNA, 1501 bp, Oryza sativa
agaagaagaagaagaaaatgtaccatttattagttgcgatgggtctgcgttatggcgatacattttgtttagcacaactctagatcttaaattcacgttggatttaaagcaaattttatattttatttaaaataacaataaaataatttatttaaatattatcaacataatacatatctgaacttatggatttgtagaactagaagtacccaactaaaatagttttttttttattaatctggaattgtgccagcaagaaccatagtttgatcagtttaatttatgcacatatctttttttaataattgtacataaaataaatttacattaatagaaccagaagcaatccaattctgtttctaaattccgaccaccggcaaaatcctgataatgatcgattgtccccgctatgaacacgcatcttattaatatagtatgaaaaagaaatagcatggagtagtttaattagcttaagaacacgccttgtagagtgctatacctgttgtacttagttacggcgacacgtttgcatcaggcgcgggtgaattaactgaaaatcaatcctgagtatgtacgtaaccgaaaagaagaggctttcataaaaaccttttcttttttcttttgttttcctctttcttcacccttgcgctgccgttccgctcgcccaaaaagcaccccaatctttccgctcggagaaaaaaaaaagagcgattcctttgcgcgcctcgcgattcgtcgagctcgtcatcctcgtgatcttcctccttcctcctcctccggagaagcgtgggggcgcgcgtttctgctcgcgccttcttctcgttctcatcatttttccaattggtgtatatagcggcgtactcggagagatcggagatctgatctagtaggcggcagggtgggggtcgaccccgagggctgcgagatgggacccgccgccgctgacgacgccgctgccggcgaggaccaggctttgtccggtgagcctcctgctgctggcttgtcttggctttttttttttggtctgtctgaaattttggtttttgaagccacgtagaggttcagggatttgttgctgttattttcaagattccatggtttaatatgtggaattaataaaaagattttcgttagatgtttcatggacctgcgaatgcgtgtcattgaggttttcccgaaaatttggaatttgtttccttttctctattcatagggacgattcaatgatctgtggcctgctttcctttcctgctgatactaaggaaggattgaactgtcctcctttgctggttatattacatgcttgattttggtatatttcatctactttgttggacttaagaggatccctctctccatggttgttagacattgctaaattttttttaattaggtgttggagttgttgactagatttactagtaatgctcgaattgaggcttttagtcaatatttcgttcatttagattatggaatttgaaataaaactagtactttttca

SEQ ID NO: 53959 - DNA, 533 bp, Oryza sativa
agtccccctagccacctcagcatcaccccgccacattggcagggggacggcgccaaagaggctggcgccgtcctgttgaacgacggcgccagccactctggcgccccaaaaaggaccatttttcggataagtttttctaagggtctacttgcgaaataagtttttcaaaaggaccaaaatgtgaaaaatccagcaccacgcgacgcatccggtcgggaccatcccttccttccctccccttccctgccaaactcccagcttcgcgctgcctcgctgccgctgccgccgccgccgcgacccccacttctccgccagcaaagcgagctgctctgctccggttgccttcctccctaagcctgctctgctcgcgggcaccagattcggcgggcagcgaagcagacagctctctccgcccctgccttttctgtttcttgattagtataatatcaattaggaggcttttctttgctttcgatgggtgtgtgcgtgcgtgttggtaattttgattagttagcggcccatcctagccacgc

SEQ ID NO: 53960 - DNA, 245 bp, Oryza sativa
ttagtaatgcacgatgagtagcgcggcttctgccccccaaattctgatgctgatgagtaattctacctgtagttgtgttgttagtactatgttgtgccaatgtatcatgatgcaagaaagtatcgattaaccgcctatgttcaaaactgaaagtatcgattaaccgcctatgttcaaaactatccaagaattatgagatcctgaggtagacttacacttttttttaatgggttctctaatctttg

SEQ ID NO: 53961 - DNA, 362 bp, Oryza sativa
caaattttaagttgaatgttttaaaaattgggtagagtttttacaatttttgggtataaactttcaagagctcaacaattgttatgcctccgatccaatttatccgtcccttccagtaaagttaaatagcagaatgattaaataaatatgaacaggacacagttaaaaaaacgacgcacgacatccctttcatctcaccaacaagctggagtcgcactcttgcactacagcattgtaatttacagcattcaagtggtaaaaggaaaataaacagcgagccagagatcgcaattacaggagacagcaaatacaagggcgtgtcgctcaatctcatgggctcctgcgaagcttgacacgagcca

SEQ ID NO: 53962 - DNA, 1501 bp, Oryza sativa
tcctttccagattataaaatcgtttaacttttttaagttaaatttttaagtttgtagtagaatatgctaatattttcaatacaacataaatatattattaaaatatatatttaatgttaaatttaatgaaactgatttgacatagaagatgttgctaattttttctataaacttggttaaacaaaataaactttgactaaaaaaagtcaagcacttataatatgaaacggagggaatagtatatactctaagagtaagctctgtatagtagtaaagctttgtgtttgagccggccgtttaaaggtgatatgatcgtgtgtgcgcaatccatgaagtgatgatgcataagaataacgttacgaacgtaacctggtgggcggtggctgaataaatactattgtacataaatttggatcaatacattattaaacctttcaaatatgctttttaattggagagggtgtgttcgatgcgcatctcaattctagatctctcaagactcactaataaatactatataggagtatataaatatatatattaaatacaactctagactaattttcatagtaatacgaacggtcttaattaattactaactaatatatgttgcctctcctttcgaataacctcatgtctacacatagtaagcctttagctagctagactttagctactattagcatcttttgtggcttgttagcggctaatatgttcagatgactatatacatctttcgatatagctagagggcaaaaatattgcatctattacttaggaacaattacaaaaataacatatatggcttttcagacacatatgcatgatcagtggcggagccactacttgacaggtcgagcggccaccgggtagagatgttcgatcttcatcgatcaaaccagactcaacggcgtacgtcgctggctccgccacagcatgattatgactgaggttaattaaataaaagagaagcaagtagcaatgagactaccactcacgaacgtccaacaagtagcaacgactactcatcaacgtctccaagtagctagggacgatcgagtagcaacgatacgccaaaatggcccaaagctagctagcaaagccgcccaagctaaagctagtgcacgctccagccacagaaaaagcaaggccgctgctgctgagactgagagcgaggcgcgggcccggaaaaatctccgcggccacctctccgccaatggggcggcggcgcccacgtgacatgcctccacgtccccctcctcccccaccacctcccctatttctatctcctctcttcttcttcttcttcttcccccatagtttagatagataagtaagcagtgagctacctagctagctagctaacagtgagctgaatcagcagcggctcctgtctcctggagcttgctgatccagtagtccagtactactctgccattagctaagctagctggagcttaattagtggtgatctctgtctctctcaagctaggcgccatgg

SEQ ID NO: 53963 - DNA, 366 bp, Oryza sativa
gccatcgctggcatcaagcccgggctcgcgttcatgcagcaagggcagttgcaaggacaaatcttttatataaccatttaaatcacatgaactaggtggtatggcacctatagatgtagaaaatatttttctcagttgcaacacttgaagtcaggcaggtatattcgtttgcattttgacttgacaataatacgttaggctctttagtagtactactacttagcggcagtttggaagttctttcatactcctttttattttttgtgaggaagagaaagctttattgattactcaacaacttgttgagattcacggttcaatagctccataatacaagcaggggcatccatacgctaaacagaacaa

SEQ ID NO: 53964 - DNA, 1501 bp, Oryza sativa
tctgatacgggtgtgacatcagaatttcaaaactaacagctcacaccaaaagcgctcggtttccctattcaaaccccaaaatcttcctaataggttggaaaatcaagtagtgaagtaacaagtatttgcactaccgccatctatcatcaggaacattcagataaattaaagcaccgcatctaaacttaactatacttcagaacacagagcaaactagcaaagtggttgtgaacttgcaattaggggatacaagaacacgagggagagctcacgctttggtggcggcgtagacggagtagagcggatcggacggcatgacggaggaggagccggagccgatgttgacgatggcgccgcgcttcctctccaccatggccgggagcacggcgtgcgtgacccgcgtgaggccctcgacgttgacccggatcagggtgcgcatgagctcctcgtccacctcgtggaggtagcgggcgtacgggtacgagacaccggcgttgttgacgagcacgcccacctcgagcccacggatggcctccctgagcccctccaccccggcggcgaggccgtcggcggcgaagtcgagcacgaacgtccgcacctccaccctggggtacctccccctgatctcctcggagaccgaggccagcttgtcggggctccggccgacgaggacgaggccgagccccgaggcggcgaggcggaacgccatggcgcggccgatgccgtcggtggcgcccgtgacgaccgcccaggcgccgtagcggcggcgcaggggcttccccgggcggaggaacgcggcgtagagccagagcgcgaggcggagcgcggcgcgggcggcggcgagcaggccgacgcccgccagcgccagcgcccacgccggctgcgcgcggaagaactcggcgtgcgcgcacgtgccggccatggcgtggctggcggcggctcgcgcgaggatttcggggggagcggagaagagagatgtgctgatgctgatgagttcgatccggcgcggtgcggaagcggtcagagctatattagctgggaacgtggggttggtggaaccggtgcaccatccagggtgatctgctggaataccgttgcacgctggctttgagttggtgaaagacccaaaaagaggctactccatctatttcatattaaatcgtttatttttttctcaaactttttaaaatttgatcaagtttatagaaaaatatagtagtatttttaacacaaaataaacatattatcaaatttaatgttaattaattaaatagaaaaaccacttaacagtattccataggcacaggataactactgccactaaatttctaactctcactcctcacaccatctattcaaccttatcctctcatcactttcccttccatctcctctctccctctctctccttctgactagcaccctcatggagcacggaggcaacggcggcaactggccttgcagggtggcgcgtcgagcgtggaggaagctgccatcaccg

SEQ ID NO: 53965 - DNA, 989 bp, Oryza sativa
ccccccccccccccccgaaattttttatttttgttttatttgtttgatattttttttcatgcttaggaacacacaagaaccaaccatagaaaaattgaactcaaatggacgtaatatgtgacatgtagaatttttcctctcctctcttctctccgaactagtgcagaggagagagatgtgcaacttttttatttttattttatttttttgatatttttttcacacttaggaactcacaggaaccaaccatgtaaaaaataaactcaaacggacgaaatatgtggcatgtggaattttccaaagctccaccgaaaaacttctctcctcgaaaacacaatcttgcaaacggaatttgggggatttaatatcgccgaacccggcaaagcggggagaattggatgtaactttttctgtagatgtctgtgcatatattattttcctgatttcgagtccgtataagaaagttacgcctatttaaatagatgacatattttgtccgtttcggtagagttttggaaaattctacatgtcacatattttgtccgtttgagtttattttttatacggttggttcctatgttctcctaagtgtgaaaaaaatatcaaaaaaatgaaataaaaataaaaaaattgcatgtctatgtactgtttaacttatatatgtcatttcatatgattatattttgaattagattaagtaatttcatatagtggtagagtgcattatgtttaacatgctaatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacagagaaacagaaatggaggcggcggcgccagccatgctggcgccctcc

SEQ ID NO: 53966 - DNA, 304 bp, Oryza sativa
ccccccccccccccccgaaattttttatttttgttttatttgtttgatattttttttcatgcttaggaacacacaagaaccaaccatagaaaaattgaactcaaatggacgtaatatgtgacatgtagaatttttcctctcctctcttctctccgaactagtgcagaggagagagatgtgcaacttttttatttttattttatttttttgatatttttttcacacttaggaactcacaggaaccaaccatgtaaaaaataaactcaaacggacgaaatatgtggcatgtggaattttccaaagc

SEQ ID NO: 53967 - DNA, 1501 bp, Oryza sativa
tcgtcttattcaaaaaatttaagtaattattgattcttttcctatcatttgattcattgttaaatatatttttatgtaggcatataattttaaatatttcacaaaagtttttgaataagacgaacggttaaacatgtgctaaaaagtcaacggtgtcaaacatttcgaatcggagggagtacttgtcttagttagatttgcttggggtttaaaaattttctagctctactactgtctagaaaatctagctctgtatacatgctttcatcaaaatatcattctagatcatgttttgcttgccaatccatctgcggaaactgagacctcccaaacacttgtatcactaagggcattagcagtgcgacaacacattttgctgaacctcatgcgtcacataggctcaagaacacctaagaataatgtttaacacaagtttcacagtggtacctagtctcaagtggggtccacacaaataaaaaagtattttttttctctctcccttgtcctcccagtgccacgcctcccctccccctcctccggccatcgcgcctcccccttcctcctcctgctatcgcgccttcctgataagcgacggcgccgggcggcccaagcggcgacagatctggctgcggatcaagcctccccctcccctcctcctccggccaccgcgcccctcctcatcctccggccagcgtggagtggagctcgccaatgtggatctagtggtgggcaacctcgacctcctctccggtggtgcggatttggtggttggccggtggctacaaggggaaatcaacgttggcaccgccctccctcccctcccctcccctcccctctcccctcccactgccggccggcacctcttaggagaagatgcggaggcggtggtaggtcgatggaagcggacgcctctcccctccctctccccaacggatctgccagtggcgatggttggcgggggtcttagcggcagcggcgtaggtcggcgacacagattgggcggtgacaaaaatcccggtatgcccctccctattccggtcatcgtctctcccctcccgaagattttctctccactcctgacaaaaacctgacgaggaacggtgatccattttagtttcccattctttatttggtcacgggagaaacatacgaggcataaaatctttggacgtgataggttggaactgaatgccacctatatacactgtgaatggcctaataccgccagtttggcacgattggcatttatcgcctgcagccgtgcgtgcatgcccatgcagcggtaacagtatgtatggctcatggctggcgtgatctgacacaaaacagtgctaggatagtttggagagcatgaatccaacacgcgatcaatgggttgattaaattaatttcagctggatcgtcggagctagccatgcgcggccggcccggggagaatccaaatccgattcgagcctgcatgtggccgagattagccgatcgattagctcaaaaataatgg

SEQ ID NO: 53968 - DNA, 196 bp, Oryza sativa
cagcgtgacataccatgtatctcggccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcagg

SEQ ID NO: 53969 - DNA, 221 bp, Oryza sativa
ttatataagaatattcagagccatgtatgctctaggtgatgctctgcaattggccctcagtctagctatgatcacagtatatactcattttgtttttctgggctattacttgacgaaacagttgtaggcagacggcgtccgctgcttcctccctggcgctgcagaaatgtttcaagaacatgcttaattagcccatcatgatcgtcattatcatcttcaga

SEQ ID NO: 53970 - DNA, 1501 bp, Oryza sativa
caacccagggatgcaagcggtccaacccgcgaacctgcttataggtaaaatgagtgaataacccgcgggttgacttgtggattacctaataatttgatatataaataggtttatgggttgatccacttgcttctctacgacgcggcaaagccgagtcatgacgcgaaaacctgcggattaccctttatttaacatataagtaggttcgtgggttgcaccgcttgcatccctaaatgtaatgcagggtttttcgccaaaattagccttgctaaattttggcacactttgacgttaccagattttggtaacgttggatgtattcagtttgtggtcctgccaaaatttgatagtgtttgtattaggagaaactttcgaaaatgctaaattttggtgaagtggcaatgtcaagatttgtttagtttgttatcctaccaaaaaattgatactatcaaatattgtgagggttgagattggcggcgaagtgaacaagtccgtaatgcaaaaaataatcttgtgcttgtgtccaaaatggcaaaatgttactcaactcaccaagctggttgaaacttgaaactagtgctttcaatatactgcagcttgacttggagtggtgaagagcgaaacaattgtgtgccgaaggaggagtttcagctccttctcaatgtcagttggagatgtcaattcgtataaatggagtccggatttctattcactatctgaaaaatgtcaatttaacagtgaaaagtctataagtagcaactgtaccagaatctgctctgcacaccgtctgtatttctccaaatactcttcaactgaaccaagttttttaatagatggcaccgttaacttttggatacatattttactattcatcttttttttttaaaaaaaaacgtaattataatctagtttgggcgtgggaaacggaggcgggagcggtgaactctgggagagagccggatttgttgggcgtcgtcgtcgcaggacaaggaggcggcagcgcgagatgaggagggcgtgcgtgggggacaggtgctcatcgggatgcggcggaagcagcaggacagacgacggcctcggctcctctcccgtcgcccgttgcccgcagcctcctccgtcgccgcccgtcacacgcagccgccttcgccctcacccaccgcttgccgcccgccccggccacggctcctcgcccttgcccaccagccacctcctctgttcaccaagagagagagagggggggcagagaaggagtttttatttgttttttctgactgtatcgccacgtaggctgaaaaccgcttcgaatcaagttagggtggtaatttatccggtttgaagagtttgggatgctaaatgtccggtattatagtttagggggataaatcatactaccgtaatagttcgcgggggtggtaattcgtactttttcttggaaatttcggatccaattcaggatttttcttggaaagtttcgggaagaaattggaatggaataatataa

SEQ ID NO: 53971 - DNA, 1501 bp, Oryza sativa
ttctgctattggatattcccatgcacttctattttcctttcttttggggttatttgtatccacacattttttaacgggaaattctgagtttgatagtggtaccatttatgtgtaatttattgttttgcacaaatataccgttgcgcgaaaatgacaatggtgtgatgacgccagttggtgatgataatattgtgctcgatgatcatacacaatattctgcatgactttatttgtaaacaaagttgtattgtggcagcgaagcaagaagggtaacaaccaggtgagttagtgtgggctttagttgggccctcgatgggctggccaagcttccactgacacttgggccgcatgaaggccgaccaccacaagcacgccgccgcggctggccatggcctccgcggccgcggccgccgccgccgccgtcgccggaggacggggtttctggtcgatcgatagtccgcgccgacgagggcgctcgcagggaggtccgggcatggcgttgcattcgtcgatccgctgcaactccaccactaggtggcgccgtatgtggtggcgcgtgcggcgacgcggagagggaagaagaagagagcggctgtttgctcgcgcctcgcggcggccgcttcatgcgcctgcgcactagcccgtggtacggctcagtttccccgcatctcgcaaccagttttttctttggttccatgcttaattactgttctgtaattctgtttaggaggtgaaagagattttttttttttaagataatggattttcattaactttttgccgggtcagcgaaggagccgaccaaatttcgaggattttcattagtccaggctctatattgacgaagtatatgcacaaccaaggaggtgaaagggatggtaaaggactaacggcctgtttggttggtgggagttgataatggggaatgagagtgtatgatatctggaagtttaagtttgtagtttgattgaaagatttgggaattcgaaggggtttgggatggggaattaagaggtccaattcccaccaatctcttacctggaggaggcctgttaattcgtgagacttggagagaattcgatgtgaaacaaaagaaaggatagggactaaaaatataactcccatgaccaatcccactatcaactccctccttaaaacttccattcctctttccttctcttcaaacaggccgtaaaggttagtagccggaactgaattgattgcagactttgcagtgtcgactgatgcttagctttagcccaagattgcaaaccatcaaatctccggtctaaaagagtgtggcagatcatcaatcccacctaggacggtcaaaagctcaaaaagagggtagtcctttaagttgattgacgaatcaacaggagattagactagagtgatgtgttctctccaccatacacatcaaacaaagacgcgcttagcacccaactctgacttgctcactttttttttctctctccctggaatcatgcacgtcactgcc

SEQ ID NO: 53972 - DNA, 457 bp, Oryza sativa
ttacaatgtattttcttgtaagttacagtgtaatttttaaatcttcgcatgtaagttttaaaatttatattggatttggtctttttcttgaagatatggtcatttagtgtctattatggtgtttcttaattgcttttttgctttttactgtgtccattgaattttaattcaaagattaaaaatatatgtaatataatcataaaaatctttcgaaagatgtatatgtactccctttaaacaaaccaaacaaccatattttaccaaaattttgtcaagccaaataaaatcgcttaccaatgttttggtcacgttttcccaccgaaaccggttgaaaacaacacaaaattgtcaagccaatgtcttgacgtgggacgaaagcagttctcgatgaaatttcaagtggttttcaagaaattcaaattttaaatattaaattcaaccaaaattgattaaagaa

SEQ ID NO: 53973 - DNA, 1501 bp, Oryza sativa; identical to SEQ ID NO: 42281

SEQ ID NO: 53974 - DNA, 266 bp, Oryza sativa
cccaaatcaaatcccacaagattgctaacttgctgcagcatgtgtacataaagattctgttgcttttaatgtattgataattcacttctaatggaaatcgatttccaatcaggcaatcatgcagcgtgatggtctatcgcacattactgaaaaaccatgcctgatgtatcaaactttgttgcacaaattattgtggtaccaaaagctgcattatataatgctcataaacagtctctctaatcccattcatgccatttctgtgcaga

SEQ ID NO: 53975 - DNA, 1501 bp, Oryza sativa; identical to SEQ ID NO: 42282

SEQ ID NO: 53976 - DNA, 1501 bp, Oryza sativa
ttggtaagagtggatgacacattaacactacttacggatcaaatgacatgattcaaagttgttgatagagacccacaggtgatcgggataacgcctatgccctacttatatatcctgatgccaatatgcctgaacaaatgtaaaagattaaggttaatgaaaatgaagactaatccagtgttgctcattgtctttgtgttgctatataaacaatgaatgactcaggcagtcaggcactagcacccagaacccttcgcttcccaaagaccccaacaattacttattggttcatagtagcataaaaagtgccagatgtatttagtctaaagagccattgctcaatggcagggacgaagggtaatattgtgcacttcatatttaatactgtaacaggtggttatgaggaactgggaccatatgaggatcccgctgactatgattggaaagttgatggctgacgcaacaaagctgtatatgaaatattcttaccaatatggagataatattggccaggcagctaaatccatcatcaaaatgctggttagctggtaaactgcaactgtgaacttccgcggaacatgaaataatctcctaaagaaaaagggtaagaaacaaatgaatgtaatacttggaacctgagtgacagaatcaaacaaattccctcacaaaacagaaatcagttactacatgaactaagtaatttgatgccataaagacatttcacaagccattctacatcatcatcacaatcccaaaccactccctctctgctccgtgatgataccttacactacagggttaaagccatgtgctaataatagattttatcattacgttctaattcctcaaccccaatataaagcaaatgctcagtcagtcgcataatttcgactaaacctacagcagttcaacaatcaaactgaccaaaaaaaggctatcggaggcaatacctgatccaattcgcacccttcgtcgtcgtcctcctcctcctcttcctcctcttcctcttcccatcctcgaatcgccttacttacctaaaaaaatcccaaaaaaatcacggaagggaagggcaatagagcgcagcagtaacaatcgcgaaccctagtgagaggattactcgggagagcgcgaggaggatccgccgctcgtcctcccgtgtgagccgcgtggccggcggcttgggttcctgtgagcggcgcgcacggagtgataggctaggactaggagaccagagtcatcagaggccagtgcagagagctgcttacgaggtgggggaggagtgcgcaggcgacgaggtcgcagaggcgagcgagctgccgcctctcccgccgccgccgcgccattcgcgtcgcgccgcctctccccttccggtggattcgaattgggatttcaaattcggagaaaagtttttgatttttgcctgaaattctcggaaattcattcgaggttggtaaatttattggcccattgcgctaatgggcccggcccatcattacactac

SEQ ID NO: 53977 - DNA, 1501 bp, Oryza sativa
ccaatcaactcaagcatgcatttgtatttgtcgctttattaacttgtaggacagaacgatagcctcttgatctttgcatcattcaagagttgatcgatcgggttatcatcatcagaaacatggccggccctgctcatcatgcatttctccaacttaatcttttcatttgtaactgaggattaattatccactgtaaaaatgtttgtgtggctaataaacagtcaaacagcatttcgaagttattttaagtattcatactttataactttaactatgttatctgcacttggagtggatgatacgtctctaatcataatcaaatcagtagtagtagatagtatcataatgtgtagagaggtatagccgtatagggggtaagacaaacagtgtagcttgcggtgacagtaggtcgtctcgtctgaaaagattcgaccttaattagtttgactcttggtttagcagtttagcttacgctggagctaagacaacaggggcaaacagacacagctgacaaccgagcccaacgttgaaaaggctatcataaattcataattatgctagacacattagagatttgtttactcacctggttagcttattctaatcatcattcgacacccacatgggcacaatagtaaaaaaaattatactaagcaaactggtacagttgttctaattgcaaaacaatgtaaaaaaaagtacagtataaccaacactgttctctcttcttcttcctcttcatgtaaaaagagttgcacacgctgcaatcagccgtagaggagcctgtgctgtcgccagtcgcctgaattttctggaggaggcagacaagacgggctcatttccatgcttgtgttgcattgctgcacgatcttcctgtccatgagattgtgacttgtaatggcgaaatcttcagaaaaattctccattgaattgccaccgaatgtccatgaaccctaggtgaagtacgagcggcagtatcacagctctggctggctagctagatctcgtttaagctggcaatggaaggtactactgtactgtcagtgaagtgatattaacgcagatacagtgaccccatcgctgggacaggatcttcttcatggtgcaggagtaattaaacgcctcttcaacggggttcttgattttacctgtctggtgcaggacacggtactacatgtacaccaacttcttctgaaccgagagaggtttcaatgtaacggatggacccccaccacacgatctcttattgcacaaccagaatccttctttagaggacatgaactgataaaaggggaacttgaatagtagtaatatgtttttttcagtactaaaattatgtcttgaacataggcctcactcccgcgagggcggcacgggtggtgctaccgtcgccgcccatctccccctccctctgccttgccatcgctagagcgagcgggcgacaagacgtgtagcgtgctaggatagcaacggtggggctctcaactatagatataggggc

SEQ ID NO: 53978 - DNA, 1501 bp, Oryza sativa
aaagatggacgatatcagtgacttggtggcatgggcaattcgcctaggaaagaaggaatcccttgctacttgtttggcctcttgttcttcctggacacgctgcctgcacatgcgtattgtgtcatcacactcttcagcaacacgtttcagcttcttctgccaacgtagcaacggctcactaatgatctgccacttcttggatgtctcaagtgcaagatctaacttgatttgtgccatctctaacctgtccatgtgttcctgcgcacttgattttcgctcatacttgtcaatcatgccagatatgattttgttcactgtctcatgaacgagagcagaactgaccacctcccccatcttcagtaatctgtaggattccctccctgatcaagaatcaatatatactatatcaatcactaaatcaaaagacagaccagtgaattcctaataagtactaacaaagtgcaatgctgtaggatatgaaaaggccagccttctgaattgaatcaattttgtgatataagagatattcatgcagggggcagtgaaatgaaataatgcatgattccatacagaaaaaagtgagaaattcaaagttcaatgtaaggcctaaccttctgggttgaatcaataagaagtaacttggggccttgggggtcagacaggtgcacccagagagagagagtacctagcacaagataactggactgcagttttcaagaatgaacagtcctgtaacacaaggaggtatttatgcaggggggcagtgacgtgcatgattccagggagagagaaaaaaaaagtgagcaagtcagagttgggtgctaagcgcgtctttgtttgatgtgtatggtggagagaacacatcactctagtctaatctcctgttgattcgtcaatcaacttaaaggactaccctctttttgagcttttgaccgtcctaggtgggattgatgatctgccacactcttttagaccggagatttgatggtttgcaatcttgggctaaagctaagcatcagtcgacactgcaaagtctgcaatcaattcagttccggctactaacctttacggcctgtttgaagagaaggaaagaggaatggaagttttaaggagggagttgatagtgggattggtcatgggagttatatttttagtccctatcctttcttttgtttcacatcgaattctctccaagtctcacgaattaacaggcctcctccaggtaagagattggtgggaattggacctcttaattccccatcccaaaccccttcgaattcccaaatctttcaatcaaactacaaacttaaacttccagatatcatacactctcattccccattatcaactcccaccaaccaaacaggccgttagtcctttaccatccctttcacctccttggttgtgcatatacttcgtcaatatagagcctggactaatgaaaatcctcgaaatttggtcggctccttcgctgacccggcaaaaagttaatgaaaatcca

SEQ ID NO: 53979 - DNA, 1501 bp, Oryza sativa; identical to SEQ ID NO: 42284

SEQ ID NO: 53980 - DNA, 1501 bp, Oryza sativa
tgtaaagagaactagttaacatatcaatcttttagtgtctgatttggttcaggtcccctaattttgttcatattgtgcaattttgcctgattctatgtgcagttgtgaactgggttttgtattagatcatcttacgaattgaccggtttgcagcttggataatcattatagctgctgtctatatataatgatattattgtatttgattctatagtgtaaataagctaaggcaggtttttgttttgtctgatctaattttgtcatgaagcaaaaatcttaaacatgatctgatatgactggtctgttggtttaggccgtttgtcctgccccaatttttgcaaatgcccatacccttgtgattgctctgtcctatgaacatccattccctgtttcaggtggatacaggacagccgtgaccagttcactaaggagcgcctggattccatcaacgacgagttcaagctgtaccgctgccacaccatcaagaactgcacacacgcctgccccaagggcctcaacccagcgaagcacatcgacacaatcaagaagctccagctcgaggcctgagtgagcagtatatctctcttcatgagatgaaactctgtcgaaaaattgtaatcagccagcctcttgtttctctgcctttttagtccatcgcctgacgaataattgctggaacgcaggattcccttctgggcctccgatctgatgacttccatttccatcagatggagggagcattgtagggagtgaataatttgctaccgtattttacgttttgttctgtatctaattcggtttgttgttcaccgtccattccattatgtcgtgcggtttatgcatgaagtaattcatggattttacctttgtttttgtgatgttgaacatgcccttcatatttttaacccggaaatcaacaagcattctccgtaatctctggttagtgatcgggtttagccatatagtgaatcttaaattgaagcaaaacgaatcggatttggttcctgtgcagttcttggtattactgcaacttaggcggtcatattgtggctgtaggatgcaaatccaaaggcccaaatttaataggacactgtttattcagacaatccagcacaaaattattataacaatcatagtggcaaattaaagcgtgtaatgatgcatctaccaaatgctaaattgctaatggtgggatattccagataacactagaatgattcagacaggccaagcctcccaaggttttccatctcaccagcaggtgggacccacccccgttttgctcccagccaatggcgtcgcgaggcgcgagataaggctgcaaacctggagcacacactcgcctccttccatcgctgatgcagataagccgcgatcgcatccaccgttctagaaacgcagcgacattgcactcaccatctcagaaattgcatccaacagcagctgccatagttgcaagtgagctagagctcagagaagagaaggaagaagaaggcgtcaa

SEQ ID NO: 53981 - DNA, 461 bp, Oryza sativa
tctctctctcatcatttatcttcttaaaatatgtttgcagctagcttatagcctgctattgtatcttctctaactgtaatacattatgaataagcttgacaaatatcttgaaaaagatacattatgtcattgaaacatttgaaaaatacacagacaaaaactagtgtgcaatgaaccaacattagaaaaacatgtaaaaaatatgttgataagtagagtgcaacatcaataataagtagaaaaaggcgaaaccctgttaaattcaaggtgaaacattttctggaacattaagtgccaactatcgaagcatcaaaaataacaaatctaaaaacatgaaacacagtcaatttcaagatataacatttcactattgcccgtgaaaaattgtagtccatttgttgaaacatcaagatttgcaaagcataccaatatggctttcttcctcccgcttccacaccagg

SEQ ID NO: 53982 - DNA, 1501 bp, Oryza sativa
tagtggtatcctattaatttaatgaaattaaaaattgacaattagcaaattgtaattgatgtctattcttctttcaatctaagcttataattcactcccactagacggatgaatggatagaaggtgagtgagaaaggaggaactattactagatatgtagtggcagcaatttattcactgcttttcctattaagatattttcttgaagtacccagttagtataagtataggtagatggtatgcataataaaattctcacctttgcctcttaggctcttactaaagaaccgagatactagccactgatcccaactctgagaagatttggaagctggccaggtcacatgcagagaattggcctagtggcgtactggtgttattgatttgtattgatggacctggacaaaccatgcatgtaggacagtaggagtaagcagctgtcttacaaatgaactaactgtctatatatgaagaagtagagcagattgagattattgtaatattactaaaccttaataatataatgagtattcaaaaaagtaatattactgaagttgaacatatgaaagacagaaagagacatgaaaagtttccacgaaggaggaggaaagttcctaattaagatgtcacattcacccgcaaaaccgtaggaagttgcaaacgagggtagatttacattagcatgggtttgtctaatctgtgtttatctacttaagcgcgtcatttagccaaaaattctgtaatcaactatgccatttccgcatttcgtttccaagataggagtaatcaatacttgaatcgttctcccaaaaagaaaataaaacaatccaatccttatcatgctcgctggcggaggctactcagtcatcgacaacaaatcttgaattcttaagatcatcacccaccctaccacttcttttatctggtgtttgttgttacctaatgatgatgggatcatgtgacagaaggtgccttagttccctgcaatttacgatcatatagataaataggataagaccctatagataaatgatctcaattaacgcgaaactacgctataatcgcatcgatgaaaaccaaagtggaaactaacacgcgcttatattaatttattagacccaaaactcagtggaaattataggagactactagaatgaatcaagcggaaaatgaaattgagaaatagtagttggtgcatgtacttgacgcgcggtggcaggtgaagcctccttcatcctcttcaccctttgcctccgcggcttctccggccgccggaggaccgcctcgcctcgccggacccgtaccccgtcgtggtcgacggcgccaccgccgccgccgccttcctcatcgccgttcctctctctctccggttcttccccttgtgactcttacggcctataatactatgggctttatctaatgtagtgtaatgatgggccgggcccattagcgcaatgggccaataaatttaccaacctcgaatgaatttccgagaatttca

SEQ ID NO: 53983 - DNA, 1218 bp, Oryza sativa
tttgattgatgactcatgagagaaagagagggtttacctttccaatggactgacggatcccaacttctagctgtacagtgattttcgtcattctttaatcaattttggttgaatttaatatttaaaatttgaatttcttgaaaaccacttgaaatttcatcgagaactgctttcgtcccacgtcaagacattggcttgacaattttgtgttgttttcaaccggtttcggtgggaaaacgtgaccaaaacattggtaagcgattttatttggcttgacaaaattttggtaaaatatggttgtttggtttgtttaaagggagtacatatacatctttcgaaagatttttatgattatattacatatatttttaatctttgaattaaaattcaatggacacagtaaaaagcaaaaaagcaattaagaaacaccataatagacactaaatgaccatatcttcaagaaaaagaccaaatccaatataaattttaaaacttacatgcgaagatttaaaaattacactgtaacttacaagaaaatacattgtaaatttgagtgagaaaatcgaatgagagataaaaaaaaatctttcgagtgaaatatagcaaaatcgttgtttaaactacaaaatctctatttacattcctgccacctgtttgagcctctcatgcaaattaaagctgactagagtacttagtttggtacttggatttaggatagtattaagtagagtgagaggttttctgagagtcagattgcgatgtgaattgtgaagaatacttattcctgcttttcggtggaagcagtttcttcagtctttgctcctaatttgtaagattttttctttttcttttcctgctactcatcaagttaccaatgattgaattggaaaaactttagattctaaaaagcagtttatgtgaatcagaatctgaaattttagtttctgattgttttttagtatttcactttattttgtagctacaactttatcatagtttgagaaaaagctagacagtttcgtagctctccaaacaggccctaagcccctctctctaatgatcaactcatctactgctagttttgttaaacccatacgagaattgaacctttttcacgcagaggactgaagaacaggtccatatttcaccaattcattcatcagctgacaatctgacgcgcacatgcatcatgcacggatgctgcatatggctgtgctg

SEQ ID NO: 53984 - DNA, 1501 bp, Oryza sativa; identical to SEQ ID NO: 42077
